United States Patent 10,667,523 (SEED ENDOPHYTES ACROSS CULTIVARS AND SPECIES, ASSOCIATED COMPOSITIONS, AND METHODS OF USE THEREOF) - sequence listing, part 2

SEQ ID NO: 2442 - protein, 384 aa, Unknown
  Kingdom: Fungi, Phylum: Ascomycota
MASSDFDPERVNLTDAGDDLQTQITCYLTQTGNEYGGDNLGIRIGSIFVIGVVSTFVTFFPVVAARIPRLRIPLYVYLFARYFGSGVIIATAFVHLLDPAYDEIGPASCVGLTGGWAGYSWPPAICMSAALITFLLDFGAEYYVQTRYGLPHCNHAEVEDTITTGNNEVSHQALHSGDVDREERAVSKRNGSSKDERSYSGYDDMSELKHLTGDSEATELAFKTQIAAFLILEFGVLFHSVFIGLNLGVAGRDDFDTLFPVLVFHQSFEGLGIGARLSAIPFPSRLSWMPWVLCIAYGLTTPIAISIGLGLRTTYDNSSFTANVVNGLFDSISAGILIYTGFVEMLARDFLFNPERTNKKSRLTFMIFCLFLGAAIMSLLGKWA

SEQ ID NO: 2443 - protein, 683 aa, Unknown
  Kingdom: Fungi, Phylum: Ascomycota
MASLRHLVALAASASTARALWTNGSVIAPCDSPVYCHGDILEEIQLAHVFEDSKTFVDMPGLKPLDEIREAFDKLDKPLKNNSALNDFLDEYFADAGGELAEVSKDDLKTDPKFLDDLDDDVVKEFVEKVIDIWPDLTRSYNGSADCEHCPSSFIPVNRTFVVAGGRFREPYYWDSYWIVEGLLRTGGSFVEISKNIIENFLDLVEEIGFVPNGARIYYKNRSQPPLLSLMVKTYVDYTNDTDILERALPLLVKEHDFWMTNRTVDVEMGNKTYTLNRYNVENTQPRPESYREDYETATNESYYAESGIIYPQTEKLNDTQLELVYRNLATGAESGLDYTVKYSKRPEDAARDVYFPLRYLNYVETVPIDLNSILYGNEMAISEFFNQTGNDTAAREWADLAKDRSEAMHAVLWNETLYSYFDYNITSGEQNRFWPADDDTKDWEKESAPKGQQILFSVSQLYPFWTGSAPAYLKNNPLAVKQAYSRVSKYLDESVGGIPVTNFKSHQQWDQPNVWPPLQHILMKGLQNTPPTFGEDDQAYKDVHDTALTIAQRYLDSTFCTWYATGGSTSDTPQLDGLSDSDVGIMFEKYADNAINTAGGGGEYEVVEGFGWTNGVLIWAADEFKNELKRPDCGDITAAETTQADDGKKRKRSAVEIHPKDARRTKRFGKRAMGQMKTPTVF

SEQ ID NO: 2444 - protein, 193 aa, Unknown
  Kingdom: Fungi, Phylum: Ascomycota
MKYIHSQELLDIPEGVKVSIKTRQVTVEGPRGKLQKDLGHLAVTFAHPKRNVISIEIHHGVRKNVAALRTVKTIIENMIIGVTKGFKYKMRYVYAHFPINVSLDKDAETDLWQVEIRNFIGEKIVRRVTMRPGVDVEASKAQKDELVLSGNSVEDVSQSAADIQQICKVRNKDIRKFLDGLYVSEKGNVVEEA

SEQ ID NO: 2445 - protein, 573 aa, Unknown
  Kingdom: Fungi, Phylum: Ascomycota
MPGVRGFADPNAQVTNGVPVWKQVVSAQQSSDTSYLTPWYLNYLGGSWPEATQCMAAGSNGWNANHAAWNSGINNHWALNNTPYSIGYYKRNDLPIHFALAEGWTVGDMYQESVITSTNPNRVMWASGSINIPGSPQTKDEGGYPYIDNNETPGCDADGINCYPLKWPTAAEMYEAAGVSWSVYQDTDNFDDNPLAWFKQFQDAKKGSPLNIKGVAGFSLDTFYAQASNGTLPEVSYIIGPMELSEHPPYSPHDGSWLQRKVAEAVISSPKYSKTVLMVSYDETGGWADHVDPYHAPDGTAGEWIEDPYGKVGRTVVGPGFRVPFYIISPFTRNGGVYTEHCDHTSQIKFIEAWQAAKGRNVQTDQMVHWRRENMADLTNAFDFENPDYSIPNLPEAPTPHKNALGVYDGSSVCASQYGSGRPPVPYKGIGANSNTPNLAERGFKPVRGLLTEGRNLVLESYGQAVASSSGAVTLRTATKNHDDYNHGWVLHAVEVGDDKFTISSAQEKGLYVCDKLRLCRHTNSALVFTVDFKAAHGHSFQRSDGQYLAISKDKKLGWKKCQVFWSVFSVTY

SEQ ID NO: 2446 - protein, 437 aa, Unknown
  Kingdom: Fungi, Phylum: Ascomycota
MMLLLLAFAAAASASIQTSLANRNKTCAPRPLRFQKDGTFQISIIEDLHFGENAWDSWGPQQDINTVKVIEKVLDFDRPNLVVLNGDLITGDNAYLHNGTAVVDQMMKPMVTRNLPWASTYGNHDYQYNVSGEAILEHENRWPNSLTRSMVPGQDAGTSNYYLPVMPYNCTDKATCAPALLLWFFDSRGGFEYQVKKENGDLIGKPNWVDVSVVNWFQQTNAALVQKHGKMIPSLAFVHIPTNASQALQTVEKVHPNYQPGINDDYPIAVQSQGWCPEGYDDGTCPYGALDVPFMKAVTETPGLMALFSGHDHGDTWCYKWDQLIPGMTVSGNGINLCFGQHTGYGGYGNWIRGARQVIVSGQKLKNLEIETYLRLESGDAVGEVMLNATYGEDWYPKVPNDKTSCPTCNYDSVTPMPGTERKAYAAQVNGRLANLD

SEQ ID NO: 2447 - protein, 173 aa, Unknown
  Kingdom: Fungi, Phylum: Ascomycota
MATRSAALKLDWAKVTSSLGLRGQTVSSLQAFKKRNEDARRKVQLLSEQPTTVDFSHYRSTLKNQAIVDEIEKRFTSFKATTYDVNRQIKAIDAFEVEAVKNAEATKQAVDLELKDLAATLKNIEEARPFEDLTVDEVAAAEKSIDEKTNALVSKGRWMVPGYKEKFGDLAIV

SEQ ID NO: 2448 - protein, 245 aa, Unknown
  Kingdom: Fungi, Phylum: Ascomycota
MALPPSPTLPIPPKRKKTSLLPTLTISHSLTTPSAIIRASKVAHLTTKDTYVVGRQPHNTAIMGLAFSKIFDKLWGKKEMRILMVGLDAAGKTTILYKLKLGEIVTTIPTIGFNVETVEYKNIQFTVWDVGGQDKIRPLWRHYFQNTQGIIFVVDSNDRDRIVEAREELQRMLNEDELRDAILLVFANKQDLPNAMNAAEITDKLGLHSLRQRAWYIQSTCATSGDGLYEGLEWLATTLRKAGHQ

SEQ ID NO: 2449 - protein, 199 aa, Unknown
  Kingdom: Fungi, Phylum: Ascomycota
MAAPGVQSLKCVVTGDGAVGKTCLLISYTTNAFPGEYIPTVFDNYSASVMVDGKPISLGLWDTAGQEDYDRLRPLSYPQTDVFLICFSIVSPPSFDNVKAKWYPEIDHHAPNIPIILVGTKLDLREDGATLDSLRQKRMEPVSYEQALVCAKEIRAYKYLECSALTQRNLKSVFDEAIRAVLNPRPVAQAKKKSKCSVL

SEQ ID NO: 2450 - protein, 552 aa, Unknown
  Kingdom: Fungi, Phylum: Ascomycota
MATAQSSASVSSATMTARDNDIESQQESPKVSHWRLLKDQAGITPEVLSQKYAGHGTAESPYLVEFLPKDHWNPLTHSHVFKWTIALTQAGATLAVTFASSAYSGGVQEVMRSFQVSTEVAILGVSLFVLGFAIGPLAWAPISEMYGRQHILFITLFLITAFLAGSAGAQNIETLIILRFFAGAFGSAPLTNAAGVMADLFTAGERGIATSIFAMAPFLGPTLGPIVGGFLGHAEGFRWLEGLMAIFMGVLWLACTFLCPETYAPRLLRVRAKELSKRTGKHYICKLDVGKPKLSFKDRLSLALLRPWVLLFKEPIVLLTSIYMAIIYGTLYLSFAAFPIVFQKGRGWSPGVGGLAFLGLLVGMMVAVTGNILDNKRYMKIVHKHNGMPPPEARLPSAIVGSVLLPIGSSFFGAGLVLVFLSIFNYLIDSYVIFAASAIAANTVLRSLLGAAFPLFTTYMYEDLGLGWAGSIPAFLSLACVPVPFLFWKYGAAIRSKCKFASEAEAFLHKMRESQMAAAKSAEAAPTEAPIVSSPEATTDEADQREKETKAI

SEQ ID NO: 2451 - protein, 497 aa, Unknown
  Kingdom: Fungi, Phylum: Ascomycota
MVLKSSLVALAALAGSAVAAVKPLEIKGQEFVDSETGNKFQVVGMAYQPGGSAGYDPVSGKDPLSHPEECKRDAALMQILGINAIRVYNLDPNINHDECASIFNEAGMYMMIDVNSPLPGEAIASVEPWTTYHVGYLNRTFAIVEAFSNYPNTLLFFSANEVIERPESAEFAPQYLRAVTRDLKNYIKNNLKRQIPVGYSAADVREMLWDTWNYLQCSDADDKNDMSRADLFALNSYSWCGPDATFQTSTFDKLVAGFKDSSVPVFFSEYGCNEVQPRAWTELKSIYGSDMKDTFSGGVVYEYTMEDNNYGLVNISGDTLTILSDFNRLKDKFAEIKWKSVQSEKASGNAPKAPACRSSLINNTDFDSNFTLPRPPPGAQELIDDGISPKPKGKIVKITDYKVSMEVRDPDGDEVTGLKVVPVNTFNMAGENDAETGTDQHKSSENVDGKDSDDDDDSDSSNSNDNSNNDDDDEDAAVLTKPMMWAVGLPLVAMLFA

SEQ ID NO: 2452 - protein, 582 aa, Unknown
  Kingdom: Fungi, Phylum: Ascomycota
MRGLVLFSLGALLGSSLATNYVVHERRHHALDHQWDKREQLHKDEVLPIRIGLRQSNLEHADRWLMEVSDPNSSKFGKHWTAEEVLHAFKPSNETVQAVHSWLNESGIYPDRHQLSTGLGWLQFEASVDEAERLFQTKYHVFEHKKSSTAHVAFPGNSLGIVEYTPESYLGSDLDLFFETYERDLIGKRPVLDSIDGGYLYDTGFNDTNAFTYLGEPSLDLQYAMALVDQQEVTLYQVGDLAESNMTSFNNFLDAIDASYCTYDGGDDQEIDAVYPDPYPEPHSYQGKEDCGTFQAAKVISTSYAYNEVELPAAYEIRQCHEYLKLGLMGSTIVYSSGDYGVEFDGGGCLNPDGSQNDGTSGAFVPTFPGTCPYVLAAGATQIKNGTYNVDKAIREDKQVEVVMELYLVDGAYVGNDVPPGADVFNKTIFSSSGGFSNVFPIPSYQQHAVKEYMEKYAPDYPGQYNNTGMVRGFPDIAANGAWYSIAVFGELSQAFGTSCAAPVVSALLTIINGERMKRGKGSIGFINPVLYSHPHVLKDVVEGQNPGCGTNGFSAVPGWDPTTGLGTPNFPKMLELFLSLP

SEQ ID NO: 2453 - protein, 251 aa, Unknown
  Kingdom: Fungi, Phylum: Ascomycota
MAKNAPLAIAALVLVAGSLVLLFFTILPGLSNTTPLNKTYFLQADTSGITGARDVTQWTYFYFCGEGNTDCGSARPAPAFGKAWDGGARNAPEEIIGKHAGGTTSTHYFYMWRFGWVFFLIALFFEVLTFFGAFLACCGRLGAAISGMLSLVALLFLSAAASLMTAVFVQARNAFQSDDRKATLGRYAFGFVWGAWAALFIATILFCLGLRGDKSARTASTGGGFMSRFKRNRSVRSRRSYDGRRVKDDYS

SEQ ID NO: 2454 - protein, 885 aa, Unknown
  Kingdom: Fungi, Phylum: Ascomycota
MRSFPSIKLLSLVVLASAPLINSQECPEQPGAVGEWTWLGCYTEATASRALSGRSTASDDLTLEDCADFCEGFTYFGVEYSRECYCGNSFNAGSVLKDDSECNMKCAGSECNYCGAGNRLSVYTKGGTGPGSTSIQPGTSTTSALPVPTGFPEGWEPYGCWVDGVNGRILNYQAPDDPDLTLESCVQICADRGNTIAGAEYSRQCFCGNSIVNGGREADSPSECNTPCSGNSEQTCGGGGRMNIFALGDPQVVGPPGPIETVGDWVYKGCALDNVNDKKTFVWQNFFPGTMTPKLCLDRCADFGYMAAGLEYGEECYCGDPENMNTAGSEFVDESDCGVPCPGDASAICGGGSRLSTYFWEGDPFYSWTFPIEGSAAAGSYDFLIGGVVIPLITSQAITGKVTFVEKWGTGPPNSTGAYELDLSVVDDFEAAWRTMHVKTDVFCAAGVTLPDKGGRQLVVGGWSGDSTFGVRLYAPDGSDGVKGKNDWEENVDELSLQDGRWYPSAMNMANGSVLVIGGQEGSNGAPVPTLEILPYTGTAPLYMDWLERTDPNNLYPFIAVLPSGGIFVAYWNEARILDERTFETLRELPVIPGAVNDPKGGRTYPLEGTSVLLPQHAPYSDPLGVLICGGSTEGPANALDNCVSIYPDAADPEWKLERMPSKRVISCMAPLPDGTYIILGGAQHGVAGFGLATDPNLNALLYDPRKPLGSRMTVMANTTVARMYHSEAITLLDGRVLVSGSDPQDGVNPQEYRVETFTPPYLLGGDPRPTFTLSNKDWEFGEDVTLRLGAAARNGGISASLLGSVSSTHGNSMGARTIFPAVTCSGTTCTVTAPPDAHVCPPGWYQFFVLDGGIPAVGVFVRIGGDPAGVGSWPEGDDFTRPGS

SEQ ID NO: 2455 - protein, 453 aa, Unknown
  Kingdom: Fungi, Phylum: Ascomycota
MILNIFLTAALGAAASVDAAKPAARYAMYFDQYHTAALPNKTITAGITHVITAFANSSLFASDPPGVYTPFKPLTEVRALFEEDVKCCMSVGGWGDTTGLGLGSKNDTTRRLFASNVAATLDRLGYDCVDIDWEYPGGNGADYKQIPNSKKKGEIAAYPKLLREIKKAIGTKELAITVPGLERDMIAFTAKECPLINRAVDFVTIMAYDMMNRRDVVTKHHTPVHGSLEIIDRYISLGFSPRKLNLGFALYAKWFTTAPGVDCSQGLGCKTALLENPDGSDAGASGAMTFEAANFQPVPANLTVAPDASCGVGTFHKCGDNKCCSQYGFCGDTPAHCGTGCQADYGQCNGTSTLESFHKALANSKTDEVQGGQWYWDSKGPFFWSFETADLIKQKFRDIVMARGLGGVAAWSLGEDSHDFALIKAIQSGVKDLSGDSGKKSHVARHQRRAAYQ

SEQ ID NO: 2456 - protein, 211 aa, Unknown
  Kingdom: Fungi, Phylum: Ascomycota
MPALCGGNKTVNRKLVLLGDGASGKTSLLNVFTRGYFPTVYEPTVFENYVHDIFVDNVHIELSLWDTAGQEEFDRLRSLSYDDTDLIMLCYSVDSKDSLENVESKWVGEIADNCPGVKLVLVALKCDLREQENEEDGEGESSAPAAGEQPREKRPTINYDQGLEVARRINAARYLECSAMRNRGVNEAFTEAARVALSVKKDSEDSKCTVM

SEQ ID NO: 2457 - protein, 764 aa, Unknown
  Kingdom: Fungi, Phylum: Ascomycota
MLYCAEAKTNSIRNVAATIAYDAMSYYKGNTSSNPTDVGDLSGTVYYWWVAGALWGAMLDYYHYTLDPTYNDVVIQALLAPSNLGANQDYVAKDRDLVEGNDDLFFWGSAVLSAAERNFPQPNPDLPSWLELSENVVAGLESRWNTTNCGGGLTWQIYTWNPNGLNYKNSVSNGGFFQLAARLARATGDDKYLDWANRLWDWSWDMNLINHDTWHVFDGVDASNNCTKVNYNSFTYTAAIYLYGAAVTAEYSGQQVWRDRAESLLGGAGWFFGPFKNSTDIMCEAACELTDTCNADMTTFKGYASRFMWQTAIMLPDLRPKIEKYLIPTAKAAAKSCSGGTTGRECGLRWYTGGFDGDTGLGQEMCALETIQGLLIDNVGLPLKGDSIKVVRDTDFKPLDENEGKGGPKETTTESHQPTTTKSEPTHTNSDDDDDIAVMVPAPMGLMLILGLTQQSTKVVIIGAGSVGATTAYALLLSGLAADIVIIDVDTHRADGEATDLSHAAHFARARVRTGTYEDCAGATAVIITAGVNQKPGQTRLELVRTNYAIFADIVPRVASAAPDTLLIVATNPVDVLTHAATQLSGFPAHRVIGTGTSLDTTRLKRELSSHFNVSPRNVHAFIIGEHGDSQLPVWSLANISGMRLKDHCQQGGKEFDQAALDACAARTRNAAYEIIERKGKTNYGIASVIVSIVGPIIHDDDSIITVSQAGSYAGVDDVALSMPCRINRAGAHQGVPLLLDEEEIELLRKSAASIKEVIMSVAK

SEQ ID NO: 2458 - protein, 350 aa, Unknown
  Kingdom: Fungi, Phylum: Ascomycota
MRTSTILALAAANIVAAQRNNGTNPDDGGNAVNGFPGQLGEAFRLYGCVRSDNGFPTFRRVSMMPEMDLDFCAASCESKYMGVQDTDCYCGTEIDESQSTRVDLNLCDIDCPGNDEQKCGGLLVLGKRQNVPSNVLLTVYVREGNAEPDTTTTVTETSTSTGTITSCPPEVTNCPIGSKTIDVQTITSTFCPEPTPDYKKIVCYGDECTAAASCDVCAKHRVICKDGHCFIEECDTEDYNRLVICEGDKCEYATGQHGKVVCYGETCDIQECYGEECKEKIINHEACVGPKCPTPAPPAPTPAPVCFGPDCQVSPPKNNGTVPPVVAGADAVLPAAGAVFGIVAGFAALL

SEQ ID NO: 2459 - protein, 205 aa, Unknown
  Kingdom: Fungi, Phylum: Ascomycota
MSSRKKVLLKVIILGDSGVGKTSLMNQYVNKKFSASYKATIGADFLTREVLVDDRQVTMQLWDTAGQERFQSLGVAFYRGADCCVLVYDVNNAKSFEALDSWRDEFLIQASPRDPTNFPFVVLGNKIDVEDSKRVISNKRAMTFCQSKGDIPYFETSAKEAINIDQAFEVIARNALAQEESEEFSGDFDDPINIRIENDRDGCAC

SEQ ID NO: 2460 - protein, 218 aa, Unknown
  Kingdom: Fungi, Phylum: Ascomycota
MTDTLPPDTQTSSSSTAAAQDASRRQPTSAAASAAELTSAISTLRASLRSFSDFPIPGIEFVDIMPLFADPKAHATLLDALEIQVRQQAATAGGMPDVIVGLDARGFLFGPGLALRLGVGFAAVRKKGKLPGPCVTAEYVKEYGTDFFQMQEDAIKEGQKVLVVDDIIATGGSAKAAADLVEQCKGSILGFLFILEIPGLNGQEKLGGLPTTILIENE

SEQ ID NO: 2461 - protein, 217 aa, Unknown
  Kingdom: Fungi, Phylum: Ascomycota
MSKITVANVRTQVEDLLTYSNETKKRNFLETVELQIGLKNYDPQRDKRFSGTIKLPSVPRPNMAICILGDQHDLDRAKHGGVDAMSSDDLKKLNKNKKLIKKLARKYDAFIASEALIKQIPRLLGPGLSKAGKFPTPVSHADDLSGKITEVKSTIKFQLKKVLCMGVAVGNVGMTNEQLVANVMLAINYLVSLLKKGWQNVGSLTIKASMSPPKRLY

SEQ ID NO: 2462 - protein, 677 aa, Unknown
  Kingdom: Fungi, Phylum: Ascomycota
MRQLVPLLSLLGARYGLAQFVNQDEDLRNLTTVRSPGDANITVSYKEPDGACSTAFKSQKQYTGWVSIPGDYPTNLFFWFVGAREETESLTIWLNGGPGSSSMYGFFTGNGPCEVVEKGLNEYDTVAREWGWDRASNMLFIDQPNQVGYSYNTPTNGTLRVAASTIIQPPEDPAQSGPRWAQLNGTFSDTDSSGSAQTANTTELAADAVWHMLQGFLTTIPPFANSTDSLDVHLFAESYGGRYGPIFAETFEAQNRKRLTGQLDAETTRDIHLSSLGIVNGCIDREVQVPLYPVFANNNSYGVKALSDAEATFVSEQFNAKGGCNDLLQRCARAVAENDPEGEGDNERTNTICASAVDACSMIESPYYNTDRSPYDLSASYADPFPSMLFEEYLNQDWVQRAIGAPINFTMSSADVFREFRETGDIARDGNIPRLAALLNGGVRVGLIYGDRDYICNWLGGEAVASRLAWEAGADYGNGFSDAGYAPIIVNDSYIGGAVRQFGNLSFSRVYQAGHAVPAYQPETAFQIFARILGGGSVSTGSTAVSLSEYRTSGSRESDEKQKLPPAPEPTCFIRSYGTTCDSKARELAANGDGVVINGVLYAEEEDWPLYEEEEEKKSQSETSTRATSTVTETKTEGLTGAFTATETPDDEDAGVTQGVWRGGLVMGLMVVMTVIW

SEQ ID NO: 2463 - protein, 173 aa, Unknown
  Kingdom: Fungi, Phylum: Ascomycota
MAQAPPLHSATSDSDISSTCESHNLTTAQFAILRSSASSAKSLAYCPYSRFRVGAALLSPDGETVISGANVENASYPVGTCAERVAIGKAVTWEGKGGPVKTFKAIAVATDISPPASPCGMCRQFIREFCSLEMPIIMFDSKDQYVVMTLGELLPMSFGPDALPPPGAPGAQG

SEQ ID NO: 2464 - protein, 202 aa, Unknown
  Kingdom: Fungi, Phylum: Ascomycota
MSSLKGPTTEQHDGSGLRVAIVHARWNTSVIEPLVRGAKEKLLACGVKEGNIVVQSCPGAYELPITSQRVISASQIQQTSTGGPSATDLLASSTTDLTALSNTTSSSGPFDAVIAIGVLIKGETMHFEYIAEATTHGLMRVQLDTGVPVIFGVLTVLNDEQALARAGEGGSEKAHNHGEDWGLAAVEMGVKRREWAAGKIEG

SEQ ID NO: 2465 - protein, 226 aa, Unknown
  Kingdom: Fungi, Phylum: Ascomycota
MSSDTPVLDPAIFSFLKNSLEEETEVRDTLTQIVQRLERAVAVAQGHLSRVHSTPRAKYPELVQSIEAAIVDEVLIVQELSEVASKHPYYKYNQKWSRIMQSAIGTVVYCGWLVPTNLKTQDAFHLTIEEYLLSLPDLTSDLARLATNSVTLGDFALPLIISSFVKDLFAGFQLLNLKNDILRKRADAVKYDVKRVEDVVYDLSLRGLVKRPGDGGEADTEMPSAA

SEQ ID NO: 2466 - protein, 217 aa, Unknown
  Kingdom: Fungi, Phylum: Ascomycota
MASSTRQFLREYKLVVVGGGGVGKSCLTIQLIQSHFVDEYDPTIEDSYRKQCVIDDEVALLDVLDTAGQEEYSAMREQYMRTGEGFLLVYSINSRQSFEEITTFQQQILRVKDKDYFPMVVVGNKCDLENEREVTRQEGEALARSFGCKFIETSAKSRINVDKAFYDIVREIRRFNREMQGYSTGSGGPTGANGAPKPMDMDDGEKEAGCCSKCVIM

SEQ ID NO: 2467 - protein, 532 aa, Unknown
  Kingdom: Fungi, Phylum: Ascomycota
MRGALALSAAAAVHAASFSIETVHNQAAPVLSSIEADAIPDSYIVKFKDHVDEDAVTNHHSWIQNIHDEGEQQRLELRKRGLSDVAELFSGMKHTFSIGDAFKGYAGHFHESVIEQLRNHPDVEYIERDTVVHTMLPIEGENLVTEDKCDGETEKQAPWGLARISHRDTLNFGTFNKYLYTAEGGEGVDAYVIDTGTNTEHVDFEGRAKWGKTIPSGDADEDGNGHGTHCSGTVAGKKYGVAKKAHVYAVKVLRSNGSGSMSDVVKGVEYAAVSHLDNVKAAKKGKRKGFKGSVANMSLGGGKTQALDAAVNAAVDSGVHFAVAAGNDNADACKYSPAAAAKPVTVGASALDDSRAYFSNFGKCTDIFAPGLSIQSTWIGSKYAVNTISGTSMASPHICGLLAYYLSLQPAEDSEYSLASITPKKLKENLIAVSTEGTLTGMPDADTPNLLAWNGGGCSNYSEILAAGGYKASRAPSTLENIESAVEDKVEVISGEIVHGAKVFSGKAEKLANKIHHLVEEEIEQFLKEVHA

SEQ ID NO: 2468 - protein, 232 aa, Unknown
  Kingdom: Fungi, Phylum: Ascomycota
MNLFSFISALFLGLVVAAYDLPDNLKSLYEQHQSGTCSKALSGKFSGGAQYCGDIPDVIFLKGDGNYDNMDIDCDGVNNAVGACANDPTGQGITAFQDTVSSYGISDLDANLHPYVVFGNDGDQPSFSPEQQGMHPLSVMAIVCNGQLHYGIWGDVNGGTSTGEASISLADLCFPDDGLNGDLGHDGKDVMYLGFIGDEAVPGKDGAAWAASNRSEFSRSIRALGDKLVGSL

SEQ ID NO: 2469 - protein, 955 aa, Unknown
  Kingdom: Fungi, Phylum: Ascomycota
MDEKTSLPPYTAQAPRQPLDSSQPQPRHLLHGRRFARRSRAIKVFALACLGFIVLAQWGQLWRAQSSAPMLSMQKLSDDLQTCKKLRHKPQDPRGAGREQNARYLDGGKPTLIKNATIWVGEPVKGTSAEDARAGKGWEWTKGDVLLQYGLIQKVEADISSSSVPDDTVIYQAHGRPLTAGIIDMHSHVGVYPLPALQGSDDGNEMSDNITPWARSIDAILPFDVQFQVIKSGGVTTSLVLPGSGNNMGGEAYLVKHAVGKPDGRKELSARDLLADPEQNWRYMKMACGENAKRVHRDQVFSRMGESYSFRHAFEQASELVQKQNDWCDKAEALGVETMQEYLPQQIAWESLGAALRGQVHINTHCYTVPDLEAMVDHTNEFKFPVRAFHHAHQTFLVPEILKRTWGGRAPSSAIFADNMYYKTESYIGSEHAGKYLYDEGLTPVYVSDNPVLNAQHVLFEAAKGYKYGLPYHAALASVTTAPADDLGMGQRMGKVKSGFDADVVVWDSDPLSVGAAPVQVWIDGTSQFDDPVELSKPYSEPIVPDESLGVFVEEPTEMTDVVFEGLTKIFLANGTNLEPFDEGYYFNVAISKGEISCIGLCKDELEAATASGKGPIRLKNGYLTRSFVAAAGTLGLSHIDAESATNNGANYDTFSRAIDGLSLDGKKLRAGYEYGATRAISAPIFESGGSHYGTSVGFVTTAQHTLEDGAIFESDVAVHYTLDLGVRAAGLSYSAAFGGLRAKLLTAAAAKTPAVSSFSEAAALKKVVEGKMVLALTINSADGIATALRIKSEVESELSSINDKAPKLRIAIIGGAEAHILAKELAEAKVGVIVSPAQSTGDTWDARRTLSGAPLTNGTTLDQLLAAGVTTAIGLKEDWMVRDLGLAAGTAYHNGEGRVSEAAALDLVSTNVYKILGGEVENDAHFVVHEGSPLDIGSRVKAVGSGNGKVAVFV

SEQ ID NO: 2470 - protein, 1267 aa, Unknown
  Kingdom: Fungi, Phylum: Ascomycota
MADVVSAASNSLDPHGSGGAPGDIPNDGTGVVKLDPWLEPFSGALRRRYSKAQDWIKSINDSEGGIDKFSKGIEKYGFNVDEQNNITYREWAPNATEAYLTGDFNNWNRESHAMTKNSFGSFEITLPAQNGEAAIPHNSKLKISLQLPSGERVDRIPAWIKYVTQDLSVSPVYDARFWNPPASERYQFKHPRPKKPTSLRVYEAHVGISTPEQRVATYKEFTKDMLPRIKGLGYNVIQLMAVMEHAYYASFGYQINNFFAASSRYGTPEELKELIDTAHSMGLTVLLDVVHSHASKNVLDGLNNFDGTDHQYFHGGGKGVHDQWDSRLFNYGHHEVLRFLLSNLRFWMDEYQFDGFRFDGVTSMLYVHHGIGSGFSGGYHEYFGADVDEEAVAYMMIANELLHTLYPECITIAEDVSGMPALCLPLSLGGVGFDYRLAMAIPDMWIKILKEVSDEKWDIGNICFTLTNRRHGEKTIAYCESHDQALVGDKTLMMHLCDAEMYTNMSTLSPLTPVIDRGMALHKMIRLLTHTLGGEGYLNFEGNEFGHPEWLDFPREGNNNSFWYARRQLNLTADSLLRYQFLDHFDRLMNQCEAKYGWLSAPQAFISLKNETDKVIVFERAGLVFVFNLNPTESFSDYRIGIEVPGTYRVVLNTDSKAVGGFNRIDEGTRFFTTPMEWNGRKLMWILFPPQAPPPLCNTLGASFSAITHCSLCCLSALSASRAKLLTSAKVLPQLQPPSSPLTSRIALLSSGKMFKSGISSFARAARPTFAAAAPRAVRPAAIRFPSPRFASTSGVGDGKIYQVIGAVVDVKFDTAKLPAILNSLETTNNNQKLVLEVAQHLGENVVRCIAMDGTEGLTRGAKCTDTGAPITIPVGAPTLGRIMNVTGDPIDERGPIKSEHHAPIHTEAPEFVEQSTSAEILVTGIKVVDLIAPYARGGKIGLFGGAGVGKTVFIQELINNIAKAHGGYSVFTGVGERTREGNDLYHEMQETSVIQLDGESKVALVFGQMNEPPGARARVALTGLTVAEYFRDAEGQDVLLFIDNIFRFTQAGSEVSALLGRIPSAVGYQPTLAVDMGQMQERITTTKKGSITSVQAVYVPADDLTDPAPATTFAHLDATTVLSRGISELGIYPAVDPLDSKSRMLDPRIVGQEHYDIASRVQQILQEYKSLQDIIAILGMDELSEADKLTVERARKIQRFLSQPFTVAQVFTGIEGALVDLKDTINSFKSILSGEGDNLPEGAFYMVGDFASAKAKGEKILAELEK

SEQ ID NO: 2471 - protein, 648 aa, Unknown
  Kingdom: Fungi, Phylum: Ascomycota
MGVAKYLALCAAVASVASAGTQDRANPALALVPRDPSSLALSPRAIQNAPDGYVPASVRCPSDRPTIRNGTNLSQQEKDWVQKRRNETIEPIRDLLKRLNIPDFDSEEYLKDVEDNATALPNIGLAVSGGGYRALLNGAGAFAAWDSRSAESDAEGNIGGLLQSATYISGLSGGSWLIGSIYVNNFTTVQASLNSPVVWEFEDSILEGPEQYSLLQYYTNIFDEVGDKDDAGYERSITDYWGRMLSYQLFNVSEGGPGLTFSSIADDQDFKDGKMPLPFVVAVGRAPEEKIIALNSTVFEFTPWELGSSDPTLHGFAPLKYVGSNFTNGKIPEDGSCVEGFDNAGFVLGTSSSLFNQFILYLDDPNSDVVPDDVPDFFVEGLSSILNALDESDNDIADWTPNPFKDYNTEENLSDGDRLTLVDGGEDLQNVPYHPHILIEREVDVVFSVDSSADTEYYWPDGASAIATYERSLTNISEGTSFPAIPGKQTFINLGFNTRPTFFGCNATNTTDPSPLIVYIPNYPYVYNSNTSTFQMSYNESERDAMVENGWAVATQLNATRDTDWPVCVACAMLSRSFDRTNTTVPDKCKECFENYCWNGTLAEEEHEEYDPMMFSEAIDVQDAAVSVVARGVMALGMAVGVGALLAL

SEQ ID NO: 2472 - protein, 261 aa, Unknown
  Kingdom: Fungi, Phylum: Ascomycota
MAKGIKKHQKRLSAPSHWLLDKLSGTYAPKASAGPHKLRDCMPLIVFIRNRLKYALNYRETRSILMQRLIKVDGKVRTDMTYPTGFMDVITIEKTGENFRLVYDTKGRFTVHRIQTEEAEYKLGKVKRVQLGRGGIPFLVTHDARTIRYPDPLIKVNDTVKIDLATGKITDFIKFDTGAVAMVTGGRNMGRVGVITHRERHDGGFNIVHIKDAIDNSFATRESNVFVIGQDKPWISLPKGKGVKLTISEERDRRRANAIAA

SEQ ID NO: 2473 - protein, 866 aa, Unknown
  Kingdom: Fungi, Phylum: Ascomycota
MAAMRSFGFVLASQLFSLANSEPQVSFPLNSQLPPAARIDELFSYVFSEYTFRSDTSSNITYTLGDHPSWISLDSDERRLYGIPENKDVESGEVVGQIVEVIATDNTGSATMNSTLVVSRRKAPVVKIPLSEQIEGFGNYSAPSSLLVYPSTTFNYKFDKDTFDSSSGVNYYATSGDSSPLPAWITFDPSTLTFVGTTPAFETLVQPPQNFSFQLVASDIVGFSAEAIPFSIVVGSHRLTTEEPIITFNATRGSKFTYDRIGDSIRIDDERVSSDDLTATTEGMPKWMTFDKSNWRFEGTPGKGDRSVNFTISFSDPFADTLDILAMVNVATGLFKSTFDDIEAEPGEEIDVDLESHLRNPEDVELDVTTSPKDDWLKVNGLSISGRVPKSAKGDMKITIKAKSKSSDLSETEDFKISFLELEGTATSTTEVVSTSTKTSEAEKTADGDDDDEGPGHLPLGTILLATLIPIITIGLILLALICLRRRRRKAKETYLNSTYRHKISKPVLETLVHTGSDQIEAAKFEKVGAKGALVETTTHYNPKNNLGAHPTHSSSTLSRSSGTVDMSPHMMMAAGAAMPPSIRTLSEPSTPGEESSSRRSWVTVEDGRGERSIALAARQSVTTVPDSIDHQLRYPSDKTFRSGLDVAIPSLDDLSILPEIMTPFGDSPHHYHPRTLDALSMASSDVLPSSAISSPFNLGTVIRRGLSTHNRNTFYNSSEDRPSTAPADSEDPSRDSVSELRTPGAAVTRQSSLMRRAEGLGNRSSTHTGSFFTESSFGSSENWRVVSSARYGPAGAAGGGQPTIPGSPSYQDIVQDAPFNPSRPGTSRGEEATTGQAATGTAGPNWKRDDSALTTDSKGSYIAFL

SEQ ID NO: 2474 - protein, 393 aa, Unknown
  Kingdom: Fungi, Phylum: Ascomycota
MRLLQFAATAVALASFTNGLSLPRAEGAFSIDAISSTSETFNPTAELEKLQAKFPTTSDVNTRTKRASTQQGSAKVNPSANGLSFYVPTLIGNQTFNLIFDTGSSDLWVYSNESSIYQSLEHPVYVPTSSATLLQNYTWAIKYAGGQSVSGVVFTDTVKAGPIVAQKQAVQAATVIPFEFNSDGILGLAFGSINTVEPVKQKTFFETLMPTLERKIFAANLRGDGTPSTWDFGYIDEEKFTGDVVYTPVVSEKYWSVDIGSYAIGRDPFSSFDKKVGEVIVDSGTSLVYLPDPVVEAYYDSIDGSELQLGGSYTFPCNGTIPDFHFKIEDATLSIPGTSVNYTVYDPAKGLCVGGITTQLNMKYSVLGSLFMKDYYVIHSQEEETPKMGFAKY

SEQ ID NO: 2475 - protein, 143 aa, Unknown
  Kingdom: Fungi, Phylum: Ascomycota
MQLSFTILPLLAALASAAPAADIFRRAEATCGSVYYSASAVNAASVAACNYFRAGNTAGSSSYPHRYNNYEGFNFGGAAGPYQEFPIMSNGQVYSGGSPGPDRVVITESSCRQAGTITHTGASGNNFVACKVTEAVMGLLIKA

SEQ ID NO: 2476 - protein, 543 aa, Unknown
  Kingdom: Fungi, Phylum: Ascomycota
MGAGKLSLSLLALAGGAVGADLPAITMKGAKFFYENGTQFFMKGVAYQQDTSAAGATFEKKKNFIDPLADEKACRRDIPLLEELGTNTIRTYAIDPEADHSVCMKLLEDAGIYVISDLGEPQTSINRDDPKWDVELFTRYKAVVDELANYSNVIGFFAGNEVSNNKTNTEASAYVKAAVRDTKAHIKSKGYRWMGVGYAANDDKDIRAEIADYFNCGPTEDAIDFWGYNIYSWCGESSMQKSGYDEQIKFFEEYSVPVFFAEYGCNLPDGAAGRIFEETAALYNDQMTEVFSGGIVYMYNQEANDYGLVKVGSDGKATKLKDFDFLKKQVLKADPKGVDKDDYSPSLKAATCPDVTSTWKVSGDDLPPTPDKELCDCMVQSATCGPASDLSSKSYGDIFGFICGEKPELCKGINGNTTTGVYGAYTGCDPKSKLTYVLDAYYKELDNAADACDFKGKAETKSGSDSSSCKSALDEAKAHNDKVATATSGADAPFSTSANSDAGDDEDFAVPGAALMRLFSLGDYAVGLYMVVAVAVGGSMVVL

SEQ ID NO: 2477 - protein, 423 aa, Unknown
  Kingdom: Fungi, Phylum: Ascomycota
MRFDITTLLALASIPLATAKKGCATKSGWETSYTATGTAEVAAAAATAKTSSPTSHVKGKAFDRIVFIWFENENFDLAAGDPNFARYASKGIKLTNYFGVTHPSEPNYMAAIAGDYFGMQNDAFNRAPRNVSTVIDLLEHRGISWSAYQEDMPYSGFEGFEWVNHQNGRNDYVRKHNPPILMDSVTYSEERLSQIKNLSLTDKEHSQFHKDLKEDKLPQWMFITPNMTSDGHDTSATVAGEWCHAFLEPLLNDPKFMKNTLVVITWDENETYAEANNILGILLGDAVPKHLVGTTDSNFYNHYSEIATVQANWHLPTLGRWDVGANVYKFVAEKTGDKLRKWSKKGDFTGHFWNMSYAGPFNAKGGNQEYVAPNLKLEHNHAGRQILESVKKQWEHSDTPTYYKDTIELPDGLNPPKGYAPKQ

SEQ ID NO: 2478 - protein, 753 aa, Unknown
  Kingdom: Fungi, Phylum: Ascomycota
MKAAITTGLIFAVLADVSVAAPPVARDVDESFPYTGPAVPIGDWVDQTINGNGKGFPRLEEAPAVEPKSKNPTNNINVISLAYVPNGVNIHYQTPFGLGETPSVRWGTSSSDLSKTATGRSHTYDRTPPCSMISAVTQCSQFFHEVQIPDLRPSSTYYYQIPGANGTTESEVLSFTTAAEAGDRKSFSVAVINDMGYTNAKGTHEQLLKLVDHGTAFTWHGGDISYADDWYSGVLPCEDDWPVCYNGSDTKLPGPAPVPDEYKDTPLPAGEVANQGGPQGGDMSVLYESNWDLWQQWMAPITMKAPYMVLPGNHEATCSEFDGGKNILTAYLNDKKVNGTAPKANLTYFSCPPSQRNFTAFQHRFRMPGDETGGVGNFWYSFDYGLAHFVSIDAETDYPDSPEASFARDEAKKGVDHITPDDTYVTDSGPFGKVDGDLEDNKAYEQWNWFKKDLESVDRSVTPWIFVMSHRPLYSSQVSGYQAKMRAAWEDLMLKYGVDAYIAGHIHWYERMLPLGHNGTIDKDAVKNDFAYYTNNGKSLTHLTNGAAGNIESHSTLEGAPVLNITKVLDYTHFGVGKITVVNETVATWEYIVGDTGEIRDHLTLLKPQSSNSTSTATSEAASATKKPAGVTTVTEVVNSYTTWCPAGAVITEGSHTYSFSEATMATITDCPCTLTHTLPLSTSTGSMQNPGMNGTAAVPTGGNPSHPVGGGSASESFGSSGTSGPASVPTAGASKASLGQAAIAVVMGIWLL

SEQ ID NO: 2479 - protein, 447 aa, Unknown
  Kingdom: Fungi, Phylum: Ascomycota
MKWYILLSGLVSQAGAASVQQRSTDLPTVSVKGKGLYADGKRFYIRGLDYQPGGSSANEDPLADESTCKRDIAEFKKIGINVIRVYTVDNSKNHDACMSALADAGIYLALDVNNPDYSLNREEPGPSYNPTYLQSVFATIDAFADYSNTLCFFSGNEVINKADNTLSAPYVKAVTRDMKQYIGTRGYRDIPVGYSAADVSENQYAMAQYMSCGEKQSQGDFYAINNYAWCSPSSFEESGWNKVVETYKNYSQPMFYSEYGCIKPSRDFSETKVLYSTDMTSVVSGGFVYEYSEEGSGYGLVKISGDTITPIKSQVSDLTDALKNTPNPSGDGDLVTSGLTTQECPDQSDDWDTSPFKGSALPAMPSGAEKYLKQGAGTAPGLKGGSQNAGGGSTATAGPNAGEVSTTYPAGSAKTGDDDDEDASDYVKVSKGLVIALGAMWAINAAL

SEQ ID NO: 2480 - protein, 399 aa, Unknown
  Kingdom: Fungi, Phylum: Ascomycota
MHSSQLLTALAAAGFASAQTKTCTKDIEVTEPTPSIECEVVKADIIVDSSVTGDLVLEGVKQLQGDLVIKNVSINSISSSSINAISGTFVLDGCEFLQTLRMDSLTEVDEIQFINLRQLEGLTFGSSGELEINKITISDTFMDDLSGLNVVTVEDFLINNNGRMASFSSDLVNITGKSGLRIEGNGKEFELDLPKLTSATELQLQDIKSIKLPALEKLSQSLKLDDNRELTELSAPNLTEIGEALSLINNRKFSNVSFPKLETIGGDFTIINNTAMETVAGFPELRTIGGGIRMGGNFEEVELPSLKDVKGASNVTSSTDIKDFCEFFDNAKEDGILQGEDSKCTSNNDKALEGEEGGETNDGSSSGNSSNDDDDAAGILNVNMAVLSLAVVFGVAQLL

SEQ ID NO: 2481 - protein, 552 aa, Unknown
  Kingdom: Fungi, Phylum: Ascomycota
MPSHVARILLAALAGLALVDPITAKSCTPKAKVANGTYLGVHNEDYDQDFFLGVPFAQSPVGPLRFKAPEPLTEAFGHRAATEYGWMCIGYGSDTSNLGNPISEDCLTLNVVRPSGVKPGEDLPVGVWVHGGSYVQGGSRDPRYNLSDIVDQSVKEGKPIVAVSINYRLSLWGFLFSQEMQDEDAGNIAFKDQRMALRWLQDNIAAFGGSPNKVTIWGESAGARSLGMQLIAYQGKAGNLFHKAILESGSPVAKFHNASRWQPYFDALVEETGCDKDSDRLGCLRKLPWQTLSDIFSGKNPLSVATPTLSAVLDGDFITAQGTTLLKQGRFAHVPLLTGNNFDEGTAYAKTGINTTAQFESWLASLELSDAQIEEISKLYPNDPAVGIPASYEGPPPASFGSQFKRVAAVAGDYQQHSGRRCLVETYAAAGLPVYSYLWNVIVNGLPNPIYGATHFQEVAFVFDNVNGRGYSPSPFAGKPETYVELADLMSKAWVAFMHDGNPKANGVVWPKYTSESPTNLVYDTNVEGLHYTAKDDYRSEQIDYLLQKVFV

SEQ ID NO: 2482 - protein, 373 aa, Unknown
  Kingdom: Fungi, Phylum: Ascomycota
MRPYAIAGLLPALAWAQTSTDCNPTKKTCPSDKGLDQSSYTADFTKGQDDHFKMTYGDANYDSNGLSFTISKPKEAPTMQSDFYFFFGSVSAIAKSAKGTGIVSCVILESDDLDEIDWEWLGGSANQVQTNYYGKGNTTTYNRATYVDVNDAQDTWHNYTIEWTSSATTWYIDGAAVRTLAYADALGGKNYPQTPMKVKLGIWSASDTGAEGTIQWAGGNTDYSDGPFTMQVKSLSINNYNPASSYSYSDETGDWESIKMSSEGSKDSSSSESSSTKSTKTAESSKSSSHKTKTAESDSHKTASASPESTGKDSVSHSSETTSAVMVVHTPDVTPTRSSTAEKATSTSFASPLFTINGQLVSCALMAAVYQLF

SEQ ID NO: 2483 - protein, 410 aa, Unknown
  Kingdom: Fungi, Phylum: Ascomycota
MFSFKSLLTVVLLLQTAAAAGYVNAAYYASWKQYNGHPIEALNFPALSHVIYAFASISANGTVQPTDAFADYQMLHKGDVAQSGNNAYGNVKQLYLQKKANRKLKTLLSIGGYTASQNGDFINASKNEPSRNRFINSAIKLMLDYGMDGIDLDWEYPTSKTQGENFYLIIKNLRDALDAKSKALGQNYKYLLTAAVPASPDNYSKMPLSKMNARLDFFNLMAYDYAGSWSPVAAHASALYNDKSNPKSTPLNTDTVVKGYLASGVSANKINLGIPLFGKSFAKAGGLGKSYSGTLGDKNDYSIPFYELPKAGAKVIEKPDAGALVTWDSKTKELVTLDGGYSAKLKSAYLKKQGLAGAFFWDSSGDKTGKNSLMTVTKSALGSLENTNNQLMYPSSEFVNIRNGVPTSKK

SEQ ID NO: 2484 - protein, 474 aa, Unknown
  Kingdom: Fungi, Phylum: Ascomycota
MPSPSKILGVAAAATGASAAFQGFNYGATFADGRLRVESDFESMFEAAQGLAGTDGAFTSARLYTMIQGNTDNEPISAIPAAIKTKTSILFGLWASAGQANFNNELAALQKTIDQYCDQLDGLIAGISIGSEDLYRDSPIGQKAGENPGAGPKVLVNYIEEVRKVIKGTCMSDAKLGHVDTWTAFVNETNKPVIEALDWIGMDAYPYFEDTKPNSIEEAKGLFDAALGNTQGAAGGAEVWITETGYPTKGKTSGDAVANTKNARTYWEEVGCPLFGQTNTWWYTLQDSNSDGPITDETPSFGVVGDDLSKPKYNLSCKGVKPKPASSSSSAESEATTSAKSGNGDKEAKETVESAVESATESAAAESTAEATTEAAAETSTDAAAETSTEAAAETPVNTPSGLTTVSSAEPTPTSSHGGSGSGSDNSGSDNSEGGASTTTGDNEPSQVPTDAGVQLKGSFGAVVVALALTFFAL

SEQ ID NO: 2485 - protein, 180 aa, Unknown
  Kingdom: Fungi, Phylum: Ascomycota
MRFSVAACLTALAAPIAAASIANGQSPNLVKRGDDDNKVPGDSPLEFCPGDHSKDLVTIDKVDLSPNPPQPGKELLIKASGVVKEKIEEGAYVLLTVKYGLIRLISTKASLCEQVGNVDLECPLEEGKVEVTKAVDIPAEIPPGKYTVLADVYTEEGDPITCLTATVSFSRGKSVFGIEL

SEQ ID NO: 2486 - protein, 129 aa, Unknown
  Kingdom: Fungi, Phylum: Ascomycota
MSDKKVAVLTDNAPKPLPGIYSQAIKAGGFVFVSGAVPMDHETGKLIDGDIQAHTHRCIQNLKAILEAAGTSLDNVVKVNVFLANMDDFAAMNEIYTTYWGDVKPCRTCVAVKTLPLNTDVEIECTAVL

SEQ ID NO: 2487 - protein, 867 aa, Unknown
  Kingdom: Fungi, Phylum: Ascomycota
MRVLNTAAAWPLAIALVTGLTIPPGAESPARAALPHDNFKRAETELNEYLTTYATEDLLPTSKTVSVSTAKLATGTAVIAPPLSAVDPDLEPHTEGFVVTTVSNPAETRPPLMTNPIPSPTKLLQPVKSLLSDSEEAEDVEEMEEPQESASPGLARRATNIFAAPIDTSAPPSMFRRVSDHPVPRKGIGQSGPIETNKFYTNFFMGNQTSPVFSFPYSLAWTAGTGPAASWGMAISHIDASKRVFGPVQYNNAARYYLNPIGIQSMIMSATELGKNTVLTTDNISELFVKASLRKDKNSKPAIIFPITQGMVFTTGYYGGSTPMIQTGVFFRSMTKSSKDPKTNVRKYTFVLEDGTTWRLYAYKTSGDNLDLQLTNNGLAQSKKGFTGYIQIAKDPGPKKGEDVMDNGCGVFANGLSVEGSVSGTSGSYTLKFNRAGHPSGNLFMFALPHHVSSFDAATRANIKNYQLQTTTKGLVSAVVGNSWTMIESSLPTGMGFAPSDLTFGSRKLSTAAKNAIKPIAQLEVSQDMQAQTNLDSMYFSGKALAKFGTIIFVINNMLGDKALAQAGLAELKKAFSTFASNKQKYPLYYESAWGGLVSSASYITGQDGIDFGNTYYNDHHFHYGYHVLAAAYIGLYDKTWLAANKAYVNHLVRDYANPSSSDPWYPQNRAFDWFHGHSWATGLFDQLDGKNQESSSEDIMAIYAIKMWGQVIQDTNMVARANLQLAVMRRSMQDYYYYTTDNTVQPKNFIGNKVAGILFENKVDHTTFFDPNIEAIQGIHMIPILPPSNLARTNRFVKEEWAAYFDNGRIDKIDNAWKGIAYANYATIEPKKAWAFFNSTSFQANWIDGGASRTWYLAYAGALGGI

SEQ ID NO: 2488 - protein, 291 aa, Unknown
  Kingdom: Fungi, Phylum: Ascomycota
MLIHNILSATAFAGLSLALATPPTPTLTPPPSNASAIYARAAPLIPGGKKAGSAGGNAVPFWKDHLGWWYDWTPQPSSVPGVVGVSMLWGDGNNGPEDAKRFSDFSNMKSTPDYVLGFNEPDCSGQDISANMGVSNGVQVWNDKIVAKGNSGSLLGSPSMCMQKDEKWLKSFNTSGLSRSWDFTAIHVYKPDMAGVQADIDYYWNTYGKPIWVTEFACVYDQNDFTPCSDQGQINKWISDVVDLFEKNDHVKAYAYTDGTGLGQVWPPTQNNGQELSESGKTYLAAISKYH

SEQ ID NO: 2489 - protein, 631 aa, Unknown
  Kingdom: Fungi, Phylum: Ascomycota
MVFVHLWSLLALAGAADAASSLGEVKHVVMMMLENRSFQHYFGTMAGVRGFADPNVQINPDGRSVWYQNVTGLTDKADWMLPYWFNYKGGEEAWNKSQCLCAGANNWIPTQQALNGGLNNKWAQIDKPQSWGYFKREDLPYHFALADAYTLGDHNFAGITSNTNANRRFWESGSINVPGGKQSPDQGGIILDNNQVNGCTGPGLNCLPIEWPAFAQYLDEAGVDWRAYQNSKDWATTNGLFYFKAFQDADKDSSMYKRGLVFDGDNGLSAFQKSAAEGTLPEVSWIFPPGILQEHPPRSPVDGSWYINQVVNAAIHGKNYNDTIFIINYDEAGGWGDAVMPIVSPKGTAGEWFEDPYGELGYTYSGPGVRVPLLIISPYTRGGHVFTERADHTSALQFLEKYLEARGYEGIVADQISDWRREHMSDLVNAFDFENPDYSIPDLPVPQDPIRGANGDILGLYSGHCSKVYSGHCSSNSYVDGIPFGEQTEEEALFFEDGFKGVRGYLTEGRFLTFESNGYALTNLGVDKQFTTTKTTDKHEDLKQRWVLHALEKEGTTFNVASALDGKWISQHSSLSISRSGAQKFNITRMSDGTYALKKENGSHLNVVKGGGLSFDKNPIGFKVFSVTYHD

SEQ ID NO: 2490 - protein, 579 aa, Unknown
  Kingdom: Fungi, Phylum: Ascomycota
MRWLLVAALAASVAHAKDFEVDNEDLAGWLTPPLLPLMKDAGTTELFPMADCFGFKLEEATIDDMQKAMEKGKLTSVQLVLCYMLRAQQTHNYINSIIQFNPDAIAIAASMDLERSKGKTRGPLHGIPFTVKDNFATRDNMEATAGSWVLLGAIPPRDAHAVKKLREAGAVLFGKNTCSEWADMRSNDYSEGYSARGGQLRSSYNFTVNPGGSSGGSAISVSNNVIAFSLGTETDGSVINPAERNAVVGFKPTVGLTSRAGVIPESEHQDSVGTFGRTVRDAIYALDAIYGVDKNDNYTSAQKGQTPKNGYTPFLANKKALKGAKFGLPWMSFWRHAPAEQLEILEEILDMIKDAGAEIVNGTEITDYETIVSDNGWNWDLGGTRGYPNESEYTVVKVDFYNNINKYLSELENTNIKTIDDIIQFNYDNDGSEGGHPKVHPAFASGQDGFLASQKTKGKYDKTYWQALEFVQSSTRNGINDALRLSNKKKKLDGLLVPPDVGQSYQIAAQAGYPVITVPAGESTESGMPFGLAIVQTAYGEKELVRYGSAIEDLLKGSKYGRKRAQWRGYLERNIPVPF

SEQ ID NO: 2491 - protein, 698 aa, Unknown
  Kingdom: Fungi, Phylum: Ascomycota
MEVVTVAAASLPSVPLDFLGNRDRILESIRIAKAKGATLRTGPELEIPGYGCLDHHLESDTELHSWEVLAEIISDPMCKGMLIDLGMGVRHKNVQYNCRVLCGYRKVLGIRAKQSLANDGLYRETRHFTAWTKERQVEDCKLHAIIREVTGQTTAPIGDMIFETHDTSIAHETCEEMFVPRHPSIFTGLDGAEIFLNSSASHAQLRKLKERLDLITNSSKRMGGSCYVYSNCIMETPVFYFVAQSSQFSLLKVEVITATIDLGRVRTNRSSSRGVQAASQAAYPRVHCDITLSQSSSDLFLAGGIVSPEVEIKLLDPMEEIHLSTAVYLWNYLARTMSGGFFLALSGGLDSSSVALMVFGMCKLVLKSIQNGEESTLSDLRAVVGIKDFMPKTAEEIVSKILFSAYMGTVNSGSETRSRAKRLAAQIGSNHMDTNIDKAVNANIEIVADALDGFEPQFAVNGGTTSENLALQNIQARSRMVFSYALSQVMTTAKRMPRAGASLLVLASTNVDEHLRGYLTKYDASSADLAPLGSISKADAARFQRWARDTWDMPIMDEFLEATPTAELLPLSAGVQSDEEEMGLRYDQLSEFGILRSIHRAGPWSAYLHLLPEWKARHGMGPREVAEKVFTFFRFYAINRHKATIITSAVHLSGYSPDDNRFDLRPYLYVVSWPWQFNKIRAHVEEMEKSIKERDNVD

SEQ ID NO: 2492 - protein, 1100 aa, Unknown
  Kingdom: Fungi, Phylum: Ascomycota
MLQHSKSNQILTTLAARPSVPSSISAISGSSVASSSRQGSPIMTPELATLTNSSSIQASPEQLSAKDDDLCPPLFQLPESIVSRKTSSTSLGQSLKTGSQFTSETPPVPTAKGGIIRRISSRASRTISSRRRQSSAAPTSRDTSVGPCIFRRRSDSNTTAPPEYAPTTTDSESDAEERDEIGSLRIFGLEEVSREPSVSQQNTSGAMAGPVIPFLVQQGTRLRKVSKKSKSKRISLAYEPETNTLVWDKSRPNKSIHVDEIKEIRTDTDVQQYAIDCNVSELERQGWFSIIYSDPIKRKTKLMHLIADNMATLAAWVNFLSAMLKYRQEMMTSLMSFKPEAVAEYWQREISKQYNGHCDSDVGELDLTSIKRICSNLHIYSSQTALEDSFDACDVRRRSRLNFNEFLAFVSHLNQRRDVQRIIRSVAASPEVGLTFKEFLRFLNEFQKEDTSDRRSWEAIYRAHTGIASSIELDESIIMTEPAFISFLSSARNGPLEDLPQNYKLEHPLSDYFISSSHNTYLLGRQYLGESSVEGYIAALGGGCRCVEVDCWDGSDGQPIVVHGRTLTTSISFSEAMRCINKYAFVRSQEALWISLEVHCNPAQQAIMANTIRETFGARLVTEPLPGHETSLPSPEELKGRVLIKVKKPRDDGPIAEPVGRRRGNSLNSMNSPLARPSMSDSPSFLAPSQSLPQSPLLSPSHVSRRLVSKSRVNTIAEGEVPDIASISTSTSDNESGSELGTARRSANKTVPVLGQLGVYCAGLKFQGFDHPEAKAFNHIFSFMETSFARHSQSKEKKMALEIHNMRHLMRVYPDGIRLGSTNFDPIAYWRRGVQMAAVNWQTFDLGMQLNRAMFQGGVDQSGYVLKPEELRGIQVGPYNHDVAERGKKERSVVSFSIDVLSAQQLMRPANLPANKSMDPYIEVEVFHANDKRGKKEASNSNTHHLDSPLKVQTEVIRENGFNPMFIDGHFNFRVTTQYPELVFVRWSVKLSNDGESYSSKDRASVATFTAKLCNLKEGFRTLPLLNHTGEQYLFSRLFCKISKDPIVKTMVDAPMMIAEPGKLNRLGKALGRINTSPRSTQERSIASEKTSMEKSSFES

SEQ ID NO: 2493 - protein, 505 aa, Unknown
  Kingdom: Fungi, Phylum: Ascomycota
MGFEFIDSTAPVDPAARQRIRRQAALGKNLGRKLNRPSRKQALKPHPVATRTTIDSSEDSDQQDQQQAKAQKAKSHVVEVVEAVRLPAPDNQIGNTLTQLQFKKIGPDSLVMNAISFVLQAPRSADHGIGKAVHVGKVPLFSRFMFQDEAYFHSTIALSLRALGSRPEASGLPSIMAIQHMARSLQLINSRFAKSQSVSDINIAVVVVMTQYTRMSGQLSECRIHLDGLERMVQLRGGINAIKPELAEKIFRTDLGCAYHLTAPTRFTMDEVEQFAQETIGPDGILTKKHRQITRADIQPDLIEALSETHKNIFLDATRFTVVLDEAYSGKREWLTISILHQATLYIGYQIVRGPPSGPPNENSDVDLLTRLGLVTFCLSFFRSFDARIIHSSPLGFAIHRVVQGLQPRGAWTEELVLWTLLMGHILQIFGDDLWPDVMRRAKQSVETLKLTSWRDATQMLTRYPWSDALTGSTGKVMWDMLMLMPESPTIGSTAIASQFDVPVR

SEQ ID NO: 2494 - protein, 249 aa, Unknown
  Kingdom: Fungi, Phylum: Ascomycota
MASSTSTATPSRHAFDQRVDSLKAPKSDINALILDYLTMEGYPNAAANFSKEANLPPQQETSSIMARQEIQNLIHSGQVEMALKALNDYDPELLDEDKALHFSLLRLQLVELIRSCKAVDGDISPALKFATDHLGPRASTNPQSLEDLERTMALLLFPSDLLEPQIAALLKPDLRQEAADNVNKAILDRQSKRREAAIRSLVKMRAWAENAAREKGISLPAQLNIGLHGEETDDRGPSSGNGHEPMITT

SEQ ID NO: 2495 - protein, 1431 aa, Unknown
  Kingdom: Fungi, Phylum: Ascomycota
MMATSTPQALPSPPLSDGRKSPRSAVPADLAPLIESTYQSSELKFYVNGVLTVIKNPNPEWILLDWIRAQDSLKGTKLGCGEGGCGACTVVLQTGLPNGRIRHDAVNACLFPLVGVDGKGLITIEGLGSVKNPHPLQERVAKMHGSQCGFCTPGIIMSLYALIRNSYYDGKFHLTTSDVELRGHLDGNLCRCTGYKPILEAARSFVLEDLKGIIKDTPMCNKENDKSLETDLTEAAETTGEVKSPGSCGRPGGCCRDKPSPGACSSSAPPEEAKSKPSTPPPEEPEFLPYRPESEPIFPPSLRKHEPQPLCYGNRSKLWFRPVTLQQLLDLKSTYPQGKIVGGASETQIEVRFKKRDYRVSIYAADIPELRAYTAPETDAEIDALHELRIPANLPLTAVEDLCTVLYRRIGRRASVLEALRKQLRYFAGRQIRNVASLAGSLATASPISDSAPVLMAAKASVVIQSRQSGLLQFPLSRWFLGYRTTALPEDGVITEIVIPLPGEDDMEITEAYKQAKRKDDDIAIVTSGMRIRLDSDGKVEDVSIAFGGLAATTVSAEHTQKAVLGRVWTDTATLEAGLDALLEDFNLPHGVPGGMAHYRRTLSLSMFFRFWHEANHDLGLATFDKSLIDEIHRDISSGSHTHTPRTGTKAVGKALPHLSALKHCTGEAEYLDDMPKRHNELFGAVVLSTQAHAEIISVDWSRALQMPGVVNYLDKDSVPVGGNKWGPVKKDEVIFADGKVEYYGQVIGMICATSALEARAAADQVKVEYKPLPAIFTISEAINAKSFFEHGKELRKGDAVEGSLDKAFSKCEHVFSGVSKVGGQEHFYLETQAAFAIPHMEDGSMDVYASTQNLMENQVFVAQVLGVTMSKINMRVRRMGGAYGGKESRSTPFACMVALAAQKLKRPVRIMLNRDEDISISGQRHPFQCRWKVGVNGDGRIQCLEADVYNNAGYSLDMSGAVMDRACTHIDNCYHVPNVWIRGWVCKTNTVSNTAYRGFGGPQGMYFAETIMFNIAERLNLDVDELRLRNLYSVGQTTPFLQLITDDFHVPTMMEQLSKTSDFEARKLQVAEFNAKNRFRKRGIVRVPTKFGLSFATAIALNQAGAYVKIYEDGSVLLHHGGTEMGQGLYTKMCQVAAEELGVSTDEIYNKESQTDQVANPSPTGASSGSDLNGMAVKNACDQLNERLAPYRENYGPDAPLKTLAHAAYADRVNLAANGFWKMPRIGYQWGNWKDPMPMYYYWTQGVAVTEVELDVLTGDHTVLRADLMMDIGRSINPAIDYGQIEGAFVQGQGLFTMEESLWTGKGEIFTKGPGTYKIPGFSDIPQVFNISMLERDSSGKPISWESLRSIQSSKGVGEPPLFLGSTVFFALREAVKAARVMNGSGDVGLLLNAPSTAEKLRLAVGDRLVEKAKVVLGRDQPEFFKHIED

SEQ ID NO: 2496 - protein, 258 aa, Unknown
  Kingdom: Fungi, Phylum: Ascomycota
MSESQEDMKIDPARAQALISQLGAIKDRVTAVAGSRTVRLVAVSKLKPANDILALHRAPTSHAHFGENYAQELTAKAELLPESIKWHFIGGLQSGHCKTLAKIPNLFCVSSVDTAKKARLLNSTRASASLSPLSIHVQVNTSGEEAKSGCAPGADTIALCRDILENCPSLRLIGLMTIGAIARSKATTAETENEDFVVLKEQRDLVAKELGLEETRLELSMGMSEDFEGAIKMGSGEVRVGSTIFGQRPAKADAKLKE

SEQ ID NO: 2497 - protein, 414 aa, Unknown
  Kingdom: Fungi, Phylum: Ascomycota
MADQKNIVILGSSYAGFNVAHYLLRHAIPKLADSASYKIVLVSPSSTYYCRPASPRALITASAFPQEDLFKPIEPCFSRYPAENFQFVHGKAMKWDTDARTVVVELMDGKGTETLTYYSLLVGTGSSTPSPMMGVHDGDAALKKNWEAFRSALPSAKHIVIAGGGPTGIETAAELGEHLNGKPGWFAGPNKNPKVQITVVTAGDHILPYLRSSIADKAEPLLARVGVNVVKGVKVESVSPPDAGYKGNVASRATVTLADGKTIDADLYIPSTGYMPNTSFVPPQLLASDGRIKTDSATLRVPGAGDRVYALGDCSDYARQAIHLLLEAIPITGNNMKRDLFLAEGKDKEAPAEKQYKEDTRATHLVPIGLSGGVGSAMGHGLPGFVITMIKGKHYWLNTLPKIWSGEQWAKEAA

SEQ ID NO: 2498 - protein, 1165 aa, Unknown
  Kingdom: Fungi, Phylum: Ascomycota
MAAAPDTAIPAVGAAVGHHHPQYNTPARSYSTRSSRPSPPDDYYYPSNPVGHDQATVSRTQSQSASASAAARAQQYRHRRSSSSSAVPSSPAVASYNRHLDNHHRQQQQQAQSHHVSGTTPPVQPQRHHRRTSSSIRPLPEILPENDCEASNVAIYPQRSSSRDRPAHPSSSNPPARSAADVESARLAHRRSGNTRQTNHHRTSSQVQSTHNSRNMAPSANGASAPSGAPADGTHSSSGKQTRSRTTIPTQSGKWILGKTIGAGSMGKVKLARKEDGSEQVACKIIPRGSTDDGHQSRADKERADQSKEIRTAREAAIVTLLNHPHICGLRDVVRTNYHWYMLFEFVNGGQMLDYIISHGKLKEKQARKFSRQIASALDYCHRNSIVHRDLKIENILISKTGDIKIIDFGLSNLFAPRGHLKTFCGSLYFAAPELLQARAYTGPEVDVWSFGIVLYVLVCGKVPFDDQSMPALHAKIKKGVVDYPSWLSTECKHLMSRMLVTDPKMRATMQEVMTHPWMTKGFNGPPDNFLPVREPLSPPLEPEVIHAMQGFNFGSPESIRAQLAKIIDSEEYQRAVMLYQKEKEMPQPNREGEKKRGFGFDFYKRRNSGTSRDTLTGPSSEALQLGNDPLNAFSPLLSIYYLVKEKQDRERPEGPPPTPSTPREKEKERERDRDRDREHRDHRDHRDPRDHRERSREERERPVDALPEIAPPQAAVTNATRYEMPGEQPTGGRTRPRARTHGEDDAPDTAKQATPPEHRPEQQPQKKESAASGLLRRFSTRKRRDPERLDKDRSHPPVVQVHSPADGSSLTPRKSFSIRRGRRERDGSAEPRLRSGSSQPQHSELLSPPATAGGSRESRRGGLGRSTSVNSAEMRRQKARGAAKEPPPTSGSDQSMAEEPPAGPSRGHGHSKSVAYRAKSLGHARRESIQQRRMRREAAQEANVPEETDQEQEASGVSTERLDSSDLAKPVFLKGLFSVSTTSGKSVPAIRADIRRVLRQLNVDFVEIKGGFTCKYMPSIDLNKVQDPPGSPGPTSAGGGHRRRFSFGGLMRGDDRDDVRDPSDRPPTTPRTPGRSDRDRSYSNSETSVDSIPRRANHGNSRRAPGETSTQVQSDLGGSMVLEFEIFIVKVPLLTLHGIQFKRLDGNTWQYKNMADQILRELRL

SEQ ID NO: 2499 - protein, 1038 aa, Unknown
  Kingdom: Fungi, Phylum: Ascomycota
MATLTEDDIEKLFSGAPHFYCRSESHFAGAPHPSVAFPFDEELEIRDLCDRVPINNKAWSGVSAWPHLTRDVRRDAEKREIEKQRKAHFHIKTRERPNMLSMQGLEKGTMGFEAALELPVGDSLNEEQFGFGSIGTKAKAIVEARESMLSEKGWLRRLPESDVLDRLMHNGDLYRNNDLKTRSSAETYKDLFHSLLRPTHVPPIDKQDHHSLVNQIDCLLKCLGMPNVWIDLSLVEWRIRLGQILWGRNDGDELDDATDISDASSVSERADERFWLLIQVLVATELLIRLDAVTEGQEFGLGNLRQIDVVRFERAATPAVKWSLLLARSWLENIQVVREKNEAATAPVVPPKAPHQHTSGWLSSLVSKVSLYYHHEHPRPIAPPYHYTIKGRHGDRQVDGLTHFARKLRWPGLDQYESRISSNAEHTMEKAQTPMPTSNTIDSTQTSYFGAWDITGNRNKKNERVQAQRRKMAAALHSSGWLSKSYIFGLLLPGEALSHFLMSTLLENDPEAMSRLGSFANLCGGFVYSGMSFWSTSCIVGRVLAAGDGASESMGWISTDIVPESRRDGWLNICTKDVPADMAQLGRKSRIWAKKKIERESSILGDANEDSVFPADFIIPNEGSYPKQPPSLSTEFRSFKLHKSYESVLPTPLSELTPMPTPATEGSIAPELASHPASLTFTVSMNGQPSEEHTFPLTYDISFVTAYPCAPSSRVKFLKSPTSPTIQQIDVSGSDMLGNTSRSVHRAGQSFTRTIDSSVSSHKAGHPLHKSFNYNIVHISELLQRRHYFLEDFLPAPLPTTRPSSRTNTNRVLVIDCTTNVLDVPPSPLFERSAPSSPVVERSGSFSSQSLESRRRNMGSDMEVLARALYSPTSRHAIGVQLAPLAQSLLTSPVLTHDKPSPDALAERCRRPPPSSTSTDITSSPTTPSTTATMAPQQKDMRRPDLIVPYMEPPAKEGEADMGSTISTTLPMAAMFMRNKFVGWAALVFSVQNWLGESEDSKKKAATSGIFSVGMSALALAVNYMPMFIPPVGKAKAA

SEQ ID NO: 2500 - protein, 292 aa, Unknown
  Kingdom: Fungi, Phylum: Ascomycota
MISTLTIIRDDNEVPPVQPKTQYITQDTENSLQLGTLDKLLEHPNYSIRDIAIKILYDRAVNDSEITSFLLRGATRPDYDERIKSLRALEALVYPAGGYDGLSKLDDPKAYAALVKCLEVGLEDSELPDVQSASWDEYKLRDPAEKCCLQLLAELALRFNAKGIIKAKFVEKWLAKQAWGEHPIERRRNFRIYMDQRDNRIVHIVAKMKQYRRGLRALERAGLIDREYSRVGDQVMISLDMESEPLVLRAREHSAEEQRLRRQHREAMVLNDGTRPFGREDIFERDHNVAID

SEQ ID NO: 2501 - protein, 582 aa, Unknown
  Kingdom: Fungi, Phylum: Ascomycota
MSRRAPNPAAERAAQNQATLKSLLKLETNKTCADCKRNKHPRWASWNLGVFVCIRCSGIHRGMGTHISRVKSVDLDSWTEEQMKSILSWGNARANKYWEAKLAPGHAPSESKIENFIRTKYELKRWTMDGPIPDPSTLDVEGDDDVPLNIVKEKQAIERSTSTRAGGSAAAQAPQQQRRQAAPVGDLIGGDDPIPQRSSTAGPTPGKLPPPKAEPAPPKATNKDSLLGLDFLGESTAPPRPSSAASAGTPGAQSRPDLKQSILSLYASAPRPQVQQQQSNASAGSFGGMGSPTAPTHQQQGSFGGFNDAFSSLSMNSTTSPKPAAADPFASFGSTTSSRSPPPPSNNNAFGNLGGGSFFDTKPSQVSAPQSHQKQPSNSGFGGFSSQPAASTKSPPPSQSFSADLLSLDSAPPPQAMASPPPPTMSPPASSSVFNLSSPPPQPAQVSPPINPAPPAAASSSFATASIGGADVWGGNAWGSTDTASTPSAAAPAPAQTSTTFASNDFGGWGAPAAPAAQTSSFASTPIVPGASGGFSPAPKVQADEEFGGWSSSTGQTGNAGAKPATGGFSAADDDLFNNVWG

SEQ ID NO: 2502 - protein, 991 aa, Unknown
  Kingdom: Fungi, Phylum: Ascomycota
MSSGPPGFLGRSSSSNSNMRGLVQFIADLRNARARELEEKRINKELANIRQKFKDGSLSGYHRKKYVCKLLYIYILGWDVDFGHLEAVNLISAGKYSEKQIGYLAMTLFLHEKHELLHLVVNSIRKDLLDHNELFNSLALHAIANVGGREMGEALSGEVHRLLISPTSKSFVKKKAALTLLRLYRKHPDIVSPQWTERIIHLMDDADLGVALSVTSLVMALTQDNVEQYKGAHAKAAARLKRIVIDGEYTTDYLYYKVPCPWLQVKLLRLLQYFPPSEDTHVRDMIRESLQKILQLAMDTSKNVQQNNAQNAVLFEAINLIIHLDTEVALMKQVSTRLGRFIQSRETNVRYLGLEAMTHLAARAETLEPIKQHQDIIIGSLKDRDISVRRKGLDLLYSMCDSSNAQVVVGELMHYLQNADFAIREEMVLKIAILTEKYATDVQWYVDVSLRLIAMAGDHVSDEVWQRVIQIVTNNEELQVYAAQNALQYVKSDHCHETLVKIGAYILGEFGHLIADQPKCSPIEQYLALQSKLSACSSSTRAMIMSCFVKFVNLFPEIKPQLLHTFDVYTHTLDSEMQQRACEYLALATLPTDDLLRTVCDEMPPFPERQSALLSRLHQKHANTSDRRTWVVGGKAANSNSAELSMAKNNGSLQRTFSSGAADGKATNGANGAAGHGDGASDLAGLDMNAPSPTEPKMLKAVNLASAAHLSPGWEKGYNRLMLKPDGVLYEDGQIQVGIRSEYRGQMACVIGYFKNKSPTAMSSFTTTIDLDESEKGKLTWDTKTLPDSTIAIGSQGQQVIMFEAKKVFEKSPTMRISYLAGALQSVTLKLPVSLHKFMDPAELSAEDFFKRWKQIGGPPREAQGIFGLSTGPKNSDRQITESFVARIVEGFRWKLLDMVDPNPKNVVGASVLHTSEGGKFGCLMRLEPNYGTQMIRLTIRATDDAVAPVLLKMMQDKIAAGASTHISTEEAMEQPSKQEISDAFANVMVL

SEQ ID NO: 2503 - protein, 1130 aa, Unknown
  Kingdom: Fungi, Phylum: Ascomycota
MKSPIPDYLAAVLEKVRPIETGAPAGYIETLAKADTSKLAVAIAMVDGNLYSAGDDRVEFSIQSISKAFVYALAIEDSGLEKVLEKIGVEPSGDAFNQLSLHKGSNRPMNPMINAGAITAHSLVVGPNATAEERTERILKALSKLAGRELHVDEEVYEAELRDGDRNLGIGHMLKAAGIISCNPREVVKGYIRQCSINVNVRDLAMMAATLCNAGVHPVTGESIIPQRSVRQVLSVMTTCGMYDAAGDWVSNVGIPAKSGVAGGILGALPGQVGLAAFSPKLDERGNSVRGVAICEQMSNDMGLHMMEASQIARATVRTSVATIVAGEDEPHNRNCHREVIIFSLRGAVRFAGSERLSRAVQRELGEVDEKDPGSGAHAEACAVVFSFRDVYSLSGVAQRVITEVIRRLLIENRSVVVVDPSRVFPQDVKGDKDEQKPIIVQTEGEARDHIGGRGCSTLQKTDSCAALTLLAYNDLETDPAPGSGAILVEPAVDYAAAKDLCRELSESLWESHGQDTTDAIVKQLEYQVFQGNHDDDAKFWISGKNTKACKCPALAVDGSVHQVKCTEKLPVLCSQSAALANKDSENTAEEFRVTRQVGDAQVTGYRDFVTWKFFGMRFAPEPKRFEYSTTLEATGEINALEFGADCLQTTVPDSSDDCLFVNVWTPYLPAEKPTKTELKPVLFYIYGGGFVAGTGTNTATNPVNVASRGDVVAVTFNYRVGNLGFLVFDDGVHNGNIATNDQLSALKWVKDNIAAFGGDPDRITIAGGSAGAMSVKFLLASPEAEGMYSGAFLESDSNGGYGEPWGIWMSPEQSYETFTKTILSTNGCADAEDEVECLRRIPGQELIQGDQARYPVVDGKYFNTPYFLLDGSGPRYPKDIPAMIGTTRDEGGIGEGLTELPWDTFTLDVWMYLMRQYNDQIRVDLDAVFANLELFGINTTTPTGDELFKASAKIAGESAFICLARAQAYSGAKNGVFKEVYAFNWNRTYSPAGYTNKYCNAPKTEDHPFGDPDMEYLKCHGGSQFATFGTIKYNSYPDRDGLDTGFGRLVVDYFSSFIRTGDPNPDREFLKVRGYEGTLEEIERAGEWKAVDPERPEEMVLQWDGFMTPFADKEICDVLGQPLDYWEKL

SEQ ID NO: 2504 - protein, 1260 aa, Unknown
  Kingdom: Fungi, Phylum: Ascomycota
MASPIADSSSFRRESGVISPVRQVRSRTHSISSDRPSTISHSLMSPPLSVSPEAAFIASSAASQIVTNDHDSHADTWYDQHGIEPAGETALIAPAALTLVNNFLDQLLFNFLQVSKATTLAALRPAVSEVLKPKLAKDAINNADEELREYLGGADEDDYVQPQGSDRKQDWDLELVWKRTRLRCMVYSSLGDMEEEDEDLFMEQENLEIGADEQISDVISPAVAIFLTSVLEYMGELTLTVAGQAAYHRMRSKFEKDLREGIRSQNDIADRIVVEELDMERVALDRTLGRLWRGWKKRIRTPTIDSIGGQLSIRSLNRHFRSDSQDSVALKSAAADDLRRSQDYRGNAIAEDVQPADIALPMRDRDVDEIEVPGLVSYSDDEEDIEETIAEQKRPKSLYLPPSVANALPEAAQAMHQPPRKRSGSHPGGRFNPFFSRFEQQILAQEATTAEDTTRTPAQVDRLMVVLDENGVSPLEEDGPGTSLHDHEGIGMAMTSDAVSQHETSGAAGDFDSADEDVEYEKAEIVTSARVSVAGSSSPSENEKLERTSSVRSARIVSVSAPKGSPSSRPASIEAARPVSTIGSSGKASPAIVEERSAPLEVRTVTSATKPAAERLRPAVQNTETISESDEEADFFPPELQGIPARSSPSARNPYAQSVRQQHSSTKHEPASGTKVTIIGSSNSNSTFDPIPEVPAKSPGHATRHRPRDDSLDKAGPRASEETVTSSPQPNGNTTKPAHTSASSISSSTGRLKAVRTSEENYNQRVENVARNFEDLIHSNQTITYTLTPENMRDHNATESSPLPRHQRKSEEARSRDRSGSSPVMTHSPKSPTSSYRSQRTGQGFDGHAERPSTTVPSSSTRRDSRSSRTAVPQAREARVPTDSTADFAEFIKSTGPPGETRPLPLKNSGAAASPMVKNSSESRRVSTNSNRGRYQPREAAIDKGDNSDLIDFIRQGPPNSGATNHRIPRHVAPFRNTMDSDQMTGANGGRAVDASLPEIRHSQASTNITENSMPSMQSSVNSSSALLRKNNAAAGMPSKMFDEDDMMPKRKQRRVRDPYAIDFSDEEDEDEDLFTTTPKAPAKQEESLAEFLRSCPPPPSPPMRASVPQKLPKKKSAPSLMARFRNTYSRDSQSSPPPPKPAPIPESASSLSGRSNGGKGYTPIQINMPAGYDSYGAIANTGPPRRSSTAGTTGKVQMKRYEPREAVSGNTRTSDLAAFLRDSEPPPSSAPLAANAPQQEDNNGFSKMFSSRRKKLGLT

SEQ ID NO: 2505 - protein, 1061 aa, Unknown
  Kingdom: Fungi, Phylum: Ascomycota
MNGSDPAGPTRPPPGLEERLHNLIISNSPNGQPGVGDARAMPIEASVEAEQAAGSSKVSAAPHTARGGGKKRPNQAQRRQMNAELSLVVDTRSVEPPRHEHQFHSQRGSHGNHRGGMPFAGQRDMTTQARQAHGYQHQQQWRSPDASHHQHGRWNQAQQGHQGHQYPRQQHHDQSFRRPQGQSQNFRPSSSHQGQSHQPQNFPLRPEELAAQSSMLEELCFKVVSGSEIEFSEIADKEAFRQRIEHLSREVIAMYEIQENGKGQFPPQSVELKCFGSLSSGFATKASDMDLGLVTPLSAVQPDTPDSPIPRLLEKALLNAGFGARLLTRTRVPIIKLCERPPVKLLEDLLAEREKWETGASKDTQDGQDRAPVGEDVPSADEDEDHEPHQTEDDIAPEFYFDVPSIDDVGAVKRMWLKQSRNQTLANYQITAKRVLRKAGGRDVTVGNHRELSELEWDILNCVCNAFIQGLENIELRDRLQQWSSLTFEHTPGSPNRHSLMTVCTQVEGEELLQRWDQKIVQQGMSTKPRHGHAVMQWNHLRSREMFGLDPLAWAKEVQLALGMVKKLPSVQLITLEQQPHETPTQYNVRARSVVRVLADHNQEPTHVLLAQYIAGIQPSSVRKAVTKAFEDSSYTMDMAAIGRRHKSFHLATKLEQALTKKLYEESQVSDIKSYIELLRQPLVNISNESAASNWIIPIGPENAALIARIQGIKDPQTFAVNQPRDRYKDKLEFPKSGVGAQCDINFSAHLALQNTLLLRCYSHTDPRVRPMVLFIKHWAKVRGINSGYRGTLSSYGYVLMALHYLVNVAQPFVCPNLQQLAPPPPPDMNPSEMEGIYTCRGYNVRFWRNEEEILHLSRANQLTPNKESIGHLLRGFFEYYAHTSVMSDGTGRGFDWGRDVLSLRTPGGLLSKQEKGWTGAKTTVESRGPAHGPKHSQSMDVASPSSPLTPQQLQGPTTAVDAGAATKANAGGEAKEVKEVRHRYLFAIEDPFELDHNVARTVTHNGIVSIRDEFRRAWRILRAAGQGFVKEDLLQDANTVEQGGKSPFLALLDDIHGITA

SEQ ID NO: 2506 - protein, 408 aa, Unknown
  Kingdom: Fungi, Phylum: Ascomycota
MEEHISAASRQQHDRPTATSGGPARSSPSIHHPRRFDESWVEVASQPSSSSLSSIGDEIVTTGLQVGGAYRRRRLQASSRALPQQQTAIYNAGTSSQEDYDESESEEDQLLTSSTEHVPHESREDADVVLEADDDSDDGDNATALGQRPPDQPVFRPQPNAFTHPQGYVPHRSQSSGAAMPGYPHGGFTRPSFSQRAQTRVHRGGPHFMTPSAREDNDAALRASLTTLLSCAAAARGLPKTREEAQAERTAGHGVGPSNQPVGLRLVPESELMAESSPLAAQMASSPSKQRSTPRSSSRGASEGSKRSVSAGRTPRAAKKKKTVATDEALISPTLLTWVVSAGVVVLVSVVGFGAGYVIGREVGYQEGLTASVGGMNDTTSCGREAIRSSGGSLRRFRWSAVGKSIVA

SEQ ID NO: 2507 - protein, 590 aa, Unknown
  Kingdom: Fungi, Phylum: Ascomycota
MQLNGSPSGQSRSPEDAGFGDDGRYADLFSNPMHGQDDAVQQMLYSNSEDMISGLHMDLDVSNYSFLPGLSPIGTQEAQASIAQQGQLNTAASPLQTIDQMEDGCPQVIGLSSDMDPFVVHHYDSDESGFFHFKQLSIHSVQSHPYPVQFLTSRRSLVAKSRDDSGDQDIDEAQLRTELEAIVAPSTGKRLLLLFRTYIEPQYPIFSSEARPDPESSPIHLLAAAYAIAFPFSIYDDQLCIDLAYDSPPYAELSRLINLSLRPEMHSPTISVAQTQILLLLQPFANPLVAEAPYKGTLIGSLAATAVTLGLHLDASAWNIPTWQIALRRRLSFVIYCLDKWLAASLGRPRQLRDDDWIVTSLGSGDRAGCEISESDWEYLMFTSELTATLDSALSRLFSLRASQHIAHNPDYALPVVEELSNSLPNLPDIQDRSGNPLTTLQYLGYHYVKLLIVRATSRPTVHHATDANYSNIDRRSMLRNAALEFVNFVQSIRTDDTQVFWPPWCPTVFSTLCFTLLSAVVTSRDENEAAEWLAILQKTRRDLRLKATTLPVLRLGLLRIDAIFWRGLEKVLRLEPHVQAAVQAALRAT

SEQ ID NO: 2508 - protein, 292 aa, Unknown
  Kingdom: Fungi, Phylum: Ascomycota
MAWFTSLMGWVAPFFIVMSPILSYSDQAISMQRNKTSAGFSLDIPLIMLIASFFRIAYWPGAKFDTALLVQSIIMVGMQAILLKIGLDHRPGPSAKGGEAATPFAGAQEGSWMAQRPYSFWQWRSPKPYWQFLGYVVAGLIATEILLTPFPGIYSFYSTVIGITGLSVEATLPIPQIISNHQSRSCKGFRISVLASWLIGDAMKIFWFFTSTSEIPWAFKICGIFQASCDSFLGVQYWMYGDGVGSVTPGGSKGFQMVEQRSPNSHRQSGHVPARSLTPTRRPAPFTAGSSL

SEQ ID NO: 2509 - protein, 383 aa, Unknown
  Kingdom: Fungi, Phylum: Ascomycota
MGPFHATFAETLKAADKPTHIAQADSQFPQFSRLPTEIRFAIWESILPPPEDEPPALFCERHSVTWTDSNGLLDQPSANAQVPIRMTTTLAALLHVNKETRQLVLNWADALGYDLCFRILCFDFDEYDDIGSGADADEDNDKDLPVQGPIFTRGWDASKDILNMFWTADHYGIPDEWADEYLEGEKVHNVQHLAFSVDDMKYCLDSRWFYQLLIATPDLKSISFDYDCLMEGDGETFHVRFLETADVRDPWVPAGGGSVSEEDNKQRRRSSSTRVRWEAAPCDREDNSRFKKMKFKEKLMDGFREPDNWPPTEGKQDDSSDDASTSGKDDRDAFERLPPWVWDREKGDFAFEMRAPFQMVERRGYDDVRGGLVVNCGEYYNTQ

SEQ ID NO: 2510 - protein, 364 aa, Unknown
  Kingdom: Fungi, Phylum: Ascomycota
MSSTKKSPSSGNKSVKPQHRAPKRAGSAASVHHHDHITANAGMDGRHKRVWKACERCRMKKTKCDGEFPCKRCKDDGLVCTAGIRKKVEFKQLPRGYAEVLENTQFALIATVHKLYNMVRTGEQWTLGEPELNDRGLPVIHDIASKLGAIRPNSDIDLPVHSVFPEDEAGMAELARQLEEQQGAGAPSLMSRKDSDSTTSSSMSPEMDHSDDGELDTNYRRMAFGNVKTSMSSPASLTHSADFNDTPTSDIDVNNFNLFATQPTTGNFTPPVWPEMVSQQTADSNTGMYSDRAAQLQGLQQQQQEQLRQLLAYNRAQQMMQQQAGANGNLNSFGLKPQALSNMNSDPMISMGDPMIYHGFDYEI

SEQ ID NO: 2511 - protein, 525 aa, Unknown
  Kingdom: Fungi, Phylum: Ascomycota
MATPSAIPANSSRDTVQRIHRVTREKRSLWYQLSVLQQPERARACGAGSKAHSDRRPVDPPPVVELRVIEGETVETGKDITFDYNANFLLFASLENSRPVAHGRVQTAASQSPPILTGVPASGMAYLDRPISAGYFIFPDLSIRHEGNYRLNFSLFEETKEDKDSDLGMAESDLPPGFDWRMEIKTDPFQVFSAKKFPGLMESTSLSKCVADQGCRVRIRRDVRMRKRDNKHNNNYERREDNYSARAPRAVTPANEDPHAAALRARSLSNSSQQRTPYEADSHRRPSAADSYAPPPPPGYDSTTGPSRGHLTFGDPNAPQYAAPRQPSVSHVAPVSPGGPYTPSGHTTPTTYPAYPTIRPLSRLGQGSSAPFGQDSMDRRTSSAQVPSSPGFPPTDSRSRRDSAASYSSTAMSDHPLSANVSSNTSYSSRAPLKIASLVAPPPSLPIIEAQTEPDVPAPVIPTGGKRKLDYSFDHSQTSLRLHNRQRPQELQAHPTRYILSEEQTAVYERADGTMNTQAFNKFFN

SEQ ID NO: 2512 - protein, 630 aa, Unknown
  Kingdom: Fungi, Phylum: Ascomycota
MADIDIANFPAAVAKADFRAVEPLLQQLDKYLTLRTYVRGYELSEDDKKIWTALQSSKVTLGLVRKGAHANITRWFTFVEQFHPEVKEAATGGDKKKGEKGKANYNIGLKGTENGVVTRFPPEPSGYLHIGHAKAALLNDYFAHEAFSGKLILRFDDTNPSKEKQEFEDSIITDLALLNIKPDKVSHTSDYFKELYEVAEQLIRDGKAYADDTDPEIQKDDRRNKLASKCRDRPAEESLAKLKEMKDGTDEGRRHCIRARIAFDSNNGALRDPIIYRFPNFADKEPAPHHRTGWDWNIYPTYDFACPVVDSIEGVTHALRTTEYADRNEQYHWFLEATKMRPVHLWDFARINFIRTFLSKRKLTKVVDTGKVSGWDDPRLPTVRGILRRGLTEPALREFMLTQGPSRNVVTMDWTKIWSINKRMLDPAVPRHVAIDEKDRVVTTVLGGPEKPYFADKPKHPKNPSLGQRAMRFSSSVLLEQVDVASFAENEEVTLMNWGNAIVRKIVKTGDVVTAAELELHLAGDVKTTDKKVTWLAAEDAENKLTPAECWEFGDLITKDTLEKDDNLDDFLAPVTEHMTPALCDANLAELKEGQFLQLERKGYFRVDKAVGDGPGGRAVLFKIPTGATK

SEQ ID NO: 2513 - protein, 688 aa, Unknown
  Kingdom: Fungi, Phylum: Ascomycota
MDDSTNYGSPSHGATPDGNSLLAQPPLQQDENTVRDGEDVQMAEDVTTDANIKQDSTTPAPAGSSGDILDAPEAPPAETNAGGDEEMGDTVEESKTEGEGEAGAANEEAQGTKSKEALESAAREHLISQTHAIVLPSYSTWFDMNSIHDVERKAMAEFFNSRNRSKTPAVYKDYRDFMINTYRLNPVEYLTVTACRRNLAGDVCAIMRVHAFLEQWGLINYQVDAEARPSHVGPPFTGHFKIICDTPRGLQPWQPSADPVVLEGKKNADTDAKAAAAAGGKADMNLEIGRNIYEANTKGTPINKTEAKANGDTPSLNGISGGDASSKPPIAKVNCHQCGNDCTRIYYHNAQSDATTKSSYDLCPNCYTEGRLPANHSSSAYSKIENPAYTATPDRDAPWSDAEILRLLEGLERFDEDWGQIAEHVGTRTREECVLQFLQLDIEEKYLDSEAAVNAPTGLSMLGSQQGQLPFTQADNPVMSVVGFLASLADPASTAAAASKSADELKKNLRKQLETGSDNSSQVNGKDADKTDSVEVETTMTKTTTTTTTTKTSIATIPLASMGARAAGFASHEEREMTRLVSAAANITLEKLELKLKYFNEMEAILRAERRELERGRQQLFLDRLAFKQRVRGVQDGLKAAAAVGGEQGTRMAHEAMDDGERLGFQTVAGLPSVQPLSAEGQVKSFEA

SEQ ID NO: 2514 - protein, 279 aa, Unknown
  Kingdom: Fungi, Phylum: Ascomycota
MYKIFQTVVLMCLWASSLAQGAGAVECFKGLYMIVARGTGEPYDTAGDLERVAKRVAERIDGSAILPVHYPATFTNPWHVESIRDGSIAARAAITEYAESCPGKIALLGYSQGAQVIGNAVCGDRDGDAANVDPNVACYNKNLLCISEGHTQFSKGDAVDWNTVGDKIISVVLMGDPTNKHGLDFDKGTGRTDGLWPRNWANCGNYTRLMQSYCDFGDIFCDATSPYQDPNPHLLYVNRHGVEAVEFILQKWNTASGADPVSEDGGAPFPVIPDKVCQC

SEQ ID NO: 2515 - protein, 263 aa, Unknown
  Kingdom: Fungi, Phylum: Ascomycota
MPSAKTFLITGAGRGIGRGLSHLLLNAGHRVFLLDSNTSELENTKSLLSKFHNHGQDFKTAQCDVRRPDHIRAVTTEASELFAGKLDCLVNNAAYTGGVGGLSLQDMTLEEWDKSIATNLTGAMLMTQACLPMLRSAKGCVIHMSSTRASMSEPNNEAYSTTKAGLLGLAQSMAISLAPDGIRASAIIPGWIHVGDECKEADETGAKWETELSEEDHRWQLTGRVGKVEDVCKAVVYLVENEGVTGAEMVVDGGVTRKMVYPE

SEQ ID NO: 2516 - protein, 1390 aa, Unknown
  Kingdom: Fungi, Phylum: Ascomycota
MAEDPKPEVADASEPWSDDKKKKFQSKAKSQYYDPCQEAAQRSYKCLFRNGGNKDMCGEYFQAYRDCKQEWTEKRKKENGSMCRKLEDKLAMPRTRPPIKNGVDLQLQSACSEGNWLVALRLAEKRIRISKDPYYETLKICAESQLDDPSTRFAAVTAAWQYVKDGTTIKDVDALDLLEWACQDHLPECDFAETLGTLRMRAVKAGVKNQHEAIRCLESCLLHWDLVNAQQIAATMDRSYPQERKFMFWNIAITHMLSTNEQAPPEKKTLYGMLAQKQIERAAQASESDDSASKGAKSTARTVQSEEEILLLYDVVEKHGSSKDIAKLIESSVLGPVPQFRKGRKELLMRTLRRQKQAQDWRAVFDLCRNCLTNGDEKDPQPEFLAADWSVWQQFIEAASHLESVDTAASTTVQGLLIQFAKSPSLRPIYRRNVLLARLAAVFTFSKPDSPDAKDGQPSSLRLKELVSYLKDQYLNSACFNDVKSFIEKLDDAGLLWLATSLKDYLQLSANDERASNSIELLSLKTRYIVSTSCLTDVVTASDKVSRVCKHCKAETSTTLCHGCLAAISNDALSKYRELRTSSQSHQSGTSSELAILAALCEIDMADLRTDSPSLSPVSIPSLYRALAILEEQLVESPKDSVMLLILVQLHLRIGSAHRARLLWDGLGVKRTIVDCIAPVLYDRLSSVAPALLSRSDRRGYELAECVSSHYDVSLKQPMPRRLLDAFEAESYGSILQIPTYIENLRTGCTRVMSLVEEARTGRLIEGPGGHILDDPRYGEIQGDLKLCETIDFGSYPAWARSERQPVYNQLQLGPSPTNARSHLSLQAEAFHEVLSYRAPPVYKSATGTDPVFVLEHMSRIGNSLSTFLAVGDDSSVTSEEAIYFNLLSVLSGLILLSTSLDRPAAEETLPALVESAKTALGSLQGVLSSSGGTGAEEATVNLSNLHGLTILRDSAVATRLTCQWILAHNEKEKERDRSGQSGLPKDVVAQVKHLQTAAESSSKFGKTWLSTLQSQVGGADFRKHAQAQLSGDQLSGLDTSRTLDHVIASWKATLKGWQDDLRNPNAVRFDAILNDVGGSKSFDWRAIQPRTLRPFKDVYHITMAIQADSVADLITIDKDYLDRVEKRRSIVRAQGSRVHGCLPSGKDAVSELYSFLMGSFLPRRYPTIFTLGPDGKTVHNSATNKSFPREWSDPDMDGALRTLAETVEEDMFLLHETEEGHFSDAFVCCFPSGFDPSQKLGKLLRDIHGPVPSYEKIGSSMEKFFSRLEVGKNVKRMNWSIQTHGELLAISGNHITDEDQSLAQRQDINPEECFLRIELQTLMRLPNTRSILFSFKTYLYPLPDIKAEGSGPQLANAIEGLKKGNAPGMWVYKGSVRWGECVCEYLRSE

SEQ ID NO: 2517 - protein, 285 aa, Unknown
  Kingdom: Fungi, Phylum: Ascomycota
MVKFAIALAAALSATGAFAAPSPGRFGCAAEEPSAELLAMAAKMAEAEADASVNAFSIAEAAAAIEVDLYFHVVSSGSTTAQGNVPDSQLSQQLVVLNNAFAPHGIHFNLRGTDRTVNALWARDGDELAMKRALRKGGYSALNLYFQTSIGGNLGYCYLPQTASAGSTAYIRDGCSILFSTTPGGTSTGFDLGHTSTHEIGHWFGLFHTFQGNSCSGAGDSIADTPQQLSASSGCPIGRDSCPNQAGVDPIHNYMDYSSDACYEEFTAGQRARMTSMWNQYRAGK

SEQ ID NO: 2518 - protein, 975 aa, Unknown
  Kingdom: Fungi, Phylum: Ascomycota
MVLYKRKPVQLLPSEHIEDEDAEVWHIPQTGEVFASYENYLSRMDFYKQRRFNDQISGHSGMTFFEALKNELAGGEEVEAAFPEALKGPVLRKAQFQTVSRLDHLVDMVFDTFKNDYFPGEAVTVFYPDDDKRLAGLVRDKVTIGARPQADGSMSKPITRYLIFVVGRDEESSFEETQVSRERGVFTKSMIRSFMRKTVSREAWNGAPWLVKADYATQYYIDTRIPPHLRYDTKLMERKQLQAQKRASLPNDSASGGPVRLPELKPASKMQKSKNPGAAKGKWPQDVAVHGANPSNGDMLKVAREPTPPPPPKYPIEDLQLAPREDALRPTLEFYCHDPPTEVTNGTSNGASRYSQIDMDSVGPLLETWDTLNVYCEIFKLDSFTFDDFVEAMSVASEQVVVQLFEEIHCSVLKILVDSETDGGKVRITLPQLEDEDDSDEDEDEEEEEEETPEPEPKPSGRATRSSLAKAEAERIAAAAEEEELRVELETKHRAEELLEDYDWIEHLRQRDFPNGGWERIVVGLFHQLSKNERYEPLCEALLLKLVPPEEDPSQESVQLNYAQLDLSHRVKVLQTLCMLTMETKTVRGYMDECSETMTKYRKDRIEWQRQKKQAIEDLRQLNEQRRELQPPETTPSSPKGSIKEEEVDSKLEADDSLIEKEQDEQTDQDTQSKRKRRKPLTEKQRKQEEEREQKAKQKEKEKKEAATPAPSKQLLKIQKEIQKQEAIIKNCEEEVAIIENDLREADCPRTRVMGKDRFWNRYYWFERNGMPYGGLPDSSTASAGYANGCIWVQGPDELEREGYIDVPEDQQNEYKAKFGITVPERKAKEEAGTSVFHARQWGYISDPAKVEELINWLDPRGFNELKLKKELVLFKDRIMQHMDNRRKYIAGADPSDAADDDAGVSKRTSSRIRDKTPEPPNYLCLRWENTTALEELGHLHSEAPPKPRARKQTRKRESAVIEVAAAPAKKTRRK

SEQ ID NO: 2519 - protein, 258 aa, Unknown
  Kingdom: Fungi, Phylum: Ascomycota
MPPRIPTEDDFAPIVRVLPHTLHFPSPREATTSILILFHGLGDSEAPFHTFARNLSLPGVLAISVRGTSPLPPSLLPETAIDGKGHFHWGDDINMDPATGELDDDPGFEKASGLVMNKIVRETLIEKCGWEWTDIMFFGFGQGGSLALGIAARLNAGDRVTDVTNKDTKASPRTCKGVLSIGGSLPQSMVSTVSNRQKSSTSVLLCQFDPEQVEATKREFKEVRVVNWKRRDVAMPRDREEVLPLMKFFADRLNSGWA

SEQ ID NO: 2520 - protein, 352 aa, Unknown
  Kingdom: Fungi, Phylum: Ascomycota
MPPKGDKSDSAENPSSRRERGVIAQRAYRKRHASKFQALKEENDRLRHAIARVGIVAAGEGRFNSDLDSVISDAKNVAKAGEEGSETGGQNDAGTTTTTIVRSECPNGKEASPTAQNVSKTWSSTPGFRNIPTSSGVFVDGNMGMRSFAMPSNCITYLGDASTESLAGSIYRSVLSIAIRRWHTHFQRQSPPTISPDQPLPVTNPSQSLYALPATRSSPLDIAFPLLHPLENDDLVPQCIFSRPPSEQASDSSPTCAHDVVKRCRINEPEGWWRAADGLETFLRQQALPPEALAIFEEVMRGGGSEKHIEDVKAMLEALARNYKCFGDGPRWNAVYVTVAMDMFRKDIMDEE

SEQ ID NO: 2521 - protein, 272 aa, Unknown
  Kingdom: Fungi, Phylum: Ascomycota
MAVNTFARTLKALHVPSTPVVFANIWDIPSINALTALNTTPGSGPVKAIATASWAIAATEGVKDEELSKEGNLRAISRIAPLAIKAGLPLSVDIQDGYGDDIADTVRQAVKLGAVGANIEDSIPSAGFDKGIAGSLYSLEDQVRRLRSAMQAAADEGCPDFVLNARCDAFVLESSPDLSDELRLETAITRGKAFLELGATTVFYWGHSLGRSQIETLVKELEGRVAIQASAIPGLAVKDLAQLGVSRISVGPAMYRTAMKTIQEEALKLLQG

SEQ ID NO: 2522 - protein, 412 aa, Unknown
  Kingdom: Fungi, Phylum: Ascomycota
MAEGRQSFDKARHIKYWQRCHKSLLPTAYTSSDSTRLLFAAFTICALDLLEAPITVSERGSIRSWVLSLQHPDGGFCGSPAHAYEGENAHKGHANLAATFFALILLAAASEGEQEASAAFGGVDRPSLLRWLRSLQREDGSFGQNLWDGRPVGGSDMRHSYLASSIRWMLTGGKVLEGVEDLDLETMVAHVRRGQTYDGGLAESSLNESHGGYAYCGIAALAMLDRAGHGSAIKEGAPRKDDMLKFLAYRQFPYLAQEEEDQSDEDEENLIQQNLEALSLSDECPHVGYNGRWNKKADTCYCWWTGGALELLGHVSMMKTDPSRAYLLDITQHYIGGFSKTAGGPPDIFHSYLGLASLALMGKDGFKDFDVGLCCSQDITDKIVLARGGLDQAQKRSWAEDGFWNAINGSTS

SEQ ID NO: 2523 - protein, 513 aa, Unknown
  Kingdom: Fungi, Phylum: Ascomycota
MDSKAKIEDRQDPIEHAGSLEVEETEKRRNEGFEDLTNTVPEEQRKQLLRKMDFRLLPLLMVLYLLAFIDRANIGNAKIEGLEDDLGLSPKEYQITLSVFFISYILFEVPSNYVLEKYFAKRPATWIGILAVGWGVSMTMHGVVQNFEGIAMVRFIMGIFEAGFFPGALAIMNQWYTKYELGKRIAIFYTASALSGAFSGLLAFAIAKMDGIGGLEGWRWIFLLEGIATVLFGGICWALLPSNPVQRPSWLAEEEIEYLINRMVAQNGGVEADKAGKEVSWGTFWAVVTDMQYYGFVFLCLSNTVPNYGFKFMLPQIIKDMGYTASNAQLLSIPPYVAGAISSITFNFLGDKFQRRSWFLIGPISCIIVAYCILIPLSPNTQDNIGPSFFAVILANIGCYPIAPGVSAWASNNSAGAAKRSVALAYILSYSSIGGIIASYIFIESESPGYPTGFGVSVAFATGGIIAATCLDLYYTRQNKKHDGMTMVEISAKYSQEELAGMGNKSPLFRYTL

SEQ ID NO: 2524 - protein, 448 aa, Unknown
  Kingdom: Fungi, Phylum: Ascomycota
MASALFFLDLKGKTLLARNYRGDIPMSAVEQFPVLLSEAEEESSAVPPCFSHEGINYLYIRHNNLYLLALTKRNTNAAEILLFLHKIVEVFTEYFKALEEESIRDNFVIIYELLDEMMDFGYPQTTESKILQEYITQESHKLEIQARPPIAVTNAVSWRSEGIRYRKNEVFLDVVESLNLLVSSNGNVLRSEILGAVKIKCYLSGMPELRLGLNDKVMFENTGRSTRGKAIEMEDVKFHQCVRLARFENDRTISFIPPDGEFELMSYRLNTQVKPLIWVECVVESHSGSRMEYMLKAKAQFKRRSTANNVEIIVPVPEDADSPRFRTNIGSVHYAPEQSAIVWKIKQFGGGKEFLMRAELGLPSVRGDDEHGGGMTGGFGGSMGGVGGMGKGAKRPIQVKFEIPYFTTSGIQVRYLKITEPKLQYPSLPWVRYITQSGDIAVRLPDVA

SEQ ID NO: 2525 - protein, 597 aa, Unknown
  Kingdom: Fungi, Phylum: Ascomycota
MSDFGHYGASDEDYAAVRKHNAEVEADPDNFEHWENLIKAAENAEGNLNRNSSPQALATFRDAYDRFLSKFPLLFGYWKKYADTEFNIAGPESAEMIFERGCANITNSVDLWTDYCAFKMDTTHDPRAVRELFERGAQVVGLDFLAHPFWDKYMEFEERHEAHDRITGILVRIIGIPMHQYARYYERFRTLAHNRPLTELVDETLLSTFRSRVEAEASAQALGQRQELEIERDVRAKIDAYYYEIFTKTQEEVTKRWTYESEIKRPYFHVTELDHQQLANWRKYLDFEEEEGDFGRVVCLYERCLVTCAFYDEFWFRYARWMLAQQYQSPAQNLKEEVRNIYIRASTMHVPVSRPGIRLQWAFFEESCGRIDIARDIHEAILIKLPDCVEVIVSWAHLQRRQGGLDAALQVLKDHIDAPTVDLFTKAALVAECATLLWKGKGAVEETRALFLKNAQWYADSRLFWEKWFSFELDQPSAGGPTSPQTERVKHVFDELCSRSRLAGAVKRELSQYYIKYLVQEGGKDAMTAYLEADCQIFGSPGAVAKMVARQPPKENGAAARGELDEASKPKAEARYLSFYELHSEPQADAQGPADFN

SEQ ID NO: 2526 - protein, 421 aa, Unknown
  Kingdom: Fungi, Phylum: Ascomycota
MATATILQPASHHPPSHSSAYLTPTATVSSMISSEAGKPPGADSKDSPSRQSLPSISDVLKVAEPRQFQPPAPPSMPPTSSFPSPFTSGHRGSYPDGDKHASPQTLHHSSFPPRQEPPSGYADSPRSSFHSRPGLPAMPERRPSPPLRPELPPHHMTEPPRGHDPHHPLNNGAYAHPPHAPPHPAGPYAHGPLPPGQVPLPGYPISPHRAGPPGPHAYDPRGPPPSHLEDVDAANRARYDTARHFETWAYPQALGRVASSARTVFNFAEAYHRLAAEQSGSPPMPERLPTDHEIAEMLSTTDLVKRSLEQVRDLVHQSAQSERIRDSAKQPKGPYDDDDVSMYSDHMKAPQYAMGETKKRRGRAAPPGRCHSCNRIDTPEWRRGPDGARTLCNACGLHYAKLERKRQLEARQIRPKHDERA

SEQ ID NO: 2527 - protein, 453 aa, Unknown
  Kingdom: Fungi, Phylum: Ascomycota
MSSTTQFSSLSPDETILKLPHPYNTEFTIHKAPSPSSSSQLYQLIQKFTPDSKANPFSLVSPNLHFSEPADLKSSEAPPPSNNSAWGRARRSPCVTCQWSGGEAPSQAQAWLLLYVLFTVRPGMESLRVEFNGKGAGRLGQQLCDVLLAVQHPLQPKEERGATQDDKASIVAMRSTFWQGAGSPFGPRPVWCPDASPASLSSTNLSSFPLTPLLNTTSIQLAGDPQDPERHMQAWHPIRPAKPAPGAVIYSRWIPHLKETFSMVSLDYEDAEHLRLFHEWQNDPRVSQGWNETGTLDQHREYLRKIHEDPHQVAVLAKWEDTYFAYFEVYWAKEDRLGAYFSPGDFDRGRHSLVGDVRFRGPHRVTAWWSSLMHYLFLDDPRTMAVVGEPKDTNSVVVMYDLIHGFGLEKFVDLPHKRSALVRCSRERFFQLCPLGESEKAVGGMGIGLVPKL

SEQ ID NO: 2528 - protein, 844 aa, Unknown
  Kingdom: Fungi, Phylum: Ascomycota
MDMSSSAVDGASATQTAASTPNHKPAAESPATTRNTSASHESVASKQSSANSSVNQSPLASRESSPVRNPRRMASNTKLGASTSRRSSQQDLSPARQMRSSIPGPASSQRTLTSATTPTLLPAQTSTSETRTPSKPTINTDLKDSPRWPVSPRLRSPPPQLNQPGVASGRRQEQEAPSITVQKPSPSPLTAEPVTEVSESETEDSQGNSGHRTPARGALETVQEVSLPSSPSPKSDAVLMEQVKEKLSNPENQSDSALHDRALKARPSWPTQEKEGGNESGNSRADQRRPTSVPPPVVSRQSSALSTKAAKTKAEGSTQNMTVETETVPSIPQVALSTNTKGENINGTLKTKPSNETIRPRKEKKKTVRKQPPAVAGTASSKADIFEAKIASAVDEANTSDSEETFVYDSNPPEAGDRNTRRFHSRTPSATSMVSQADRQNFRSIHSIMDGSAGPASGPRKNMKFVNTSAANGNDSMTTGDEDGTGTNRSNGTGSARGTTRRLHHIGRWGREPPKSHPSLFDNESPFPNAARSKLSGAASRNSSGPPSPRNNQSARGLSAKRSMQMSGSYDLDETAADDERTPLVGTARSSRSGRRRGPHNLRQAESQSFGRRSSYLNRFAACLVLTMMLLLVITGAIGFMFATSQPMTNIEIVSISNVVTSEQVLMFDLSVKAHNPNIVVVTIDQANLEIFAKSEHAGTDSDWWEHPHGPDELHPWDDPLDDPPSGDPDDGDDSSKPNVLLGRITDFDSSLTFEGSLFHKGTSQSTGEMQLPFPGNGTSGGSERWERIFQNEFDLIVKGVVKYSLPLSAHIRSATVSGRTHVKPNSASDPSPKPNNTVTDEFD

SEQ ID NO: 2529 - protein, 295 aa, Unknown
  Kingdom: Fungi, Phylum: Ascomycota
MVQVFYDPTQSQSGTHARDDLKAQAAHQSISREEHAHLVRDLAAKRGIRAPRRGWSMTEAGHAERRHIIHESTLASVSENSSSSSGTSTPISEASFDEILAQNPVPLELPVRPKLPAPRRSYSVQDYEPMPPLLPKPSEHMTILDLPSELHYTLFDFLDPLDGVCLGLAHPRLHDIAKRKYGQQVSLASRYSGPNDMEWAWRGAGPLVRANTGGPPARTAEESKLRPKGQVYCRKCGISRCELHRHLKEWMGEDREYCEIKKIFGNPAGEDAKTYCYMSSPKNPDRCGRHGPRQK

SEQ ID NO: 2530 - protein, 440 aa, Unknown
  Kingdom: Fungi, Phylum: Ascomycota
MEQEWQAGDWPAQGKAVPEQTPIESPGSDESEELVAHGVRGRTDGGWHAWSIVLGSWCAMIPSMGLLNTLAVLEARLAENELKDVPKSTSGWIFSCYAFFLYFCGAQVGPVFDAYDIKVLIIPGSIGITLSLIFLSFSTEFYQILLSFGVLGGMSASLLFNPSLAAIGQWFYKRRAFATGVACTAGGLGGVAFPLIIQELSPRIGFPWAVRIIAFVSAAHLTVACLCLRKRLPPNKKSGASVDLKALREKNFGITTLSVFLIEFAVFIPYTYICSYAIYAGMSHQDAYRLNAFLNAGAVPGRALPGYVADKIGVFNTMCITSLACTAFILGLWQQSYGDDTRITVFSVLFGFFSGAAISLTPVCVGQVCKVEDLGKRNGTAFFVAGFGALVGVPIAAAVLEAGGGDYSGLIWFGGAFYLVATVAFCIARGVAGGWKMGVF

SEQ ID NO: 2531 - protein, 761 aa, Unknown
  Kingdom: Fungi, Phylum: Ascomycota
MGSSESSSVDMLRMSWDLEDGVVASEAVVRVPGEEDEEDEEDEEDEAAEAEAGEGEELLDQLLGASMELVWPKSKFNLIVDLRDSLTKDFRQSESESEDEMDEDTASEDLSDGGEESESEKPAARPYMALLQSFQQDTEPSAKRRKTHHGASQQKEASKDESDDESSVDEEDKDVDHVEEAEETAEDFEIAEQSDSDDEEDEADPFESHFAHPDDKAVAMHVAAVKKADWTTKKALVPAGRATAMLPSSVSQAELATPITTLDGLHLKQKLQQSAKDKLPFNNFQQNLSPFIFNNSDLLYCDRTVKNSTQLRQLTCLHAVNHVLKTRDRIIKDNGRLAKEGEDTDLELRDQGFTRPKVLFLLPTRHACLRMVNTIRDLTQPDQEENRKRFDDSYHDKEQNFGTDRPADFRHLFEGKDDDMFRIGVKFTRKTIKYFSQFYNSDILFASPLGLRMAIGSEEEKDKKKGMDYDFLSSIELVVMDQADALLMQNWEHVEFIFEHLNKQPKDAHDCDFSRVRNWYLEDWAKYFRQTIIMSGFNTPELSELFRSQCHNWAGKVRIQQEYPGSLQQLGVRAKQTFSRFQPGTVEREPDARFEYFNSAIVPSLVKRAKDATGTLIFVSSYLDFVRVRNFFATSSSVESLTFGAISEYTDIREASRARSHFINGRHKILLYTERAHHFRRYQIRGVRRVIFYALPDNPIFYKEIAGETLLKSEEDMELEPGQGTVRAVFSKYDVMKLERIVGSKRVGKMLQERGDTFDFV

SEQ ID NO: 2532 - protein, 795 aa, Unknown
  Kingdom: Fungi, Phylum: Ascomycota
MAKDKKKGGADAKKARKAEKAAKQANKGEKKIKAKTAKIEGSDAEDVDLDEVLEEYRRQQEQFLKVTETVLEGPPRARAHATFMANPGDSNTLLLFGGEYFNGSLAQFYNDLSIYNVNRDEWRSITSPNAPLPRSGHAWTRAGNPNHVYLFGGEFSSPKQGTFHHYSDFWRLEPATREWTKIEAKGKDKSPPARSGHRMTYWKQYIILFGGFQDTSNQTKYMADLWIFDTVNFTWHSPVLPPAQLKPDARSSFTLLPHEGGAVLYGGYSRSKTTVALKQQKGKGAQNTGQKNVLKPKVHDDCFFLRMTQPAADAGPNTLPSVRWERRKKPANAPNPLRAGATMTAHKGRGIMYGGVHDVEQSEDGIDSEFFNQLFAWNIERNRFMPLALRKARNQKKVAVEPRGGRRGRGQANEDELLRNLAALNSGASLDDAEDIELEKKEEEVEETPKKDMPITMEPPHMRFNAQLTVQDDVLYIYGGTFEKGDREFTFDDLYAIDLGKLDGCKEIFMRPVEDWIESDDEDDDEDDEDDEEEEDDEEYEDEGEEDKSQMYTPSKRKKKQDEMSDTSSEAAETPSVTSEDDDDTETTTTTVDDGLPHPRPFESRREFFVRTSAEWQEILMTSLRWKGIQPETMAIKELKAKAFELSEEKWWDSREEITALEEEQEAAGISEVVSLAERGDAGAGGGARRSALPGALFAKPTTHVPTPYSTPTPRHAPSQILLNNTLSRPASLLPLGPQYQRGSIPDESGRLLGHGRVLLALALDLWLARAAVIFLDGVHDHGDVAAAAPPGCLA

SEQ ID NO: 2533 - protein, 358 aa, Unknown
  Kingdom: Fungi, Phylum: Ascomycota
MEAATSSFTSRRPAAVSLPAFSLPSPASVIPRAADGISPSLSSVNTGSSQGSQPHTTMAPYTNNIGHGHGSWQTPGHNSYNLSSAPPPQLTLGSYTAQRPSLYSQNSSLGFGGQRDSPSPTAGSSDVLPPPPDHHVHQPFPTPLGGHPGSGSASFAHGTQNAMMSSHSTSQSPSQSHSLPHLDTYGSGRGASGFPLSSAGSAQPAYPSYASLQSPNHASPTTASPGLRGLGAMAPPAPYRAPPFANYGSLPGVNGGMGVPSYHGHAMIYGQPPPTVQERPFKCDICVQAFSRNHDLKRHKRIHLSVKPFPCPHCTKSFSRKDALKRHKLVKGCDKKDADKSSPEGADIADLDDEIKRE

SEQ ID NO: 2534 - protein, 889 aa, Unknown
  Kingdom: Fungi, Phylum: Ascomycota
MMRVPIISALLVASVLAQDPSWRQGSFPEPKYFGEAGWDQHYSNRFAKERLDDDERQTAVSGLVQSYLMTMNDLKVQTWLMHGTLLGWWWGKRVMPWDPDADFQITEADMFYLGAYYNMTTYHHRPDALGEDRDYLLEINPHFAHRDMDDRLNIIDARWIDMKTGLFVDITAARYALNHKKGEGVLYDKNGHEFRDTYLYPLQQTTFEKTPTLIPYRYKAMLQSEYGEKALTSTTYKGHAVPSGWRKYCIELGWEKPDGMAEIPAWDVEVHLNLMDRANIAKSVLSITSPGTYLAPGNPSLCRKITRETNVEISNISAAHPDRLSFFASLPLPDVEGSIAEIDYALDHLGAKGFAILTNVNGVYLGESRLDAVFEKLNERKAVVMIHPTTCRLHPDPASVSAVGTTKESQAQEAVPIPQYPRPMLEFLFDTARAITHLILSKTVERNPDIQFIVPHCGSVLPAIVERFTSYSARVYGTNSITSDDVRNMFKTRFFFDLAGFPFPDQIHGLLRFTNSSRLLYGTDFPFLPAAAVIESAERNDREVEALFSVEEQENIYLNNAKIPTISIAPWLDGSARDDVVEAVRSACKTYGFFQLVGHGIPLESQKQIFEAAKTFFELPMEEKMRVAKDPTSGRGYEAPGTQALQPGQVPDDKEAMRVGRDVPVDDPRYGTYLYGANRWPDLPDEAFKNPVMDYRGHILRLALEVIKILASGLPYSDDVFDEFIEDPVGSVKMLHYPPRSADGPKIGGERSPYSYELSLETGPSDKAFAAGAHTDFGAITLLLQHTGQEGLEVLHPTTDTWIPVPTRENTFVVNIGDVLGAWTNGLYRSATHRVINNSSEDRYSVPFFFDGTMTTKMSSLGAAVANNEKVKTVGEHFLEKFSAADKKL

SEQ ID NO: 2535 - protein, 848 aa, Unknown
  Kingdom: Fungi, Phylum: Ascomycota
MNGFPAPGGYGQPPSAWQEHHTPDGRAYYYNNTTKVTQWTKPEEMMGPAERALANQPWKEYTAEGGRKYWYNTETKQSSWEMPDAYKAALGASAPQAPPAANAYPTPNQGYDQPRDQRDYRDQRDQRDYNDRRDYRDRGRDRDDDRGYRDTYSESRQISYPSDPKAQTFVPASNDPEYATPEEAEAAFMKLLKRSNVQPDWTWEQTIRATARDPQFRSIKDPKDRKAAFQKYCQDMVVQDKERSKERLAKLRSDFETMLKRHPEITHYTRWKTARPMIEGETIFRSTDNESERRQLFEEYVIGLRKSHADQQTTMRKGATDGLVDILQKLDLEPYTRWSDAQDIISATPPFQSDAKYQTLSRFDILIAFQNHMKALERAFNDSKQEEKNRKLRKERKARDGFRSLLSSLRKEGKINAGTKWDQIMPQIENDDRYLNMAGNGGSTAQELFWDVIEEEERGLRVPRNDVLDVIEDKRYDLTPTSDLEEFLSLMKEDRRTANIDRNILEIIFERLREKRISKREDDKQPDRHQRRAIDDLRASLKRLEPPIVLTDTYDKVRPRLIKSEEFQAVSTEDFRRMAFDKYIRRLREKEEEAERSSHHRRREPRSVEPEAHHRRERERSRGDRSHRGSDRRGSRRSRSPETDAYEADRRRAIAERERNHRKTTMAENLLSTDRGGPDRGGRAPSSPPRRDREPRDRERDREPRDRDRERERDRDRDRERERDRDRDYDRPPRDPRARRDEDSHYDRERRDREEERERLYRRRIDSGSYDGLPYGDDRPSGSRRRRPEDEDDYSRRGSRDSKRLKREKTPERTPQREAAAKPTQESSSVKPEDIKSGSEEGEIEEDE

SEQ ID NO: 2536 - protein, 594 aa, Unknown
  Kingdom: Fungi, Phylum: Ascomycota
MPMLLAAVTLSVLYFWTLQNDAAPPHVQLNTPNTPTTPLPPAFAIDETYAWRTLAINYPPQSIKPLPTEAPKTFPKIQADFAPASDGARKLRKERQDTVKKTFLKSWKAYKEHAWLQDELKPVKGGSRNPFGGWAASLVDALDTLWIMDLKDEFAEAVDAIDKIDFRETTLSEVNVFETTIRYLGGFLSAFDLSQDVRLLTKAVEVGDMVYKAFDTPNRMPVMRWNIKAAADGERQVAGAGTLSAEIGSLYMELTRLSLVTRDPRWFDAAHRITETFATQQDSTELPGLWPLVVDAENMVFKSGSTFTLGAMADSLYEYLPKMTALTGGQLPVYQRMYEKAMDVAPKHLFYKPMTPTNEDILVSTAFNTKDGSAARGHRDTQGQHLVCFLGGMLAIGGRLFERPQDLQLAEKLTNGCIYAYQAFPNRIMSETWNMVSCDPDSSCPWDEERWKKEVLKSNSKGADATLQEADAIIHDDALPQGFTRIPDRRYILRPEAIESVFVLYRTTGRQSFADTAWDMFTAIEASTRTDLANSAVSDITRPGESPLRTDSMESFWMGETLKYAYLTFSEPDLVSLDDFVFNTEAHPFRRLKA

SEQ ID NO: 2537 - protein, 1042 aa, Unknown
  Kingdom: Fungi, Phylum: Ascomycota
MADYERTVLDFYQLPTAYPSEWPAEKDRGDSSDEERDDKVNKLQNRKSRYQALERAVSGRRSVIPGSEGDQEGGLGNLVQKDEPDPLGTADSVVRALRLQGLSLQDDARLRNRFLLSSTTFSPALFLSQMHSTADTQKLLAGLDFLSQSIDQKSASLKVLVESNFERFVRAKSTIDNVYKEMKYRGADPSANRARPHSRHASRSSYRNSIGPSSGAINPFAPAAPDTRKKNALVKESEYGVAGVKAPLLDVSAKAEDVWGPALGGREKEEHLRDVSNYMNRYKDYMELSTSVADSIKRKDYETLVEEHNKARAFADDARRLARNLEGEELEDAQLYQILLAGRMWHDVDQQIQAFKRDLWKRLISLHSPKAESIGGRAQEQHGDVIGLLLELGVDDNPIWVWLLSRYDFLKGKIQATADRSKVEIEVLRRRLANGQKPTPQVVASHLRLLGRQPVEEKPVSTDSADVLELWDKMLAFLNALLSSQGILGEVIDFWQTAQGFIDGQAQANLPVGYKGESKHHHELSAKVIADLKKGAVDLVEMMHEHLYEFFAGPPPEDVSLLFSPLPQSPGTPASASGPYSGSALTPTALRDPRFNFDSSNPPPSSPRVGESWEKLAFWPPWSNSISGVYYLSKMLALVGSGASDMARIGPVENGDGQVVDRLRSLVGISRERCVTALCAAWNRDAENIKHVEDWKRSADRGDVTRMPAAFATFEGALLSGMQKILYISEAMSKPGAGEIVLPPPTKVLQMVRSQYVTTLYKALSGMVENAERAIKKTNDEWSMDTDMSIASSTDTAVASRSTLDAGDRNIRMLLTLSNLQALRSQVVPSLNSQFENAFSVKLTDESKTIRDVLGQIDARLFQSYTKQSIDKIRDIIQAGLSAEDWVPPAAQRPTTAKPYVYEVLLILVLVHSQVSTTAQSLTPQVLSFLLEQTSLQLLDAFRKRPRYTLEALMQATLDVEFVAQTLSHYTTDRTTELQGQIYAELDGRTDNDARARLQSELPEMRNVLKRLRDASKNEFACFKKPKKPGQAPRRTDSGLST

SEQ ID NO: 2538 - protein, 897 aa, Unknown
  Kingdom: Fungi, Phylum: Ascomycota
MEGKTSEGTLAERLLELGKAALNPSGITNVKNLKLQEYEDLLHKSSTVALIPALNALIKPNVSPPWLREHLLRSLTRLPLRPYGVRATLEFVFSVHPSNVGRAPTSDTPEKQGANITHEAVAVATKLLSSVPAGMSAQDWFNGISGQIFELIDGKAGPDVSRTAAQIVGFGILGKRQFGAPDAPGWNAFVRPILADINPSLVAGRATSEQAGEHEIVDLSLGHVLVSNSSLARSLLRLKILILSNPAPGLCRRLLSPVLQQLWTLASWIDPSPTQHEIICKPALIMLQTFLKLFGTHDVILSLLKRISCIGSGPDVEEAWSYRTNKKSEIDLVPVLDRETSTTVEWPVIDTKADTLVDNIVTMCSPEEISSTYLQLLESWILGQGHTKDIKLEPSSIHQSSRGNVMDELADVAVLQKLMEKAPDKLVSRFDQLLDLVCKVLQTDQSSQLGDDIMAVVLSLLNLIVGAPSFRKTDISPEKLAVVEKALTRISHQDRPSVSPTARNLQMLLKYRGELDKIEDEEEPRMRIDSRTVNDRRTYALAMEYITGVDSPPPVVSEGLNLIMGLIQNGSSVLDITSTLVLMSNLLTSNEDFINLRVVKIFTILANKHPKATTEEILDHYLDSQEKSSTDVRLRFGEALVQVIERLGETFAGNIAEQTCETLLSIAGRRGYRPKTLAKQAREERMDKLKKGKGREPDIPEEDEEAGETEDDRTNNDILAQIVSGWESKRGSEDVRMRASALSAFGAALETNISGVGAKLTSTCMDLCINVLTLEAEPEKGILRRAAVIAVMSFVRALGAAREAQRPLGFGLTDESRKDMALSLNYIAATDNDGLVREQAKDVAESLENWALSTLLPTDGDDMKSPGLTRLAGLAVNPVISVDSGSGQPRPRIEEIE

SEQ ID NO: 2539 - protein, 630 aa, Unknown
  Kingdom: Fungi, Phylum: Ascomycota
MKSSFTMRLGSILATLLATGHAAVVKHDFNVSWVTANPDGAFDRPTIGINGKWPIPRIDANIGDNIVINVHNQLGNQSTSLHFHGLFMNGTTQMDGPSQVSQCPILPGESMTYNFTIQQPGTYWYHSHTISQYPDGLRGPLIIHDPKFPYRGEYDEEMVLTLSDWYHEQMQILIPPFMSKGNPTGAEPVPQAALMNETQNLTISVEPEKTYLFRVVNMGAFAGQYLWIEGHNMTIVEVDGVYTKPAVAEMIYISVAQRVSFMVTTKKGETGNFPIVGSMDTTLFDVLPPELNYNVTGWLVYDDKNPLPEPKTVDSLDIAYDDMNLVPYDEMARLPEPDQVVTLDVAMNNLGDGANYAFFNNITYKSPKVPTLYTALSAGKLATDPTVYGEYTHPFVLDRGEVVQIVLNNLDSGRHPFHLHGHHFQALHRAPEEGGVFSSSAVPEDDLPKVPMRRDTMVVWPNGNIVLRFRADNPGVWLFHCHIEWHVTSGLIATFVEAPLDLQKNLTIPQDHLDVCKKGGVAVSGNAAANTVNFLDLSGQNKPPAPLPAGFTSRGIVAIVFSGVAGVLGIIVVAWYGMSGAGEATDRGIDSGVLSERESEATGEARYHAGDGIGSVGVPKHETGPQVTVA

SEQ ID NO: 2540 - protein, 561 aa, Unknown
  Kingdom: Fungi, Phylum: Ascomycota
MSTTTEAAGYYDLGTFHRSITTTSHDAQTWFNRGLVWTFGFNHEEAIQCFSKAISLDADCAIAYWGLAYAMGPNYNKPWSLFTHKERADTINETHDAIQKAGEVARRSNTSKFERKLIDALMYRYPRDQEPSKTNCSTWNREYADAMGEVYSQYPNDLDVATLYADAMMNLTPWQLWELDTGEPASAARTVEIKRVLDQALASEGGTKHPGILHLYIHLMEMSSTPEAAMPAANHLRTLVPDAGHLCHMPSHIDILVGDYSRAVEANTAAIIADNKFLAREGPMNFYTLYRCHDYHFRLYAAMLSGQSRIAFETVTELEATISEEILRVEQPPMADWLESFLAMRVHAYVRFGRWSDILALQLPHDQDLYCVTTALIYYAKGLAFAVKGNIDEAEHQRTLFLAAVPHVKPTRTIFNNKCITVLGVAEKMLAGELEYRKGNLDAAFSHLRDCISLYDSLDYDEPWGWMQPVRHAYGALLLEQGRVEEARGVYAADLGVEKSLPRTHRHPRNVWALHGYYECLIRLGRDGEAEDIKPVLEEAKEIADVKITSSCFCRRDVAKL

SEQ ID NO: 2541 - protein, 195 aa, Unknown
  Kingdom: Fungi, Phylum: Ascomycota
MSSFTLSAAPNTDVWKKPPTTDVFNAPYKPHSKGPLTTFKTTSITFSAPYTTQYDQAGLLLTLTNTTSSQKKWIKTGIEFYNGQPRISTVCCDAWADWSVSSLPPKAPAGEIEAGNKTVTIKVNREGDENGVSFWVYYVAEDGEELPLREICWVFGENNGDGVELEVSAAVARPNKDVKGELEAKFTDFDVKWSS

SEQ ID NO: 2542 - protein, 336 aa, Unknown
  Kingdom: Fungi, Phylum: Ascomycota
MKAGQWDGKQKKVVINDIPVPEPVENQFLVKIHSASLCHSDLMNDMRPETNVTLGHEGVGFIEKIHPSAEGKGFKVGDAIGFNYFLGVCFECDGCLVHNLRCERSPAQLQGFVADGYFQEYCVVDYHNAVILPKELDMKRAAPLFCAGITAFHAVDSCELKSGEWLAVVGCGGLGQYATQYAKAMGYKVVGIDVNDEVLESVTKLGADAVVNSKTNPNAVEEVKKITGKGAHASAVFAAAPQAYSAAVEYLRVGGLLMVIGISTEDLKVSTFDLTTGRYRIKADSTSIPQRMAKAVEFTAKHKIQPDVEFRKLEDLPQMVSDMQAGKAKCRQVVVF

SEQ ID NO: 2543 - protein, 885 aa, Unknown
  Kingdom: Fungi, Phylum: Ascomycota
MAGVKRSISSMLGHDETRAMHVTGHQSHNYSIGSSAYASRSPTSWTPSERTPVRTPLRTPGRSPEPGTRTPSPRLTPFTGKVSDFGGDASIVLAGIRGCGKSTLAIMAATAMKRRVIDMESAFQQTMGASSAAYKRMHGGGACHEQQARLLCETLEKNTRGCIIVCSWMEITAQRLLRSFAATNPVVHIVRDLDPIQQHLKITDREKMQNLLAVSNAIFRSCTNFEFFNISETDSVRASHPGQLDRLPSPYLTLKGAERHFLKFLSQIYPPNSIPFIEAAFILATIPTEQRLFTYALSISMADALDGKADIEDYNTGADAVQIVVPPLPGADAPGGHANLGFELASNITRAIASIRRNTVIPIIAHIALPPRLDDETKALYISLISHTFRSAPEMVTIDLRLEDHEVLPLLEAKGRSKVILDYSFTDANDAPSWSSPVWESMYKRAVRLGSDMVRFLRPALCLEDNFAVSKLRGHLESISGRQIPVIAHNTGAMGRNSACFNPILTMVEREETNSTTRDPAMLSARAASLALSASFIYDPMQLYVFGANVSYSMSPAMHNSALAACGMPHQYQPYSTNTMSGLRHLIEDPHFGGASVGLPFKVEIISLTHSLSKHAQAIGAVNTLIPVRQLDQNGYVPQGAQFLNSINRAGPVKALFGENTDWIGIRACIRRGLSPANAVRKGTCGLVIGAGGMARAALYAMLQVGVQNIAIYNRTVSRAEQAANHFQQLLYKEDFQTLGAGRHTKFRIIKSLDEPWPSDFNLPTMIISCIPTHRIGDVPAPDFRAPEEWLSSRSGGVIIELGYKSLDTPLLAQAKSRASQGWVAMDGLDLLPDQGFAQFELFTGRRAPRRIMRRDLLKAYAAAHGKQEREEIGPRLGSLNEPEA

SEQ ID NO: 2544 - protein, 122 aa, Unknown
  Kingdom: Fungi, Phylum: Ascomycota
MAEQLSTPRINARYLDSFTGKLVMIWGKVTQLRGEQATIDSDGAVNVLLNRKSSATAATKPLHKCESHLANGNIVQVIGKVNPDLTVKVLSSRDLGSNVDMTLYNHVVDVTHKHRTIFGSNN

SEQ ID NO: 2545 - protein, 650 aa, Unknown
  Kingdom: Fungi, Phylum: Ascomycota
  misc_feature (639)..(639): Xaa can be any naturally occurring amino acid
MKFAHFALSLLAVVSPVTAAWSKEDREIFRIRDEIAAHETDPAATFYEILGITNYASQDDINKAYRLKTRSLHPDKVTQQLRAERTKGKNKGGKAPSNSEIQKAVKQASERQARLSLIANILRGEGRERYDHYLSNGFPLWKGTDYYYNRYRPGFGTVLVGVFLVIGGAVHYFVLYMSWKRQTEFVERYVKYARDTAWGGSMNIPSPEPEPAAQDDEEGPRQPVNRRERRMRDKETKRESGRPKKARKVKSSDSSRDTSSGPTGQKRRVVAENGKILVVDSLGDVYLEEEDKEGNVHEFLLDPTAIPQPTVKDTAIFRTPLFFYDQTIGRVIPRKAEVEELDDIVDDEDSDEPQRTPSDSAGEDFEMLDKSVDSLGKAKSTGTQKSAKPSKRKGRKNSHHPNIANSNAGVLLLTIDKIPSWYGDNPYIHNYYRPVFASVTPCFQSWLYLHNQSANIYTHLIPGVLALVVNGALFWLFRQYYPDATFWDRAVFHVYLTACSLCFGTSAAYHTLLCHSHEFADLWVRLDYVSISVLILGSFVPGLYMGFYCEPLLLRGYLTMIFAMGIYNGYSSLQDRFGNQDWIKSRLVPFVGMGLSAFIPIIHAAFIFPYDQLQKQSGLNYYYLEGILMVIGVLFLAVXSVPRALAAGHL

SEQ ID NO: 2546 - protein, 227 aa, Unknown
  Kingdom: Fungi, Phylum: Ascomycota
MSSVWNALTGGSKAGSQHQQQQQQQTQRTTFDPSEGQGVESFLQSSSFADPTQLHPLAGLNADTLEYLSLEDSALSDLPGGQSVLPSRGFTDDLCYGTGVTYLSALSLGGAWGLQEGLRRSAGQAPKLRLNSVLNAVTRRGPFLGNSAGVVAITYNCINSGIGYIRGKHDAANTVAAGALSGMVFKSTRGLRPMMISGGIVASVAGAWAITRRSFFPVPEQHAHETI

SEQ ID NO: 2547 - protein, 182 aa, Unknown
  Kingdom: Fungi, Phylum: Ascomycota
MRAGQRRGFRFSPWSRSQKAGEAAEAPLSLGARLKKLSREYGKAAVGVYFALSILDFPFFFLLVKAVGAERIGKVEHWLMTHVIPESVRRTWNEWMAYFRKTEIKETGQEHVSDAVEKAGWGVEEAQERHQEEASLGTQLALAYAVHKSFIFVRVPLTAAVTPKVVKVLRSWGWNIGKKTPK

SEQ ID NO: 2548 - protein, 407 aa, Unknown
  Kingdom: Fungi, Phylum: Ascomycota
MATIKPYKIAVPDSALETLHTKLTHATFPNPVDFSDNWDYGSPLTDVRRLAERWRDGYDWRKNEKKLNDELPQFTTRVPVDGFGELGIHFVHKRGKREDSIPLLFVHGWPGSFLEVIKILPLLTNPEGDAPSFHVVAPSLPNYGFSDEVTKGAFAIRHYSAALHQVMLNLGYDKYVTQGGDWGFAVTRMIGYQFPKHCVASHLNFVRITTAPSITQHPIAAIQHALKPYSEADRAGLERSAWFDWEGYGYNHEQSTKPSTIGFALADSPVALLAWIYEKLHDWTDSYPWTDDEILTWVSIYQFSTAGPAANVRIYYENRHAGGDLQLKESGYIPSVKLGLSCFPRDLVVPPKGWGVQLGPVVFERYHADGGHFAAHERPQQLANDLREMFGPGGGAYREAQSTIKQT

SEQ ID NO: 2549 - protein, 271 aa, Unknown
  Kingdom: Fungi, Phylum: Ascomycota
MDAAAPPSFPALEDRPLKNTICLFDVDETLTPARLGISPEMLALLASLRHKCAIGFVGGSNLPKQEEQIGKPAGVPVTTLFDFCFSENGLTAFKLGQALPSNSFIQHVGEEQWKEFVKFVLHYIADLDIPIKRGTFIEFRNGMANISPIGRNASTDERNEFSAYDKDAKVREKFVVILREKFAHLGLTFSIGGQISFDVFPTGWDKTYCLRHLEAEAKKPGGISYDTIHFFGDKAYEGGNDWEIYSDSRTIGHSVEGPEDTMRQVKELFDL

SEQ ID NO: 2550 - protein, 357 aa, Unknown
  Kingdom: Fungi, Phylum: Ascomycota
MRRTILAAFTTILALAAGAASERCFLTTDWTEDVLIPGQPNVLIWTDGSSNRDVLLDTLDGSEVAFVGAIARNVSQGSVFWVPPINITGGVANQTFEIQLWDMTTGFGCSSPAFRFAEVDVTEDESTTDVPIGPFVTTAISISNTGYVTVTATVATFQSDTPIFEQAVTGSITATDGEGPTSTSMSVPESASTTASDADDEGDSGPNVLAIVIGTIGGVLVVALIVLSVLLWRVRRKRATEKARLESLEEPKEISPLSTPDSQMSEMAIRQGTAVTEVSGDTARHEMVGDSTAPQELPTHSMDPVELPADEIPPPSYPGHESMVSSPTTGDSRRSSLSFDKGTFTVSPVSHRRDQKD

SEQ ID NO: 2551 - protein, 345 aa, Unknown
  Kingdom: Fungi, Phylum: Ascomycota
MASRIALRAAFAAPVSLRSSSSVFSRHTALARNAVASTQVRFISKAPPDPWRAFWNGIKMPPITFKIFEDACTQGKRDGFFQRSTAVDYFECAQAFIKAVQNGSSPGTTGLKDDPRFDAATIYETGCIMHSHHPTLSPIAVAMWASSSGLGFHPAAITLVGDLVKRLRFGTLIMMRKVEAHFRRIVAQGTDANALAIEALRLYRMEKKNAQATAMYKRALKLGGPNFSYKGKCHHGLGHIAHSEGRLEEAAQHLEEAHKVDPLGTGLLLGDIYTSIDPSRAGAVYYQSAIFGEPASFDRLADMELGMSMDATDPSTRSDHHLWALELQRLGNAKRAQLQALAAAR

SEQ ID NO: 2552 - protein, 585 aa, Unknown
  Kingdom: Fungi, Phylum: Ascomycota
MAAINAPGIIHRLPSQEHEDSLQSTANIISPSREPWPNSSGFETPEHRGPISLLVKGSIPSFAAGAFYRTGPGRNKLDGLPNGKIHYVSHWFDGFAHTHKFDIKKDGSVEYSSRRNGDEYAERVRKKGWRSAITVGQKSDPCVGMFAKTMSFFQPMPRKELDFNVVVNANIPGLSRREKEAQEAVTLGHQRTGTRNIFISSDQSGLQELHPDTLESVGFTGQNHLHKDLQGQLSASHGQRDPKTGDLYNFNLKLGPSPTYRIFRTDAATAKTEILATIFGQDAPPAYVHSTFLTENYFVLALPSTHFGLNGIKIVWERTLLDAMVPFTKDQLTQWFVVDRRHGKGVVARFTSPAGFFFHSINAFEEIFTDGNGEERTAILADFSAYDSPDIMHSFYYDVMLNREDSFTKFWNDETRRKNSLASIRRLRFPLPAESEKVPTWTYSKTDKVETAELVLSIPNPHAGELPSINPLYATKPTRYVYSLAYRGLGTLMDCIVKTDLQTREAIIWSGSSGSQPGEPVFVPRSSDEKEGDEDDGVLLSVVLDGANERSFLLCLDARTLEELGRAEVEFAVGLGFHGVHLSEV

SEQ ID NO: 2553 - protein, 1235 aa, Unknown
  Kingdom: Fungi, Phylum: Ascomycota
MGGKSSKPAPPTVPDKDRRVQHLRDGLHTQQPAHRVASTSGLARSHTVTNNRRSLAVDLDPNGPGALILYDGTRDNRGLSTSTTHTTTATESSLASSSSGGKDKGIDIILVHGAGGGRTKTWTTDDGVCWPRDLLPRDLPANTRVITWGWKVPDHVPDSDETVTYNHLCNMVSDQLSMDLARIDGGAERDLIFVCHGVGGLIVKDALATTAVSQVFGKRSELGSIYPRTVGAIFLGTPHKGHGRQSLSELAVLCARLDSIGHKGELDPNFLQMMAEANELLETQRGEFALVSRDLPVICVREQLATHARGAEILPKHCATFDGINVTTDDFFQSHAGLARYNDRHESGYFQLVGHISKLTKRTHFQDTEAGMIRTQEIIDALHYDMREKENKANEDLKQTSAWILSAKDNDGSGAGDNVPGAFDHWLQDPSTPLFWISGNPGSGKTTLMRHAFHDPQTRKLLQRWCETGVDATTKRRDKPELLMASVFLFEAGSYVQKSREGILRGVLYQILTQKPELVSVCFPSFMEGPWPPPVPFNTTVNLSQAFYQLFARMSKTLRLCMFIDGLDEYRLAEGAQAQQDDPSARDSHNNIDENGNRTHRGYNSSSMDDLANDTSTLAVSEFGETENQSEFTSVSDRGEILGNSQWISDSHTEIARLLMDLSNQDHVKMCVASRELPPFERAFAGMPRLRVHTQTEKLISQYCADRLDKVAPGLSGSQRPLCDEVARKSKGDILWARLAIDMLMEGSLRKLMATLEALPAQLGGPHGLYMRIIQSMSPEEQREAARIFHIILRAVDPPNLVTLAFAFEGYMAPPKLHLADPTIGQLLVDHDRAHPYTREDLSAISDRMQSRLTNSCGDLLETTDKGARVVFMHLTAKEFVIRSSVWKQAQLPVPSPVEVDVSLISGTIRYLKCYSTLRLVVTSRPRLQFTPNAWLLVSHVLRYAARVDERVINGGSDECSAETYVALMDDLDNTFQEAWQTAIKEHVPARDDVSWYRDKYRPLLASHWADFEPMELGPSPRRQGFLSLALQANLYGYVSYKVRQIADDIERATVCMDLLEYAVAPEGDGRTTDGGQSLSAAGAVTGTYKDFHHDMPDGRFAPLLIDTVMECDTTGADLTAQQRFVWTQALKAGRPFFQQRGGRAAVLNLTPESMTTLARNRGRWVAAIKALLSTGWADPHMQIQDTSNDRIGGDMKSAADMIKETLEGEVEFARELIMLEALIVNVSVRSPRAI

SEQ ID NO: 2554 - protein, 321 aa, Unknown
  Kingdom: Fungi, Phylum: Ascomycota
MSHQRYASHDPVKEPHSISLKVLRLSRPSLVTQHPIASPLSPPNSYEPSLPASLAYEPSAADTNSGSFLLSPVLNFPVSFGSAYVGETFSCTLCANNDLNTPDPSATPSKKIRDVRIEAEMKTPGTGAVQKLETSGAGTMDGGQDLDPGQTLQGVVKFDLKEEGNHVLAVTVSYYEATETSGRTRTFRKLYQFICKSSLIVRTKIGPLRRPGTSDTTGPRCWVLEAQLENCSEVPMELEKVVMDVEDGLRYRDCNWDEEKPVLHPGEVEQVCFVVHETGEGSLEASADGKLVFGVLGIGWRGEMGSRGYLSTGKLGTRALR

SEQ ID NO: 2555 - protein, 592 aa, Unknown
  Kingdom: Fungi, Phylum: Ascomycota
MNRHPKPVPRRKDDRIILQFDYDCFYAQVHENKNLSLKSLPLGIRQKNILATCNYHARRRGVRKLMLVSEARRICPDLVIVLGEDLTAFRDVSKTLFGFLRSFSWNGKAERLGFDEVFLDVTDIIQYNISCLNLSSLNKHFFQLSRTDPMSGFTCDLTSIAGCTIVPSDTTTDRPDLLDNSLYLRLLLASHLAFYLRQRLEEDFGYTSTCGISTNKVLSKLSGSKNKPRNQTTLLALGEHDAASFIGEHQLRQIPGVGHKMAQVLENHVTGQHVDVDSHTFESRVTAKAAREHSDVSPATIETLLAGPGSEKGVGSRIWALLHGVDYTDVKEASEVPSQISIEDTYKGLETLAEITQELHKLSYSLLRRLRVDLLANELDANVESGDDAQKWIARPKTLRLTIRSWPAAGKSESLNYSNRISRSAPLPGFMFDLKMDMESIADRLVTEALLPLLRRLQSEKGQKWNLQLINICAANMVVGAAEDKSGAGRDIANMFRTQDEVLRPWRVETGRRSGGEGEGHASETAEEEAEQEETWAADENPTCEQCGHSVPSFAWSAHVRFHSLENAEDPDESLAKRDEEKMPTSNKKHSI

SEQ ID NO: 2556 - protein, 594 aa, Unknown
  Kingdom: Fungi, Phylum: Ascomycota
MPVISGLLSSRANTADPDQELIGFKDDPDGRGTIGLVWSCLLTLALCVWSALHLNIPPKYDTPVRQWSRMLRWVFLGILAPELVLWAAWRQWQSAKILTVRVQQILREQDEQQQQQETVSADEQDQDDKLRRQSTAKTGRKYEWTRLHSFYACMGGLVFDMAESTDDGIDHIPRYRLVTLSAHATILLARCGHLPDIDPDYIKDKSKADSLAKVIVLLQATWFLIQAIARLVFHLPVSLLEVNTIGHVLCALVMYLLWWHKPREVREPTVLHGDWVKPLCAFMFMSSRISGIQYQSMIRQHPSAWVFPELENLTYVAPESPAPPAPGASTSSEKKTDEINDYPRSSTTAIQDHARRTDTASSLADHGADSDWGGFRPEIRRQDTAHTLARKRKLGWGLNETAAELQAKRLERHTLCAQAFQTYPAVREYFTRKGPESAEYVPRLEQFLLPIATNWPGDYLLEPNTKSVVGIVLWFVSIMYGSVHLAAWKEYFPTDAERLIWHMSAGYIAASGVYWCIAHVLFYLWPWLADWWGRFVHLKNHWLQYVVYGFLMGCAGTLYILTRAYLTIEGLVSLRSVPKSMYETVEWEDYIPHF

SEQ ID NO: 2557 - protein, 342 aa, Unknown
  Kingdom: Fungi, Phylum: Ascomycota
MSSTNTNSWLRAQRKSDLVEIADDVGLKNYESYKKSELEAALDEYLGENSSKFSSRSSLTGYFNSRSKALGSPVKKELNAAKDEADKALKVVKRKASKAIEEATPDADTSTATVVRTPGRSLSQVAARIPLPATPADVANAVDRSTLALRQRANSIYQDSGISDVTQATRDSLSTVSSVLAVVSAWELFCVRYQILPGRYAFTIPAVSFLGTSDWAIKLPDAFLLVTASFWSPFLTWALTSLIIPGVVGYFFNLSATNNQGPRTRAKAAAQAAEYNVDPLTFSIVKALISFVVYGQGVTFGGLLSTESIARLESSVYGGYKGVLTGTAVTALMAIYDAVLKK

SEQ ID NO: 2558 - protein, 371 aa, Unknown
  Kingdom: Fungi, Phylum: Ascomycota
MTLDSAHQQRFGPQMGFDYSAASQPPAFSNPWSSSSPPQPHGTGSSALMMGSHHQQLPAPQQPHPSHHPQSSALSANLLAAKAQSQTPRPNTTAAPPSMTPYGSLPVPTSTDLLNLNRMQTSSAAYPDTTYASSASPVGGQFAPSSAPGYDALGYAPAPVRSAGYSMDADPTRRFSHSSVQDERKGFADALDASHGMLAMSQETPRNIYGGARSDRSSVDSYGFPSTHSTSSSISSSTFSSYYGGGDSVSDYSTAGSDYESVNSRTLPRPQGLMGGAAQIPPAPQTMMGQFSSKVSSSTQKKHKCKVCDKRFTRPSSLQTHMYSHTGEKPFACEVEGCGRHFSVVSNLRRHRKVHRGDAVSEVGSEDHHSD

SEQ ID NO: 2559 - protein, 101 aa, Unknown
  Kingdom: Fungi, Phylum: Ascomycota
MSFVTRRALSTLIPPKVASPKAIGAAPDALRMQRVVGFYEKLPRGAAPEVQAKGLLGRYQAKHMGKNSTAKPIIQVLAFFIAVGYAQNYYFHLRHHKNNAH

SEQ ID NO: 2560 - protein, 459 aa, Unknown
  Kingdom: Fungi, Phylum: Ascomycota
MKIQALIALMATIIPMAQAREVFAHYMAGDIDASSAETDVKAAAAIGFDAFAINLNADALNSNWAERCTDRLFTAAKNNGFKCFISMDLDNANDATRDQFWTYLNKYMAHDAYYKVEDGRPLLSTFSLGSTNPSNWPLFLKDLNNGNGVYFLPGPDNREGYYAYNQPAGSKAFWDSWAPVVDGVFSWETAWTKDGKNNVSTSDWDEPHAAEAHRRDLSYMVPMSSLQYKHWTEGNRNDNWYRVGEVNLPERMTQVLGMEPKADFAEVITWNDSGESHYIGTVHKDGQIPAFAEYANEETYSHVAWQPLFRSFNDAFKRGVDARGMKPMEQGKDYVGAMWYRSVTTNANCRDRPSGAIDAKDALNWAVIVAEGKNNAYIQAYSNGVKILPTGNNASVKLHAGLNYGSIPGLRTGNQYIEIVEIDDLENGEWKYVHRKTGKVSVTNSGGLCNYNYLVYGLE

SEQ ID NO: 2561 - protein, 276 aa, Unknown
  Kingdom: Fungi, Phylum: Ascomycota
MYELFLTAFVEDADLSAACAVLSGLCGMPAWESLSRVLYFQGVGRPSGISNQSSIDRPIRKEAGLLWKDLHQSLSRQSFVLQTRYEVVKDRDMGPQAQPSDLDGTAGVLRWTDFPDAPHGRPIVVQRKKVEIWEQKKLPSILRDNNYQFKTETVERMLRFFRDELEFTLTRHYFTHPIQAYQPLNTKPQPTVPLSTLPAWEDLTPMDSQRRWVLQVKTHVLQDTRPDEVRRGHEALAAVQNELEGVFKFEVIDRKVHDTRAILPSARQDPAMMRKK

SEQ ID NO: 2562 - protein, 304 aa, Unknown
  Kingdom: Fungi, Phylum: Ascomycota
MSAGPSVIRKSGVNRSNLELVNSLRDNFSAAQQDYAPPTNGTTTSNGTTNGNGVRPHNTPVEIWTERCGDALFVPRVNWQSGGLREEHSEYEITVKLFLLPDSPVAEREQYARDALALVRKELGIEAIDLLLISFPGISFEGTCEWEADKRNAEQGNIEEEIATWRVLEDLHDQGLAKRLGVAEFGSEKLGAFIKRTRISPVVDQINLKDCCSVPPPLKALAAKEGVELNVHTDCTDILPCGTIRELLSHGPRGAGVLADPEHGGAGLEGEITPHWVVRYMAFVRDRGVIENKGYFAGAEIGCR

SEQ ID NO: 2563 - protein, 364 aa, Unknown
  Kingdom: Fungi, Phylum: Ascomycota
MKGLILVGGFGTRLRPLTLTLPKPLVEFANKPMIVHQIEALVKAGVKDIVLAVNYRPEIMEKFLEEYEEKYGINIEFSVETEPLDTAGPLKLAEKILAKDDSPFFVLNSDVICDYPFAELLDFHRSHGNEGTIVVTKVEEPSKYGVVVHQHNHPSRIDRFVEKPVEFVGNRINAGLYIFNTSVLKRIELRPTSIEKETFPAMVRDNELHSFDLDGFWMDVGQPKDFLSGTCLYLSSLTKKGSKELTPSSEPYVHGGNVLIDPSAKIGKNCRIGPNVTIGPNVVIGDGVRLQRCVLLRGSKVKDHAWVKSTIVGWNSTVGRWARLENVTVLGDDVTIGDEIYVNGGSVLPHKSIKANVDVPAIIM

SEQ ID NO: 2564 - protein, 479 aa, Unknown
  Kingdom: Fungi, Phylum: Ascomycota
MEGPAVKRVAVIGAGPSGAIAVDALAQEQAFDLIRVFERREGPGGCWIGDNGPSPTVTDLDSLAKRTADPPVAIPSNLPASTPKLDQPRFTESSIYPYLETNVNDLSMQFSQEPIPSDRSQHSIGLYGDQTPFRHWQVMRRYIASLLERNGYEDLVSYNTTVELVEKVGKEWKVVLRKEGKGSDYWWVEWFDAVVVANGHYAVPYIPAIEGLDAFEKSRPGSVLHSKDFRGRDNFKGRRVVVVGASVSAADIAFDLTKTASSPVHAVVIGHTANGYFGDVAFYHPNITRHPSIAKVSGRTVHFADNTSVEGVDHIIFGTGYSWSLPFLPQVPVRNNRVPGLYQHVVWRDDPTLTFVGAVGAGLTFKIFEWQAVYAARILAGRGTLPFTQEMAKWEEDRIAVRGDGPKFSLIFPDFEDYFETIRQLAGEPTDGKGRPLPKFKREWFRAFMDGHEKRKDMWRRLIEQAKQNQTQAPIQAKL

SEQ ID NO: 2565 - protein, 871 aa, Unknown
  Kingdom: Fungi, Phylum: Ascomycota
MSRIPVSELSSYLLRGRLSRSHCLLARYRPRTSVQTLLSRPAQQPVRCLHAANVAPTAESPKAKHVPLGKQLKDASKHAKKKGKNKSKSDSQTVDGWELTVGIEIHAQLNTARKLFSPAATSFNDEPNSHVALFDVAMPGSQPDFQRETLIPALRAALALNCDIQTVSRFDRKHYFWWDQPSGYQITQYYEPFAKNGHITLLARDGISPQDGESVTVGIKQVQLEQDTAKTLAQADGEHWLDFNRVGVPLIEIITEPEMHHPRTAAVFVRKMQLLLNAVDACVSGMETGGLRADVNVSVRRSDDATMKLGTRTEIKNLSTIKSIEDAIIAERDRQIRELESGGVVLGETRGFAVGSTKTRRLRGKEGEVDYRYMPDPDIKPLIIGNDLVEHLRSSLAVLPDTEMDSLISRHGLTAKDASSLLNLDNGARVQYFYKVVDHLKELIASTGNQSKTDLDRCSELAANWAIHELGRLTTAKAGPLASGELTFTQEGDCAQVPHVQLAQLLSHLQRKQITGRVAKELLLGIYLGELDQDVSSTINDHDLWFKEISLEEYEALADEVMQGEDKVLKEFARYTTFPQGKLMYLVGKLMRTGSTERIDPATAEAVLRTKVDQLPSSSANNNEEAFWAASERSQLFPLSTPKAASEDPDLSKTRLSTTRTTEHQAGASTDVSHTVNPSEGTVTSLGTYQTTSAESENTAAAPTLPTHTGVTSIRGSQAAHGGPLSSGETAAIVVSSFLAFSLCGILGWFRWRHVQKRRAKAEADLDFSCLEPYQHDGLPKADARAHSTTRPRTPSPTLPNIHCGQGHWGFNCEAPARSYTRPNLRGDGFRAGDPTIVELPGDYPQGYLDPDSRVADANTSDVYRRGQGRR

SEQ ID NO: 2566 - protein, 984 aa, Unknown
  Kingdom: Fungi, Phylum: Ascomycota
MAHRFAAKEGVDLAALSPKDANAQRPHKAAELKTKTAAQLKAAKDKEHPPPPPAEVIEPSSSDRPDGAVYQVGKLLGKGGFAICYGGQLLPSKQRFALKIVKSRMPPKMEQKFQTELQIHSKMRQKNIVQFFRAFAFESSTFLVLELCPNGSLMDMVKRRKGLTEPEVRFYTVQIAGAIKYMHRKGIIHRDLKMGNIFLDSRMNAKIGDFGLAALSLTGKDVQTIRRTTLCGTPNYIAPEILEKGKKGHDHMVDIWSLGIIVFAMLTSKPPFQSSTTDEIYRRARERDYEWPEVDAMKRPISDEAKDLVSTMLTEADLRPEPDTVVQHSFFTSGYMPVEADMSTKLREFTPYQDEFYMDASELDQSQTFGNHKSMCRECGVGPWTAVKVVHSQVWKEMAKEENAGLTPSIPLARGVVYRPFDERSQEEQQIKPRLLASMAALSISNSEEPATGSTATASTGLLRQPPQSFAAQQRAQGRPSVTSSSAKPRTALPTESAPITSGSLRGRPRKEIGTSKEAPEGFRSLRGPSRPVLPSSRSAPVLPASEKVVANSSAPLSAPPKQRSDVLPPASLFSSAERPTQISGSKPDDVLERLRRLQTELERALNSRSMAIISSKTTTPPHPHIVVKWVDYTNKFGLGYILNDGSVGCVLRDITTKTDSGSAAQLPPAGVFIRGAERHILRRQDARYADRHQPVPMTRPIKFFENNGEAGLAQAAVSPEHFRVPINEDGSAGKLNPGKDSYQHRKRERIILWKKFANYMIAYGRDEAVPTEEEAAKAMGPGQENAQAELVTFYQRFGDVGCWVYCDGHLQFNFPDHTKIVLDSTGTWCHFWHLPQDAAERLASTGTIGAAALDDRAMLSYPLQTLLNFQTKSTARSAASRRRPEIDPELQGIPAANDFRRKIDFIKNVIKEWVSNGGIGNSNMSRETRLRWLGYRETVNATIPQKHVWVTIGARWGDQRLTALVDPRTPWELGEDADAGVKK

SEQ ID NO: 2567 - protein, 402 aa, Unknown
  Kingdom: Fungi, Phylum: Ascomycota
MAHPKVAKALEEAKKLVASLEAYEDYPASHQSIMKQVDKVRTELQEPMNVITGLFESLSLGGAFHTILGIRAYHAMPEDGNPITAEELAKVTNVATTVIHRIYRVCITHGVFIETAPDTYAHNDFSRALNPLGLGSFFMITLEFTRAWIHLPEYLKSHKPDDVFDLLKSPAVYSVQKEHLGKTYYQLLDEDPDPERRAVWDANMYMVDQLMPVTGMFPFASLQEQVTKEPERPYLVDIGAGRGQSCFAIQKDINGAFDGKFILQDLPSVIKSLKQEDYPGIEHMAYDAFTPQPVKNAHIYFMRRFLHDFYTPVCIEFVKNTASAMGPDSRLIICDQLIPDTVEVHEHYDLYWLDFALLCMSGQEKKKAEFEEIFDVAGLELVNIYPSAYGKTVMLEARLKQQ

SEQ ID NO: 2568 - protein, 291 aa, Unknown
  Kingdom: Fungi, Phylum: Ascomycota
MGELKLSLGWRGLDFSFRWTSQANSSSQLSSEMTTGSCATEPHFPQFSKLPPEIRLEIWKLVLPDTRVFRIRSPMQSHMAPVLMEYNHRPPSALKTCHESRQVALKIGKFLFGPRSSSSTGGLWFNPAKDILFFPSHPKEWEDKDQYYDSFEILESLRRNDIWIDHVRNVAVDRHAGNNWYELARILGQYMEQCTTLFITMDHSSPGSRRNVTPYIMKDDDHLSPIEGAGAEHTSADAGWGLFDVGCPPPCTCDVLTDYIKYWYQERGNVLITEVRGLELFETQLLEEKRS

SEQ ID NO: 2569 - protein, 771 aa, Unknown
  Kingdom: Fungi, Phylum: Ascomycota
MKWATASSILCGLLQRVSAHGTGLMGYGQAWYDPPCAYACRAVIGMAPLDCPGMGMNHGGGHDMHGAAPMAPCIASNLDFLATLAWCLNERCPNTGVSPAKLEAYWANQATGNPAVLPDWTYGAVLAKMEQAPNKTYIAGDTLNYTATISDEDYEYQYKFNVFFDWTEKIQSTYIIVIISIGVAVPVLLSAFSKLPFFPRAFDHLKPYLTYPASFGTHNLRPLPHLLGNVPTRGEGLYIAMFILLNIILGSISYRNFEFVHPWGFNKQNELLTYVGYRTGHMSFALFPLTVLFSSRNNFLLWMTNWSHSTFIVLHRWVARVCAAHAIVHSITLLAAYESTGVYDTDVHKPYWIWGIIGTLCLVILLFQSVLWFRRKSYEVFLILHIVLAIFTIVGCWYHIYYWKPLTGTYEIWLYMVAAVWFFDRLARVARMVKSGICRAEVVELSPELVRVDIRGVRWSSEPGCHAYVCFPTLRRLRPWENHPFSIVHTSALQPQHPYVDGLERSQNIGLHSDSPQLEEAKRPTTTIISKPMLTDRVSIFVRKHSGLTSELQKANNLAVLLDGPYRNNTNSEVLKCDRILLIGGGIGITGLISWVGQHTNIKLAWSIKESARPLLDDLTPALAAVEDKIVVVGERLDIEALLTHEAQSGWKRIGVVVCGPAGLCDDLISVLKPRTDEQEAMGKQEEEQVRGWGFDRVFEWSDPPNTHYPPHRHAGLTTHLLLRGDMTIWYPNEESREKLTFSAGARVDVDAGRVHEVWIGQGGCTMIIGE

SEQ ID NO: 2570 - protein, 371 aa, Unknown
  Kingdom: Fungi, Phylum: Ascomycota
MKASALFVGAIAQVASAHYFFDTTVRGGVADRQWQYVREFTRPTAYNPIKFSSNPAADIRDNSFIDGEDARCNQGAFTNAGKTEVLTVKAGSDVTVKLGVGATMQHPGPSLAYLSRAPNDDVKTYDGSGEWFKIFQEGVCNQGGDFTTDAWCSWDKNTITATIPKDTPNGQYLFRAEHIANKSQGIHRSHVNQPEHFVSCVQIEVTDGGSGVPSDTVEFPGAYKDTDDYANFSIYGGFKDFPFPGPAVWSGGGSSSNEGTETDNSSPPTPSTTEAAEAVEPTTPSTPELEEPVEEPVEVPSDYPAPPAETPAPPAETPVVPTPSSPPAAIPVAPAKPTATSTAPQLPCPGRPKRSLRRRSRKAHRRAHRTF

SEQ ID NO: 2571 - protein, 365 aa, Unknown
  Kingdom: Fungi, Phylum: Ascomycota
MSARDNEHAVPLMSQEERDEGKPEPFDLEANDSAEPPKAQNLDHEYSIPATIKFAWLGTYFVFSLALTLHNKFVLGSFHFPWLLTFLHTAFAAFGTGVMMQLGYFKMSRLGRRENLSLVAFSALFTANIAVSNLSLAMVSVPFYQTMRMLTPMFTIILYRIWYNRGYSAMTYASLLPLVVGAAMTTVGDGEMKFTDAGFLLTIFGVVLAAIKTVVTNRFMTGSLALPPVEFLMRMSPLAALQALACATVTGEVTGFMKHMASEEVSLIPTALTLGSNGFLAFLLNIASFNTNKLAGALTMTVCGNLKQIMTVALGIVIFNVHIDFLNGLGMLVTLAGAGLFSKAELDNKKKKATAAYKPVNQNPQ

SEQ ID NO: 2572 - protein, 574 aa, Unknown
  Kingdom: Fungi, Phylum: Ascomycota
MKYVLVSGGVISGVGKGIIASSVGLLLKTTGLTVTYLKIDPYLNQDAGTMNPVEHGEVYVTDDGGEMDLDIGSSSRFLATTLTRDHNITTGKIYQQVLDQERRGDFLGKTVQVVPHITNAIQDWIQRVAKVPADDSGRQPDICVVELGGTVGDIESAPFIHAISQLQRRAGKGNFVQIHVSYVPMIPPGPGGEQKTKPTQRAVSDTRSAGLIPDLIACRCEQPLFDATIKKVADMCQVETNQVIAVHDVSTTYHVPMLLEKQNVLQTISGLLDLNSYERSPALVDQGKEMWKQWVGLAQGSVHALDTVNVALVGKYVSLKDAYMSVSKSLEHAAMHCRKQVNIIWVDAGNLEDETLQDEPVKFHKAWHDVCTADAILVPGAFGERGTEGMIKAITWARTKKIPFLGVCMGMQLAVIEYARNVAGVEDAGSEELKPQGKNHAIVYMPEIDKTKLGGTMRLGKHACVFQEGTEWSKLRGLYGDAPQIYERHRHRYEVNPEMISTLESAGLTFVGKDTKGERMEIVEIKDHPWFVGVQFHPEYLSRVLAPSKTFLGFFAAAAGCLEEVTRGFNEQSA

SEQ ID NO: 2573 - protein, 139 aa, Unknown; identical to SEQ ID NO: 719
  Kingdom: Fungi, Phylum: Ascomycota

SEQ ID NO: 2574 - protein, 1591 aa, Unknown
  Kingdom: Fungi, Phylum: Ascomycota
MPSATTKRPLRVAGASGGFTDRQRAMHDLAKDNKVDVIVGAKTTFAQDPNADRAPALFDPCFMSSLSPALPHLKSNNVKLAVNAGACDVELLAREAKQELDRQKLDLKVAWIEGDEVFNQVKELRKNGEKFANLDTGKDLDDWGYDPIYTQCYLGGMGIAEALRAGADIVICGRVADAAPTIGAAAWASHRVLIVRLRWLLCRFKDLMDGCENVGFPIAAIEANGETVLTKEINSGGEMSVGTITTKLLYEIQRPLYYNSDVTADISDIKFEQHGKDEVRMTGVKGMPPPPTTKVGLIAKGGLQAEFHYLFCGLDIKEKAEWTERQIRYSMRDHIHKFSLAKFQLVGRCPTDPEDQDAATVDFRIFVQTKDPSILGREFTRWCMENFLQSCPGASIVPDQRQSAPKCIYEYWVALLPQEVVKHQACLEWNGERIDVAAPKDALDLTTNKFFGPTTRGPTTRGPLGWVVLGRSGDKASDANVGLFVRHEDEWDWLRSLLSSDRLKQLLGPKEYTGNRVERCEFPGLRAVHFILKDHLDRGFNSSSSLDGVGKNLCEYLRCKPVDIPVKFLARGKLTLVFDDDSHDIFYSSVLTKLNQHLGISKAYFRTIGYHSTRPSYHLVSPAGNQNRRPVHPRRLLSIAEKAEKLLRAWLTTQIQSPPLFESRPASRLNFSSSPTTEHTERRAKTFSLVSRENTNGNTVHRPTMPADGTEQQQPQAVDESNATGNAATAATTAEQQKERQRVTKACDHCNQIRTKCDGVSPCSRCIAYQVACTFDRKSRRNGRKKRRATPPLLGRHPWPRAATSASSDPDMSAVGGPIEGRDDEDDTGAAHPGQQIAGDGSQGTLPTGLVSSRPLLNIPVPQPPAEPGQRSGFETFNGYEQQLFGHLDGSGVSSLPPYFDEYVGPAWQGFPNEAHAAYPEKTLFGGQTPALSGGRYYPPGIARGELGGSSGLRSRTPRSERSGAQTLKEPIELEYPVISPLLPFCSHQISPALACKLLEGYFSTFSDHDAYASSPFILSHVLRKQSFLSPTSFRDCKPALLSSMLLVAAQTVEMPFFGSAPTARHRLCQGLFEITVALLSSNPPSQRYPHGATPGEKVAMAQERRLVGSSQSLSVLSATRTIDDVIAFMHLAVISSAAESKSIGSHWWHTAVQLAKELKLNLELPSPPTREPRPANQGESRPAADGPFGAALPPHGQAPRVNQAGPTSGTEADRTSPIGMVDDTVTEGDSAANAHAGLEDQEERRRTWWCLYVLDRHMAICYNSPLALRDTDCQDLQWPLDDASWQAGAYWANTRQGAQQADVHGPLPPTGPPLQDLPKGPSAECVGPGIFGLFIPFAFILGQIIDARHLMSQPHYRTPRAKEIVNIFQQEINEQLETFRSTLDQLAVPARGREWDTPGPSSMGAPLTEMAPTRLRYQRLMVTYGHYFYHILGVLLHSEWDLLTALSEHMSAMDTQTPASAHDSVVLSCATQAAEALQNVLSQDHELKFNPFLMGIFLVQGSYPLLVAASKDMQRASTQVLKACKITVRAHEASVATLHAEYQRKNRKLLLSAIEGIQYGPSAINREMTSLNERIIKLYRWSPGGRGLGL

SEQ ID NO: 2575 - protein, 349 aa, Unknown
  Kingdom: Fungi, Phylum: Ascomycota
MVQLAHVSSFGSSSSAQKSFEVSAAELGRLLQRLQQSTLHSDPVRERRLRTSEYERARLASNLEYARRALTSLEQDALSVKAPGRRADVQSDLNNKREALNQLFERLEDLKQVAIEDDDEDSSEGEDLFGDLDTDHSQAAISSTQTAAPAHAVPDALPVETTAAPAPTTAITTASQPPEPTRAPSPSPLTSEPTPTQITQSMRSRTSQPSPPPSYTSSRAALFANRRQAASPLASAPETSTATATAILERQRGEQEALTDSMLDLAKRLKASTASIHTELDADKEIVGKAGEGLDKTERTMESATGRMGVLRKMTEGKGWWGRMMLWGRIGVMIVVILVIMFVLPKLRF

SEQ ID NO: 2576 - protein, 934 aa, Unknown
  Kingdom: Fungi, Phylum: Ascomycota
MFGFSAGQQLANSLHLSAIDREHLAYFPQCSVVSNFASQSSMVMRMILAVSASELENRRSRDPSLSVTTTVRGNPRAGVAHYSAALREFGGLLARCRDEKQLPSQSVIDETVTAMFFMVTYEHLFCGEQTGLAAHLSGVHAFLSTCGVLDDPNIELGPNFSHVTKNILLYIMYIGINFVTLGGQRQRDSWATAKDNTLFVSLLDNLYQDTRDTNSLVYQEDYPPEALLDDIAVFQPLEFIHECVKLRYLLLPLTSGVMAKDDQSDISHLSRKLTHLGKRYNNLVRISAAEKPPRRLRELQTIYYSASEYHALQIMLHRLGCTNTDKKQPKCDKTCRVLKELVANLTAVLKRLSAIDTRTLARVCWPLAVAAEVVEDPAELLSSTNTMKSEKTSIEIGPAPTQETQTALSMSPGTMETADITAQDPSFYRSLLKSIDWHLLPLMTTSYMIQFLDKQTLAQASIMGIVQDLDLVGSQFAWAGSIFYFGYLAASYPASMLMVRFPIGKYLAVTFLVWGVILACHAATHSFVGLLLVRFFLGAAESSVSPGFSLITGMWYRREEQPLRHGIWFTGNSFAVMFGGLLAYGIAHIQHTLETWKWLFLIYAMLTIVWAVLLGFFLPDRPQTAKFLDEKQREGALERIKVNQTGFVNNTIHWDQVWEALTDYKIWLLFFFQLANNIPNGAITTFSNLVMRGFGYTTLQTYLLTMPQGATHALFAISSTYLAGKFPKARCIITAACSLISLIGCAIIYGTESKGARLFAYYIFCSFASGIPLSLSLVSSNVAGYTKKATVSAMMFIAYCAGNIIGPFLFFSREAPRYTSGFLSLIICFAAAMVLILALGFCWRLENKQRDRLQADVPERDEGGNGKEAGEQAFENDLTDGQNLSFRAKDSIIPLSSNAKNLELATLTAQMAFQAKLTVGLHLAGIAWLLRAAE

SEQ ID NO: 2577 - protein, 764 aa, Unknown
  Kingdom: Fungi, Phylum: Ascomycota
MFSEYASKFLAQSQSRLSNLGQPDHQAPPRSNDWGNSRPSRQQRDGGRGTAPNRSFLARGLAASGNPYQQNGSGSRFGNVGFASRISAAQDAPLFHSTLDEYREDDDDDERDREDLFALQRSRRVAAASKLAESADSDALSRGSLGDSREDQHYQDGGRRGIKSSWNGTRSMHKPRPARDTLLEEAEEVPSKGDEESEASQGTRGKMVDVGLESQDDPDEDPPESLLGGEAPTDSSPPAFQRFKPQAERTPFMMRRESTRETEASSIPRTSLDADGPVQTTASPIIEGEIFRHDPFFAWLFLIAFAGMLSTFVLVWLHTSPKKSPVGDTIYTTLQKSFDMLAVDTVVAVFVSFIWLAALRSFVRPLVSVILVAVPVIMLSFSIYSFASSFKGRTHGASFQDSVLRWASLIPAASCVLWLWLVIKGRRAIQQAIEILQFSSKILAQNPALLLIGFGCLAVIVLWTWAWLAMFTRVFMGGYFSKSLVRFVIRFSSWWLGAAFIFMYMWTLSVINAVHRATTAATVSQWYFHRNAGPATPSSEIVLAALHHATTAIFGSICESTLLSLLVRAPLLFLPRRMGLAIANIASFWIPTPVVAMTNPLTITYAAIHSQNLSISARGLDQMDFISPALPTTTLTPRALRLRGQGNGLMPYRLAKLLLVATRFLMATALGFAGWVITAKQLRIQLPDGMGMRGSAYAYVVGLMASFIGYSVMGAMEGILSGIVDAVLICYGSERRMERGHGRFCLEAAYLFGERRAGDVDGYV

SEQ ID NO: 2578 - protein, 663 aa, Unknown
  Kingdom: Fungi, Phylum: Ascomycota
MPVFQETSNSARDLRILPSRAPPLPRLSRKPEGPSIGNDTREVVVIGAGPSGLFLTLLLARYGIRDDSLLCLDSKPGTLKAGQADGLQPRTLEVLQSLGIASEIISEGCHMEEVAFWNPTTSSTATSGDKSSMSHGIERTSFAPDVNVPARFPFEVTIHQGRIERILQENLHLYASEETIRRSHRFLKYTADDHPEFPIVVEYEYDLADGTTEQGTVRTKYLIGADGARSCVRKSMGLELEGETTDHIWGVCDFVVDTDFPDIRKRCAVHSDAGSVMVIPREQIATGEYLTRLYVQVPGEVGQDTDPAGKEKRSADRERRGAVSLEYIFEQARKVFAPYKIEIKQGTSPDWWAAYQIGQRMAPKFSARTPDGLERVFIVGDGQGMNVSMMDSYNLAWKLVHSLHGLTPSSSAGNVDPVLETFNHERVDVARQLIEFDAKFSHMFSGQIGSTDAEASGLTHEEFLRVFSEGSGFTSGCGLRYKPSRLVTATEDAFLGKSIATNGAVPRGALVPGRRLLDVEVKRYADATTRHLHDEMPSIGRYHILILTSNDLLNKSGASQSAITSSINTIQRFAQDTIGLVVLHSLQDRFEWTDLPADLKRFAEMRVYGQARNEDAYEAYGVSKDQGLIAVVRPDGYIGTMAPLLGAKVVEAYFHGCLISNRA

SEQ ID NO: 2579 - protein, 548 aa, Unknown
  Kingdom: Fungi, Phylum: Ascomycota
MAGAADNAQDALAVELRLLTGCGHEAERCRAVASSLDGLRLVVPEANHPDMYLTIQEMQKCGRFLDGLAQESAIYQDRVPIVLDHLNVVLPSLSKSLRAIQNYWDDMSKSLVQRWRCIYHNLSREAGISLPARFSLYKSYLISLRLLLINSQDFDFNLLEADRARIMVVREASGIPAPSAPVGELVRAMALEVTEATPDRLLKAVAVIALGAAHLLLAAVFTNSTDRAEPVLGIGPFQSIRALSCAARLAYSVSPAALSAFDERQVTALFYIDAQDDCPYIVLRSYDGHHSHPRYSNKGVHELCILRIGSGLRLDRWSKSEDRSIPWAMMFFLTWEGKRPEMPRVLCGLLLVLHNEPEESPQYRLKAKDADSNAELVLTHCAFVALKCRSIRTSNVSPKEFGLAREECLFQARIDDDGFTHSLLLLRDIETQGLRLQASVFDDELRKCPIWTAFGEFALFAAFFSQGAKGTNADKLMRFLEPVTHQATSPTWLRRTGRRKFCLVDIHLYVFCDQYQQQNQRRGAAGEFEIKFMSEEPARAFERAFRSL

SEQ ID NO: 2580 - protein, 663 aa, Unknown
  Kingdom: Fungi, Phylum: Ascomycota
MAMNVSRGLLSNSPRPLLRNSTVSLQGIALLQNKVRGHASAAAALEPRGRDGPLESETPPTRRQRVKDAKPFSDFLTDTHHRQHDYLRISVTERCNLRCVYCMPEEGVELSPSGNILTTPEIAMLSSVFVSQGVTKIRLTGGEPTVRRDILPLMHQLGALRSQGLKEICITTNGLSLHRKLDSMVEAGLTGVNLSLDTLDPWQFQIMTRRKGFDAVQRSINRILEMNKLGAGVKLKINCVVMRGVNDREIIPFIEMTREKDIEIRFIEYMPFDGNKWNKQKMFSYEEMLDTIRAKYPSLSKVQDHKNDTSKTWQVPGFLGKIGFITSMTHNFCGTCNRLRITSDGNLKVCLFGNAEVSLRDILRKSNNGDPIDEQAYEAMKQIETDRRQGITDAKQALGVSSNEAELLDVIGLAVKGKKAKHAGLGTLEHMKNRPMILIDPAPPSLLHMSSRARSLLQTANLTMGGLDFSARPQQHRLFSSSSSRRSSRDDEANKVSEEGQPRLTHVTESGSAQMVSIASKSPTARTAIAACTVTFSNTTALELIRTNQNKKGDVLGVARVAGIMAAKRTADLIPLCHPLMLSKVGVELSLPDEGATGEQVIEVSARVECEGKTGVEMEALTAASVAALTVYDMCKAVDKGMVVGELRVVLKDGGKSGRWEMP

SEQ ID NO: 2581 - protein, 586 aa, Unknown
  Kingdom: Fungi, Phylum: Ascomycota
MRPLPSGPDADALPGRSSRHPSTGPTSPQMSCFITTEAALESADSQQSTHLPRVGRWPRQKRSLDFASQSLRTADSSPAPAPHSPASLSSSVLDDDMLQEPLAPMTPVLAGLSGPASAISSSSSRRNSSVASSIAGKDSHLPSTRSSPRRSPSRRPGPSPQQGAVDSPESQLIMPSLVVPPRRSFSEVGKTIGKLKILVTGAAGSDPPRCSSSSAIETFASTKPQPRWRTELELSSSMRRRHTTNGLSSTQSMRAALDYIENQVTPLLYKSMDEPDLWSLLVSGSQPAVDVVLYMVHGNDLSSNDIQALKALQTVTNVVPLLARADELDDDEFTSARSSLTAILEANDIVPFSFGGPKSSPELFAISSKTQPDTDEMDASTLMQSLYEQPLVQSDLQQLVNRIICAEGSAWLRHTAALKILKWCKEHRQAGALQLFTQPSTLPHIDFSGLRGLDAYRAAQWWQRVEVTDWAQSLRRSLDSQSYQMSSPSVALELAIGDASRSIVKCEKKSRKHRLRPVPTPTHQDPLGLLDWLAHARQGSKMTAELLSGMGIAAFVTAWLHMSDSACHREVAQLPRGFVGWWWDIV

SEQ ID NO: 2582 - protein, 277 aa, Unknown
  Kingdom: Fungi, Phylum: Ascomycota
MPQKTPANSSRRASPEQSIETLKETNAALAVDRDRYRQRNEKLQDKLYASEKNLDTAERNLRNAKEEIKRLVAELNIVAKEKDTLEKGFKQVSFEKDTITNKFIRLEASFDNLKLKYDAIPEERRNPMTTALPERPQRTATSTSASSGGSGGSSRAQHQDAERGRRRQADKDRLATRFETNKRPPLAGNNANRNSYIEGYGSRRRSGSAAAPSSRTVYDNVIHTGRFDEPLVSPRDAVAFSQVPRSMAGSGGYRSGGSSAVYDDYEEDGDYHIRPIH

SEQ ID NO: 2583 - protein, 1976 aa, Unknown
  Kingdom: Fungi, Phylum: Ascomycota
MSFGGFGGFGQNNNTQQSGSAFGGGGGFGQNNNTTSAFGQSNTGGGFGANNSSGGGLFGNNNAQQNTTSGFGSSGFGSNTNSAFGAKPAFGATTATTTTGGGLFGGGATNTASTGFGSGGGFGSTNTNTGFGGGSTSGGGLFGGSNNTNQAKPAFGASTTGGSSLFGGGNNTSTASTGFGSSGFGAAAGGNDPPGTGTTPFQAFTEKETTTNTTNSFQNIAFQDPYKKWSAEELRLADYAQGRRQGNPSGAGAFGQSSGFGAFGSNNNNTTQQTSAFGSAAKPAGGLFGSSSTPTTGTGFGQTNTGSTFGGGSTTGGGLFGNNNAAAKPAGGLFGGASNTTATTGGGLFGSSNNTTGGFGSTNTNTGTGFGASTTNTGGGLFGNNNNQQKPAGSGFSFGNTTNTATTGSAFGNTANTGSAFGSNTATNTGGGLFGNTNNQQQNTGSGLFGGNNQQQQSTGGFGGGGAFGQQNNTQQSGGLFGAKPAATGGGLFGNSTTQQNTGGGLFGNNQQQQQNTGGAFGGGNTQQSGGLFGAKPAATGGGLFGNSTTQQNTNTGGGLFGGMNNQQNQQQNTGGGLFGGMNNQNQQKSSLFGGSTQSTGGGLFGGSTQNQGGSLFGGNNNQQQQNQGLGNSLLGNSQQANNAPQGLTANLNDVSAYGSPSLFAGVGGNEVQNPGPLATSLNSSSKPRRGSILPMYKLNPASASRFNTPQKRGFGFSYSNYGTPGASPASSISSTPGNANLGRSLLGATNSSSGLSKSMSTNNLRRTYNAEDTILNPGAFSSSSGARWYGSTGSKKLVINRDIRSDLFSTPQKDKAAIDSNPGSRKLAKKVSFDTANVETEEGSTPVRAALPAPEDPQEETPRQTRPANNGANGSRTPEVEQTKNSELGVVHEEENTATPEGNSTTGFDNAPGRYWMSPTMEDLQNMNRVQRQKIDHFTVGRDNVGSIEFKIPVDMSSIDLDEICGGIIQLEPRSATVYPIAAKKPPVGKGLNVPARITLEQSWPRGVRDRRASTDQKRFTKHVDRLKRITDTTFESYDKDTGVWIFSVEHFTTYGLDDSDDDDDLEPMDASTTDLPIVNPYQAAFEASDDSSVRDDTFDFRRPRGVPGAFDGQDEMYEVEQPMQQSFLGVSSADSAPRDVRLALEDDDLDQGEEYDMSDDEEMARSSVGQHLAAEHDDVSSEGGQVVKMGTPGGILRARMRAMKDSAGPVKLEVADGDDWAEMLRKTVSPMKRDRQQLREYNDSPARQPRFNDAEGEEVDDRKTSIWRKSVAQPNKMGGMAASTRFAAADKGRGFATSIDLMNSLFEKPKPAMAQSMRASTSSKGFPKWPYDRQDKTLTMDEQEQAFHDASRPTWGPSETLVLTTGASQRMGQTNRDGAGVLAFQRPHVQTDRQSVQLANFSTQPSKKYLRAQDQFTKISKVNDVPVASLEVSNIKDIFHNEDPNDTAVIQEKRVWELASILFGPVDLIAEDEDPSQARRKALSNYWADLVRESSSKNTGLAASSEEKAVACLAGHRVAEACKYLLDSKNFRLGTLVALIGSSDAVKKDMREQLKVWRDSKMLSEFSESIRTIYELLSGNVGVCEGMKGVPTEDRIESFVISNKFGLDWKQAFGLRLWYATGKQDDLSAAVRKFKNDIDQERESTPRPWYIDQGIKPLWADEDESSRQDLLWGLLQLYAEDSTDLQSVLRPENSQLSPFDMRLSWQLGQALVSTGQVSYGSNATEKADATTLAYASQLTSAGEWLEAIFVILHLSDPDARAKAIKEQLCRHAVQIGPDTGANFAALTQKMQIPSGWVWEALALYMRSVKKDASAEVECLLRAGSFDEAHRVLTNEVAPRAVIERDYATLSSLISQFDGRHNTISGWSSGGEIYSLFLTMLQQRSKGENTQSSVLDRLQTGLHAMNEEVPETDLMRYAAVSDMADETAKEILKLGRKKQDSELRSKILNLPLTQDRRLAYSMDLGAKRNSEVMSH

SEQ ID NO: 2584 - protein, 423 aa, Unknown
  Kingdom: Fungi, Phylum: Ascomycota
MRVLSISALATAVAAQQMDLYSTLASDHELSTLAELLALVPEISNTLAASSNITIFAPTNAAFDSVPRNIPEGEAIEWKNDTIAIGALLSNHVFPGYFPAEAVTDVPLFAQSLLDSSFVNYRQPVGNFTGGQYNEIVKDGDKVAVISGEFTVSYVTQADIQVENSVIIHKIDKPLSFGAPLQLFTRRDGLLNFNAAVNAADLPYAFGNIGADETDKQNISDFTVFIPNDAAFEAIGSVLEGADIETLQEVLAYHLVDDVIFSTELGNVTVPSLQGNDLTVTVAEDGSAWVNGAKILFPNVLLFNGVAHIIDGVLNPSDAPFDRADLKPEAAADERLAFPDASPVSKLPFSSISYDTDSATYSTPELLKTIIAVEAMATGSATEATPTGAMSTGEPTTVAEAGSSKLVATGAAVAAFVVALFMV

SEQ ID NO: 2585 - protein, 1109 aa, Unknown
  Kingdom: Fungi, Phylum: Ascomycota
MIPRIWALLCLVMLLQQATAQSFRVIARQEDQSSVSVSATQSGDEIEPTSTNTRSNEDEDKAEETEAPSSTTSRKASSTTTSSEPTSTGIRTDGSLDDSNFINSTIPDGQLPIEPELTPGFGVAGAVMLCTGVAYTLIGIKNRWVHTFFSSAYLAALGITVLLVYIMKVPLSDALQGGYVAAVIFPACLLGGASVFFKELTEGLGCALGGFCVSMWLLCLVPGGLLKPVASKAIFNACFTIVGFAFYFSRYTRDWALILMISFAGATVSVLGIDCFSRAGLKEFWAYVWDLNENLFPLGADTYPVTKGIRVETAAIIIIFLFGIISQTKLWRIVREQKKKRAEERAAEQQDLEQQETDLGRRVEDMNARERRQWERVHGDGEVGSSLGSDNASEKRPRASVAQSFKGNSATEVIEMSDMSEPDQHRAPAPLMEERDKEGKVTIRVADDDTLPAPMHDDEMMDEKAESRRVSQSASFANKRFSDAQSITEAPQVIPLPFSVPQEDDTRSRGDRSSVATFADEEATEAPAAPARHSLAKRFSQSSGKLLRSFSQRSGISGNGVQGGHSGSSEDLVIPRIRRGGDDDGSIAATFDDSVSGDERRLSNVSDSKRRSIEITAELSDRSPKAGVASQCAGATPELNQGAFSETQSLAVPNSPVPGSEAARNDVAGTEAGESLRARSEKPKSVASAVSTPVSLTKDRLPRSLSKIALSYRTNEWAKHLSHAETPEPEQLEVAGGSRAVKSKKEEAKPVNVEELQQTAEHGIPPAANMARASSRVSMNAPATKRVSRQSSGGATEPRDSSEDPALQRMDSSHKGLLRSASNNTLRRASNFQPIAEEAPAPVRSPVIPEEAAMPDIPTTASSPSNASEPFRNTPIPGVVSYDSPQTLIGQREMFLRSRSQGNLLASPSDQSLNMTASIGRAPSETGSLYNYPAYAAAMDVDDLPLSQRKEFMRQSSMNSLTGPSMSTHRMSVGSDSRPNFDSHQPQRVSTLPTQSDREARLASFRSSVAQDLRSGTPLLPASGRETPFASTHSLLTGVGGREAEVQRNIEMQRTIMMGQREAEGQQKEMARRQKERADQAFDERMRSGDLLEAHRDAMRKMQRAAKDK

SEQ ID NO: 2586 - protein, 486 aa, Unknown
  Kingdom: Fungi, Phylum: Ascomycota
MSATSSATTSPSQTANFAALSPLTTPDPLRRSSRQRPMSHASRSRLSQYSAGSAPSRSRPVSHVFPMYPSTLPYALVRDFAYPVVHPMHYGAPPDPPSGATTPASEQRRLSDPPVSWEQKMPWDSWTADGFGRGHDIPPIQFGDGPPYSEDEDLQSPVVATRHRKHKSTSATIGLGRGAARTDESNVLHASHYDPERGYYVGTAGDGSERYYVSHGGDASGSGGEFVTYPPSEARRSRAYHYSRQPRGGEDGYRSESEHSSHPSSPGFADQDESRYSRDYQFTITSPDEEFHGKAVALFDFIRENENELPLAEGQIIWVSYRHGQGWLVAEDPKTQESGLVPEEYVRLLRDIEGGMNSLTGLAEGADDVGTPTQAEHSGQAGIPSGPITAANGYHQPVVSMFSTSSKDLNPYPTGQLGLPAGQAPPQVVHYHGQKGGSQANTPTVSQHTELGIRRGSHDSNPDATNTTPTGTLKEQEEAGEAGKEG

SEQ ID NO: 2587 - protein, 913 aa, Unknown
  Kingdom: Fungi, Phylum: Ascomycota
MSDSKLMKAAQIREYKQPYHLTKVTIPSIRPDELLIRVHAAGFCHSDVQVLNGQFSSPLPLIPSHEPAGVIVQVGTAIADKTWKVGDRVGVLNFKSACGTCTGCAVAKRRYGGLDPRFCERRETAGFQHDGAFAEYLVADPRTTVKLPDDLSFEQAAPLMCAGATVWGALEKATETMEPGAFVAIVGIGGLGHLGVQFAKSQGFRTIAIDSRPEGRSLALDVPSALTPDYTVDSTSPSSSSDVLKQTNGEGLAAAIVCTDSIEANAWTLRQLGVGGVMVALGLPPDRWQFDSDIMVFRELTIKGSYVASAESTRRMMEAVGKHGVRSHVTTVSFEEIPRVVEMYHDKTFTGRDNPVQKGDAEALLSDIGVTLDPTESPDFDHLLAAVHDCAEHISSLPDYQPSPDLKLYPREDIHLPTSSEQTLGHAWAYKFLIRGSASPPSSSSHSLKGKTVAIKDCIAVAGVPQFFGSDAFPAWTPQTDATMVTRVLDAGADVVGTATCENFCNSTSSFTSAQGTVHNPYKEGYSAGGSTSGGGALVAAGLVDVALGSDQGGSIRVPAALCGCVGFKPTHGLVPCTGMTSGDAIDDHAGPLTRTVLEAATCLDAIAGYDGIDDRSLGAAKHGSYDFTSSLLTSPQSSDSLKGFKIGVLKEGFNISIMQPEVAQLVKSAVSKFQSLGATVEEVSVPLHLEGPAAWTIQQRISGAMGVLGQAHGHRGLYLTEFEHARLPWTTENFAKLFPSTKNTVINGLYLAKKFPGLYGKTMNLARRISDAYEDVFREYDVVIMPTTPYVAPKHGVRGTPKQCFEPSIGLTSNTAVFNITGQPAMTIPVGFAPAREDASVQLPVGMEIVGGLWQEKKILRAGYAWEKAYDWKSCRSGGVATVKRVPEYASENHSKLNGTASIDVRALPVEA

SEQ ID NO: 2588 - protein, 993 aa, Unknown
  Kingdom: Fungi, Phylum: Ascomycota
MTSHSTVRIGIDVGGTNTDAVVLDTALHATSTRGVLASHKVPTTHDTAEGIRKALAAVLGKVAKPLPHFSSVTIGTTAFLNSVIQRDAQSLSRVAVLRLSKSFLRDVPPFSGWPKDLAAVIHGYVGYVDGGLNIDGSEEAPIVHEQVTQQCEKIRSLGINSVVVAGVYSPIDVDHHQENTVRQLILQNLPRAQVVCSHEVANIGFLERENAAILNAAILRYARRTIRAFHRAIDELGLRSCPLYLTQNDGTLLDAHVATNLPIRTFASGVTNSMRGAAYLSGQGVGDEAAVVVDIGGTTTDVGVLLPSGLPRQASAYVSVAGIKVNYSMPHVHSIGLGGGSIITHGGQSHAQVGPESVGHEIHQSLVFGGDTCTAMDISVALGQAGRIGNPELVKDLDPTLVRTSRTRIQDLLEKAIDSVKTSPEPIRVFMTGGGSVIAPDTINGVSEVIKPPFYDVCNAVGAACSKVGATFDLIQSTADKSQLEIGEDAKVIAIKRAVEAGAVRETVVITKIDMIPIPYLENQIRVIVGAMGDLDLARVQGQETADDNTWEILDDEADSHQQGLPTAVQYNLVEESIDRHSYRPRITSDPITNRKEWLLSTTDLDYLADGCYVLGCAGGGNPDAGKMQLKNMVEAGHTIRVIDPSSIDESATVYWGGRMGTPAAIAERLQAHETVDAMRALMDHLSQESFGAVMGLEIGGSNGLEALLCGSSRFFDRPVLDADFMGRANPMCWQLTLTVHRPGEFVPCAIDSGDGQTVLMTRAKSDESVDKPLRGALVEMGSLVGLAGKPTTVGIVRQCAVRNTVSLAWRIGRAIALAEADVSISQAADRIISEVGGPESAKVLFHGKITAVERTLHKGHSVGVLHIAHASIDEGNSSGATKDVATGGTLRIPFINENILAEHHDDNGTVQVLATVPDLIALLDSQTGRAVGVPEYKYGCHVTVLGIPCSPRWTETPRGLEVGGSQGYGYDLPYQPIGKYVEPRSVIEEFGR

SEQ ID NO: 2589 - protein, 533 aa, Unknown
  Kingdom: Fungi, Phylum: Ascomycota
MASATPNEPADPLAKGILPTIKQSWKDLFIWKQRVVVSNAYGETRCEWKQPDSFINPFTLFAQLSWRDWLFFLVGLAAWTADAFDFHALSIQTKKLADYYGRSKTDITTAITLTLLLRSVGAAIFGVLGDKYGRKWPMVGNMIVLGLLQIATIYSETFQQFLAVRALFGLFMGGVYGNAIGMALEHCPENARGLMSGILQQGYSLGYVLAGCANLAAGGETDSWKSVFWAGAGLSIGVGLIRILFPESKQFLEARASGKKSASASEFWKETRVMLRSEWKMCIYCIILMTWFNYYSHTSQDSYTTFMLTQKELDNPGASRASIIMKTGACVGGTIIGYCSQFVGRRRAIVASALISGLLIPAWILPETEPALSATGFFMQFFVQGAWGVIPIHLNELSPPAWRSSFVGITYQLGNMISSPSAQIVNAIAEKTFIRIPNGDSVEAYGPVMGIATAIIATGIVVTTAMGPERRGRAFDHAVLGVQNESTGKIVDEPMDEEKAATIGDHVEGRGNGNVAPTNGHTNGTTDATREKI

SEQ ID NO: 2590 - protein, 251 aa, Unknown
  Kingdom: Fungi, Phylum: Ascomycota
MAASKVFIVTGASKGVGAAVTQHLLDLSHKVVITARSAEPLEAFKKANPGRVEVIAGDITSPELAQNLTKTAISAFGRLDGMVINHSVLEPVRMSDETAESLKKIYDVNVFSCFAVAQAGLSELRKTKGAIAWVSSGAATKAYVAWGAYGSSKAAVNSISAHFASENPEITSVAIQPGRVDTDMQAQIRAKGGASMDKDQYQNFKDVHEEGGLLKPSQPGNVLAKFVADPLHELSGEFLAWNAESLAKYQS

SEQ ID NO: 2591 - protein, 688 aa, Unknown
  Kingdom: Fungi, Phylum: Ascomycota
MASLSSAPQPSEGKKRQRVSIACLTCRGKHIRCDGVQPICGFCQAKSTPCNFAHYENKRRPPSKKLVESLQARIRNLEEQLQAATAVAPVSPHNPVFFSDDSDEEEEESLDEGGKPDSGNDDPLSELTGLVGRLNMTDDGQVHYFGSQSSYHLVKRSLSDADPGQESLRMQTLGLGAASQLKRHVTVSPELQEHLLHLYWQWQNPWNYIVHKEAFMTSFRGEDDGRNCSPLLLSCIFAMAARYSDHVELRTISNDLDTAGDAFCEQAKILMLFESEAPTITTVQASCILALRIMSAGKEALGWLYAGNATRMAHNLGLHLDVSELRGGANMTEQESEVRRVTWWGCYVVDKLFSVGLGRPSSTPKSSITCPKPRTNGGAEYAPWFPPPMTSHDQNPPMGINSHIASNACHLSDIMTIACEAMDAIYSPSSKLSSHEMEKIVTKADVELRSHFAGLPSYLRPPASLRTPMLPHVCLLQPLVWNRRKSRRACVDSSQGDENEDNTTNNTHMKSCRHSAAEITRLLRFYKQQYTLRRIPIAAVHLCFAASIIHLIDARPTSPNQHQAVLHLQTCVEILQDLRVAWSTWSDRATRAVQLLASEWYGVSDLTQLQKRKSSNKEVVERGKRNEGHLDVDGLDLITGASFGNGLDPGLEGEDGPDSFVYYTSTTGHFMDDMLKGWLDESMFSFGS

SEQ ID NO: 2592 - protein, 129 aa, Unknown
  Kingdom: Fungi, Phylum: Ascomycota
MLSQLSRASRARSAVAAASRAAKANGVQVRSFIAPTVSRRADFVQELYLKELKSYKIPAVKESDSVGQVQTFSAPSTPKSPEEGDLAGSLKEYETMAVEIEGQDASAQTSGAPAALPDWLETEEEEAHH

SEQ ID NO: 2593 - protein, 448 aa, Unknown
  Kingdom: Fungi, Phylum: Ascomycota
MADANVPDSTDWLSTPLSALAAVEASLRCQVCKDFYRTPMLTSCSHTFCSLCIRRALSNDGKCPLCRAGEQELKLRSNWSMEETVEAFVKARPDVLKEARRRGSSSAASPKRKASASEAVDGDVGAPTNKRVRVSARLSRSRAEARASQPVEPEEEEEVIEVPDDTIEDETYTPENNDGLVACPVCNNKMKEWQVFKHLESCTGPPEPTTNGHSPSTHSSSNFRKPSTNAPERLPAINYSMLKDNAFRKKLAEIGISNSGPRSLLEKRHKEWITLWNANCDAAKPKSRNQLLRDLDTWEKTQGGRAPTSGRMAQSAALIKDKDFDGKAWASTHDDSFRELIENARRSRVKPGSGEAKKEGADEQQKQDEAPGEPIQEVPSSSAEDGDVALGGNGIPLQEAIYRAYEPPGRRMNEAAGSDMLAEDLLAAREEQDRDHERAMFLHSMGAP

SEQ ID NO: 2594 - protein, 585 aa, Unknown
  Kingdom: Fungi, Phylum: Ascomycota
MDVHLLVYDLSRGLAKQMSMGILGFQLDAIYHTSIQLQGREYVYDGGIVSIVPGSSHLGQPMETLYLGTTTLPMDVVEEYIESVRSIFTVEAYDLFRHNCNNFTDSFSNFLLGKGIPAHIRDMPQAVMDSPMGRMLVPQLTQGINASRQNGSILGLQDSSRAAPPVTRAKPATTSSVKLPKDSAEAQSLLQRAESSCAAVFFTSATCGPCRPFYPIFDQLAEELGEKATLIKIDISQPQMMAIAQRYSIQATPTFVTFVKGKEDERWSGGNPASLRGKLQLLVHMAFPPHPHEGLRLPTFSDPHSKPVVYSKMPPMDKLIAKMGVDVAGRTEVKSLKRYLEARASNGLSDAVLPNMSQLSNLVQQSLVSLPQETLFPIIDLFRCALVDPRISAYFVEEQNHQAIRAALDFVNNSTRCPYALRLVTIQMACNLFTTPLFAEQLFRSPDLRRGVTMLISSSFLDEAHNNVRVATSSLLFNVSIAARQSRSSESSVSGSALPEEDQVELAAAVVEAVGQEDKSAEALRGMLLALGNLVYGTSLDGELADLLRALDAQSTVTSKKDIFPDEELIAELGGELLGKGLRRP

SEQ ID NO: 2595 - protein, 332 aa, Unknown
  Kingdom: Fungi, Phylum: Ascomycota
MTSIVSRYIEQLRQVYPPKPTFTEPDLPDLSDKVYVVTGANTGVGKELSRILYSKNARVYVAARSEEKALQAIEDIKTAAPESTGQLHFLRLDLADLTTIKASANEFTSKEAKLDVLFNNAGVMCPEQGSKTAQGLELQLGVNNVGTFMFTELLTPTLVETARTAPANSVRVVWVSSSAADAPVCPKNGVDMDNLDYHNDKGAMHKYMVSKAGNYLHCAEYARKHTSDGIVSIALNPGNLDSDLWRTQGWAVSKFLKSFVLHPVIYGAYTELFAGLSPEVTIKHPGDWIVPWGRFANIRPTLSHAAKPVDEGGNGTGQEFWKWTEAQVKPYM

SEQ ID NO: 2596 - protein, 288 aa, Unknown
  Kingdom: Fungi, Phylum: Ascomycota
MPRPPLSENRVLKIVNAARDGGYAVPAMCCYNIESVIATVRAAEAAKSPAIVQLFPWAIQYAGDALVLAAANACHSASVPCALHLDHCQTPELVRRAANIPDGFDGIMCDMSHYEKEENLALTKELVQYLHDRDICAEAEPGRIEGGEDGVAETVDLEGVLTTPEQAEEFVATGIELLAPAFGNVHGSYGPRGIQLEYERLASVNKAVGDRVRLVLHGADPFDEEIFRKCIDAGVVKININKGMNNHYSDVQREMDGKPLTSVIEAGTDRMQKAIEKYMQWFGSAGKA

SEQ ID NO: 2597 - protein, 310 aa, Unknown
  Kingdom: Fungi, Phylum: Ascomycota
MSLTNCRFYEDKFPEIDSFVMVNVKQIAEMGAYVKLLEYDNIDGMILLSELSRRRIRSIQKLIRVGRNEVVVVLRVDKEKGYIDLSKRRVSPEDIVKCEERYNKGKLVHSIMRHVAEKTNHPIEALYESIAWPLNKKYGHAIDAFKLSITNPEVWNDITFPSTPIADELKLYISKRLTPQPTKVRADIEVTCFGYEGIDAVKTALRTAEAGNTEETQVKVKLVSPPLYVLTSTCLDKNVGIKCLEEAILDIRKSIQGAGGSLSVKMEPKAVTESDDAELQALMEKRERENAEVSGDESVSESDDNIPDTI

SEQ ID NO: 2598 - protein, 224 aa, Unknown
  Kingdom: Fungi, Phylum: Ascomycota
MFSRQAIRSVRAVAPQRALAFRAPIRSYAAAAESQPPIAVFGVDGTYASALYTAAVKSSSLDPTAKALATLGSLVERDAKLTTILSAPTLSNEDKSAIVAELAKQSGAGKDATVKNFLDTLAENNRLSILGGVCEKFGQIMAAARGEVEMTVTSAQPLDNKTLNRLESAVSKSEYVGSGKKLKVTNEVNPDIVGGLVVEVGDRTIDLSVSSRIAKMNKLLSDSL

SEQ ID NO: 2599 - protein, 517 aa, Unknown
  Kingdom: Fungi, Phylum: Ascomycota
MRFKATCTPVMRTSRPTVMIRQSLSLPLYRGYTTNPGRNASPRNFRYMLAATAVVGATTVAFAVVPASKTVDNELQAEPAPILETAASVGAIDVVSPVRALNMREANDKLREGARVFEFPTVGEGGKGRVDVVRVASNSPVEDEWAVGVGSGVGSGVGGERNGPKSLYAGVYDGHAGWAMSAVLKHVLIRYVSTSLGHLPASADDETVAETIQTAFETLDNRVMNHAQKALEGAAAGNPEALAAVAPAIAGSCALLAVYDPSSSTLRTAVTGDSRAVLGSWSAATVQSDSNRESKGNFTAEQLTIDQTGFNAAEVARLQVQHPGEGPDMINSDSGRLFGLAVTRAFGDHRWKWPQDLIKAAQTKLWSSSPRPKADRSPPYLTARPEVTTSRVQPATDFVILASDGLWDVMSNDDAVTCVERWLAARGVGKPEAQAGAATKGSFTVDEDGYGKYRATPEHFAIEDLDNAAVCLAKNAFGGRRRDLFRGVMTAYSPLSRDVRDDVTIQVIFFQTPPGQS

SEQ ID NO: 2600 - protein, 508 aa, Unknown
  Kingdom: Fungi, Phylum: Ascomycota
MFLLVSNWQLGASLVATGLSVWQAVIATIIGKVIIALVAIFNGHVGAKWHIGFPVISRYIWGPYGSYLAIVQRIILSIVWFSVQSWTGGICVAVILSAIFPSFQNIRDVFPDNPSLETKQFVGWILFNVAMIPVIYIQPHKIKRPLLVFNVIASTTLIAMMVWSLARAGGGGPLLSQGNAKLSSSELGWSMTSGVTTVIGSIAVGLTNANDYTRFARRPGDQVFGQWFSIIFFGTLFPLFGCLAASATQSFWGEAIWNPPVMCQRWLEENYSPGGRAAAFFAGVGLLLCQISINVVDNAYSAGMDMAGLFSSYINIRRGAFIGLILSIAMCPWELLSSAAVFISVLSAYSVFLGPIIGIQICDYWIVRQKNVKLSDLFHPNSPGSIYYFWRGFNLRSFIAWFLGFATQLPGFAATVTPKQVHVGEAWIHLFNLAFPLGFTISFAVHFAINHFFPPAGLGQIDLSDDFGTFTPEEAAKIGIEDHIEGKEISSEANINETTAIGFTSTKV

SEQ ID NO: 2601 - protein, 202 aa, Unknown
  Kingdom: Fungi, Phylum: Ascomycota
MANPRVEELPDDEVPKTNVEDVEDDSSSESEIEEGNLPAGSSTIVHSRNEKKARKALEKLHLTRIPGITRVTLRRPKNILFVINNPEVYKSPNSNTYIVFGEAKIEDVNASAQQAAAAQLAAAGAEGDHAGHNHGDAGKAPETAEAKKDDDEDDGEEVDAEGLEDKDIELVMTQANVSRKKAVKALKENDNDIVNSIMALSI

SEQ ID NO: 2602 - protein, 344 aa, Unknown
  Kingdom: Fungi, Phylum: Ascomycota
MTAWNIFRIIGDLSHASSKCILIFAIHRNRSAEGVSLITQLLYALVFCTRYLDVFVESYVWNFVFKIFYLLSSFYILGVMQWMYPRSREREIAWKLGALVLGGSLVLSPFVMMIFEKYWGFMHWLWVFSEILESVCVLPQLLLLRQTTVPTVIDSFYLLALGSYRALYCVNWFVRGLDPDDHGIDTVSVIFGLIQTALYVDFFWVYYTRQRVKLRGGGIVDADDMRHSWLLRRIFGNKRFQPEDEEDEESGPALGGRGGQQRNRPKWGARGISVSADDGVLDADRGRDSEDLDGVVDPDAKMQDPDELAKALDDDPLDGPSSSSSAQQNPTPPSGIRNGDEWRD

SEQ ID NO: 2603 - protein, 124 aa, Unknown
  Kingdom: Fungi, Phylum: Ascomycota
MADFEAVAKQFIEFYYNTFDADRKGLQALYREQSMLTFESASVLGAGPITEKLTSLPFEKVKHEVQTLDAQPTMNDGGVIILVTGKLLVDEEQRPMSYTQSFQLSRDASGQYFVFNDIFKLVYA

SEQ ID NO: 2604 - protein, 489 aa, Unknown
  Kingdom: Fungi, Phylum: Ascomycota
MQPPIPVLADYGISPNHGFLPDTLPLSRLPDPYYNKWESIVANLQALILSRRLRGVIDRLPVLSTIGLEHDAEWRRAYSLLGFMTHAYIWGGDTPADRLPPSISVPFLEISERLEVPPVATYAAVVLWNFKPLFIDEEIDNLENLATLSTFTGSLDESWFYLVSVAIEARGGPIIPLMLDAIAAAQRGDISLVTKCLQAFAERLTDLTTILQRMHESCDPTVFYHRIRPFLAGSKNMAEAGLPDGVLYEDGSGTEEYRQYSGGSNAQSSLIQFFDVVLGIEHRPTGEKPNPGSETEREYRAAQRHNFIRDMRRYMPGPHARFLQDVALVANIRDFVEEHTDKRQLCIAYDACLTMLSTFRDKHIGIVARYIINPSREVRARSRSRSPEVTRRRQNIAVSSRKEQDGEKKRGTGGTALIPFLKQARDETGEPAVEEWTRKFMKRKIKSEGLGDFFAGKPEEGAPVEQDVEVKGLAWSWTMDDEVGGICLY

SEQ ID NO: 2605 - protein, 575 aa, Unknown
  Kingdom: Fungi, Phylum: Ascomycota
MGGAPVNSGAAVYDAVLHRRQALMGASGARALLKNFRVFAIASFACIGGVLYGYNQGMFSGVLAMPAFKEHMGEWDPFDDNAPQTKKGWLTAILELGAWLGTLLSGFIAETISRKYGILVACVVFIIGCVIQAASIQAGPAAILVGRFVTGMGVGSLAMIIPIYNSEVAPPEVRGALVALQQLAICFGIMISFWIDYGTNYIGGTKRGEQSDAAWLVPVCLQIAPCLVLLCGMTFMPFSPRWLVHHGREPEARQNLSRLRGLPEDHELVELEFLEIKAQSLFEKRTVAEKFPHLREPTAWNTFKLQFVAIASLFKTRSLLKRCMIAGTTMFFQQWTGINAILYYAPTIFKQLGQSSNTTQLLATGVVGIVMFIATIPAVLWIDRVGRRPVLAVGAIGMATCHIIIAIIFAKNADDWPNHQAAGWAAICMVWLFVVHFGYSWGPCAWIIVAEIWPLSSRPYGVAFGASSNWMNNFIIGQVTPDMLQKITYGTYILFGIITYLGAAFIWFIVPETKRLTLEEMDIVFGSEGTAQADFERQEEINREIGLTRLVMGSGGHTPPHEPEKDHKFETSEHV

SEQ ID NO: 2606 - protein, 490 aa, Unknown
  Kingdom: Fungi, Phylum: Ascomycota
MPRRPSLPEASPPGSTVTTTRTRIVPGSCWPCKKRRVKCDLGKPGCQRCLSLGASCNYSTRLIRWKETSGNNLNSSSRSPTLEIRSFTPFSRAESPLGGRERIALNYFRGRVWPLLSTAPEPCAPPIPVALEHKAVLLTTCLLADSHRFLQDGLGSIDHLNGQRMECLAAVRSDIAECCTSTVAKRQDQSLITLLFAVLFLYIDDGFMECMRRHASTWSHHAGVIAVLNSMGGMEKMLSTGPEALQMLLSEFASADLTTAVLQTRRPELPPSTWDAIDRGAVWWGIDDQRSYSLASTFKVMSQIAFYIESIANGTEFLEMEKIRGFEIELRPRFAPISAKDLHLAGTSTLNEQESGDGAGEDSLQLHTLLRAFQHGALIYLYRALCGLPAFHPLVQQHVQSCLAAILEIPLHAHTLNCVIFPLCIAGAHAETEKQRESVLVTVNMVHENMKFAAVQLVKMLFDELWRSDDTRDLSWKKMFAKLGPHVLIL

SEQ ID NO: 2607 - protein, 352 aa, Unknown
  Kingdom: Fungi, Phylum: Ascomycota
MAPSIPSEQWAQVLEATGKPLNYKKIPVQQPGPDEVLVNVKYSGVCHTDLHAIKGDWPLATKLPLVGGHEGSGLVVAKGDLVKDIEIGDAVGIKWINGACLACSYCMKGDEQLCQSATMSGYTVDGSFQQYAIAKAAIVARIPKECDLESVAPVLCAGITVYRGLKESGCKPGDTIAIVGAGGGLGSLALQYAKAMGLHTIAIDGGEEKRALTKKLGAVSYVDFTTTKDIVADVKAATIDGQGPQAALLVAVQEKPFQQAAAYVRSKGVVVCIGLPADAKLSNPVFDTVIRMVSFKGSYVGNRADTAEALDFFRRGLITVPYKTVGLSELQKVFDLMEEGKIAGRYVVDTSK

SEQ ID NO: 2608 - protein, 1119 aa, Unknown
  Kingdom: Fungi, Phylum: Ascomycota
MGSVLEKNSEQVRKRIEKHTFDDEHGEEYAGSEFGGFGDYFRRKKIKLQNLDADLRAASDKPQIFKGIVAHVTGYTQPPLHILHKEIVEHGGGFLQYLDSKTMATHIIASTLPPKKSIDFSRYRIVKPAWIVDSVQAGKLLPWASYRVLDEGPRQKVLAFDGSSGISQSAPKPKQGYREMTDQSFYTSQFKTPTLPSQFWTQVAEQVDSPSPNPAAKHAVFSDNSSSTSTAASSVRVNETKAISEPKRTLLTSPSKAPMIEPPKNATSEEHNAWLLSDPRLRKSSTANPDFLQQYYSESRLHHLSTWKAELKSRMQRLAAEKATITMKAGKRSAGSRKYVLHVDFDSFFCAVSLKKHPEFVERPTVVAHSDGPGSEIASCNYPARAFGVKNGMWMKRALEMCPDLKVVPYDFPAYEDASRLFYEAILDVGGIVQSVSIDEALVDVTSIVLAAASSTGHGVEEGSIWREQEKVADVAKSVRDKIRVSTGCEVSVGIGGNILQARVALRKAKPAGQFHLKPEMVLEVIGELKVDDLPGVAYSISGKLEEIGVKLVKDIRDVSRERLSQILGPKTSEKLVGYARGIDKTEVGEQTTRKSVSAEVNWGIRFLSQEEAEEFVMNLCKELEKRLLNEQVKGSQLTMKIMRRSFDAPLDPAKHLGHGKCDVFNKSATFGVGTNDAERIGKEAVAILRSYKFRAGDLRGLGVQMTKLEPLRSAMPDGSQKKLAFDSWKGPSPARAPLKTEGITESDDAKDSSRRLSKQDMSDPITDDPLTPRKPKMHPSRTLSKTAQKDQASTTPLNVSGTQFILPSQADANTLAELPKDIRSRLMGQASRASTRSASPAPKSRSESPMPAEVLPSQVDAEVFNALPEDMKAEVLASYGRKPQQVTLQQSPRKNQAMQQKKPTTPTKRGGLRGMFGKGQRQRDAQSDLVQTNFLAAKPVAEAQPDNIVEELDPAFLAELPEDVRKEVIADHRRQRLAQRSGLDAPASRSHHPDAHSVLVSGQTTIRFPATPSKVTFAQSGVTSTQEIKDMLDAWHTETQSQGPHNGDVEVLAKYLARVVQEERDVEKARKIVKWLDVLVEHDGRNGRGRSAWRQAVAQVRHSVQGAVRERGMAPLKF

SEQ ID NO: 2609 - protein, 709 aa, Unknown
  Kingdom: Fungi, Phylum: Ascomycota
MATLDIAAKGTTSLVYSAFILTEFLQHVKILLDVTKAFHKKSSLGGKAVVTLTTIDGSTSHDWDVLNHLSKLASDAIGFPVFSVVQEWIERSEALSAPNFRQVQASLGELDAHLTLRSHISGYEMSCADVFVWAVLSSNHVALSWIRKAQNNVTRWYNYIEASNPWAREALNEVHTASSQDKLAARAAAASVGASYDIDLPQKSGPIVTRFPPEPSGYLHIGHAKAALLNEYFARLRPGGCLICRFDDTNPTNESSEFQDSILEDLNSIEIVPDKITYSSDNFQVMHDYAVQLIKNGKAFADDSELGKGDESRKKRLPSKHRDMGVKKTLRRFAEMKTGSAEGLRWALRARIAYDSPNGTLRDPVIYRCNLTSHHRTGRSWKVYPTYDFCAPILDSIEGVTVALRTNEYRDRNAQYEWIQEALGVRKVPIWDFSRLNLVRTVLSKRKLTRIVNDGRVWGWDDPRMPTIRGILRRGEVVPALREFILKQGPSRNVVNMQWDVFWATNRKYIDAAVPRHTAIAVDGAVPCNIEGTIEHTMMTKAKHPKNASLGEQDILYGPKIWIEQVDAARFEDGEEITLMNWGNAFVGKITRDETGNVSALNLELHLSGNVKKTDKKVSWLADRPGNLLPVDLVSFDYLITKDKLEKTDDVEQFLTPVTEFRTTAYADCNVADLPVGTIIQFERKSFFRLDLAWKGQGSKAVFFEVPTK

SEQ ID NO: 2610 - protein, 1768 aa, Unknown
  Kingdom: Fungi, Phylum: Ascomycota
MSGHGQDDIDHARRYKTPYSAKHPIPTIAKYRKEKESRQQNALDRGDDEQTQQDQSYDDGHDSDYDDGSGEKQQGDDDTPKDTSQVDPGAGDVKKRRKEMKHNKQERAEREVTDPVTHLPIVVQDFTDEALKGVDYNHPPFGSTGKTATGLSGKKKTDDQLQEEQNEIQEEHNFLVNRFPPPDFDALRKELVSINKSGITFALAGSAFIILGAVLLDRLIRRDGLFFNDDGKFHLSRAATWVVLVSFCVGGVAALVIGVRDWISKKVNGVFEDEVWDAQRRQIKSDAARHESETTAWLNSLLGSIWPLINPDLFAGLADMLEDVMQASLPRFVRMVSVEDIGQGSESLRILGVRWLPTGAATKSVMENGDLNVEAQNEADTNESGNDKAVEDSGSDKEDAHGNGVAEGMEAEEGEFVNLEVAFAYRTRSTSKTLKERTKDMHLYLAFYLPGNIKVPVWVDLHGIVGTMRMRLQLTPDPPFFQLCTITLLGQPKVEVSCVPLSKHALNLMDVPMISNFVQSSVDAAMAEYVAPKSLTLDLKDMLVGDDFKKDTNAKGVLVVNIKRGYDFKVGDTGIPLIKEGSSDPYVSVGWAKFGKVMWSTRILTSEMEPAWDEVCYVLVTSQELNVDERLRLQLWDSDRMTADDDLGRIEIDLKEIMRNEESNGKMWHRTDGFRALKSGDNMPGKLEWSIGYFSKARLQECQFEQQTYDPEIRNMDQMKKKIEESCERKLRETMFKEGRSERDESEMEQQKEQEMKEEEDAMIISAPPPENYPSGLFSLQVHNITGLELEKLSKDPKESDNKEEEESGEGLPSAYCTIIINHKKQFKTRTKPQNAKPFYNAGCERFIGDWRDAEVMVSVRDARIDEEDPLLGMVFLPLNEIFKERSQVMGFWPLTGGVGYGRIRLSMVWRSLQLKAPPNMLGWDYGTLEIQPWATVTDESQLPQDPTSTKLKFKTSLSSGKMHYDKDQGKWTAKRDESIKLAVNKRYSTCLSIALKHKGKMGENVDAFCVLWLKDLVDEEPTEMDLTIWKGDFKRATACCLTECGEKVGTLKLKLTFWAGLGGAHSKWISKDQNLREVAEVIDTARDNLQADEKEKEAGIVDAGQESSDESSSDDDSSDDEAKDESKGNKGGPIDQFKDYKKREKGLHRKHRGIMQWKAPRTAKWAKHKVEQVGGIGKGVFQRHSEGGGIETEAPHSAITSTTNTKRHQRDANDGEDEAKLHSICTPTFIVTTTIQPVASTCCSHALPPSPPPCFDQKLQTYNRTPSQRMSNINGQHLTQLPRHVQRYGNEVVDFINNNVDQAAHTLRETLSAQPWIPDSIRPTPPVRAPAAAVAAATRLQQVQDWINRNRVLTGIVVVVAGTVVYKSVQRTRSRRKTRRAKKARNGAREEVIVIAGSPALPLTKSLALDMERKGFIVYIVCSASEDQNVVQSLSRPDIRPLSIDTTDPPSAGAAIERFAMHLKSPQEPAPNVKPNLLTLKSIILIPNLHYQTSPIATIPPSSFADLFNTHLLQPILTIQAFLPLLTSRLNPIGERWTPPKVLVFTPSIISSINPPFHASEAIICSALSAFTEVLTAELRPLDIPVTHMQLGTFDFSGFVPARAALTQHSHRAYSGNPQDTLVWPDGARQVYGRNFVAQTSSAISGGRIRGLKGSSLRRLHNSVFDVIDGSITADTVRVGLGASVYGFVGRWAPRSLVSYMMGIRRVDELSTWKASSSYEGSSREESENGEGPSASHEFVAVPSESNVWNSEGESQLWTPSQTSSAV

SEQ ID NO: 2611 - protein, 272 aa, Unknown
  Kingdom: Fungi, Phylum: Ascomycota
MSSRPKIDLSPLVKDPDSLEARIAAILQPALDSAPTALTSEALAGDLDKLYPADYQPKEGDGDVVADILWSLWSFLIKAVKKIPADDVRQQLVADALRKLQSKERQDAKVWGQDCKMWGDLGLLGPNMREAWDMRPNFNKAGSEAVAEWTSLNTFAALLLGNNVQDWNNFAIWELRGALEEDASSNADRDGQLWASSEWILHAGDVLRAKKGMGELDPMERRMLKGGSKFEGEPGLSDERWQFWRTRFAELGEQVEDEALKAKLEKVVKKMT

SEQ ID NO: 2612 - protein, 332 aa, Unknown
  Kingdom: Fungi, Phylum: Ascomycota
MSSEATSAAAPASAPATATTTATSPASRSERREERRSKRKEKQPAIKYPFWFGGSASSMAACVTHPLDLVKVRLQTRKGDAPKNMVGTFGHIVRNDGILGLYTGLSASLLRQLTYSTVRFGIYEDLKSRYTTPGHEPSALLLGAMAASAGFVGGIAGNFADVVNVRMQHDASLPVNEQRKYKHAVDGVIRMAKEEGAMSWFRGWLPNSSRAAAMTASQLASYDTFKRMLLEWTPLGDTLATHFSASFLAGLVAATVTSPIDVIKTRIMSSANKQGIGALIGEIYRAEGMMWMFKGWLPSFLRLGPHTICTFVFLEMHRKAYRGVIGADDKPL

SEQ ID NO: 2613 - protein, 485 aa, Unknown
  Kingdom: Fungi, Phylum: Ascomycota
MLRRRVSSSPPPRMRRGRSPSPRNGPPPEVEHLRARFVETERVRSPSEVRSRRSPSRGPRFDDRRPRSLSPPEQQRIRTRIIDRSAERDIYTSSSSSPSPPPQRIRGPTLERDVITHYHDIDHGMVQARPPSPQRASRPRPMPQERTRGMPQERTRADETDIDISLGRNRTEVDVVRRTTRSGSRGGTTYYHDDDLGYERYGRERSSSMRMGPTAPPMDDEAREITSKIDSRGRMGESWGGATKDWTIVDVPPGTERVRMDGKGGGSTDTTWSKYSGVRRTQFIPERDGALVPVRAPEPAPAPLPPTSGRDRLSVSVQSRNTDVDIERTTERRLVSMPPPPQQPMPVTVSTKTDMWTEITKDLVTREAIERLGYPYEESKWHFYIMDYLQIDQVKELTDLTDQIRRSRMRRAQKPREVSKHHDDIDVHYHRHRHYYDYPPLPRPHRDHRQHHHHHHGSRSHWDWEAESYREREVIWDSNGRKWYR

SEQ ID NO: 2614 - protein, 317 aa, Unknown
  Kingdom: Fungi, Phylum: Ascomycota
MSASLAERFDHFPVPAAPYSSLAVDNLGFPNTMSMFTLSQHQYAFAQAPQPARQYAAHGTSSAFSSSANPDEDWTKISDLAERRRIQNRIAQRNYRKKLKRRLEDLERRAGSSDEAETEVKPQPANKSTKRRSPSKSQAKSPSASQQTPAPHKQTPQMQFTPPMDNDDMLFASANYTERERSFTPPLFNYSAYPAPEEQQMLAPYGSTQPYQVLSAAEPYPSYLSTTTMSSTLPSLTHFSDAIKREPYAMDASLTPYSGYGFVPGVEVGANPYDQSNPHTPPLSHSFDHSANCSEAGYEYPTTPLSMPGSPGMPQHI

SEQ ID NO: 2615 - protein, 274 aa, Unknown
  Kingdom: Fungi, Phylum: Ascomycota
MGSLQPSYSAPPQRLTFDGYLFDMDGTIIDSTPAIVKHWHTIGKEIGVAPEVILETSHGRRSMDVLKILAPEKATWDCKLIPSAYPITHLQPLYDHFTFLSTYITKALLTYTDIRHMEGLLPKLYSSDATEIPGARSLLTSLINNSAPWAIVTSGTEPLVTGWLSVLNLAIPEHLITAESVEEGKPHPACYRLGRERLGLQHDDKEILVFEDAPAGIKAGKAAGCKVIGLVTSHTLEQIVEAGPDWILKDLESIDVVDVKDGRVTVEIRDALVQ

SEQ ID NO: 2616 - protein, 297 aa, Unknown
  Kingdom: Fungi, Phylum: Ascomycota
MDYSRPMQSVDPRPISTPGDTQEPYQRPMPGTMPGTMPQHMPDTLPHHPSPYDVSQQQYRPPPPEGMGLHLGPEAQIPDHPGSTYEIPRPPTQTFTGQKPTTAVAPAPPKDLRNVRANCVYQLREYMALQNKTKMGDVSLSRIDLQDQMRNQAGIVVLELKRIQADLREVSKKGEQQRWKKLLVGAGIVSFIPIVRRLFRRPANTSVAGNDTEYAWHRAAALLQRIKDGILGNGSFAIIASFVAAVLYVFQNEVKLRVARTIRKRVRKLCARLEAGDETVGDEDLKVFDGWRWKIVL

SEQ ID NO: 2617 - protein, 559 aa, Unknown
  Kingdom: Fungi, Phylum: Ascomycota
MSIQEKSEVSPAALEGGSLPRDSEHGGHTEASREPVAEPESKEATRPVQGFMWVLLVISILSAIFLYALDNTIVADITPAAVNQFGDAVKLPWLSVGFLLGGSAVVLPFGKLFGLFNTKWLFNGSIVLFNVGSAICGAAPNMNALIIGRVLAGIGGNGMYLGVQTLLSVNTTPKERPGYLSFVGVVWGLGTVLGPVVGGAFTESKATWRWAFYINLCITALFAPLYLWVLPPFRPRPNESLVRRLREFDMIGAIVSIGAITSLIMAMNFGGTVYDWNSGQIIALFVVAFVLFIILGVQQGVPFFTNLNNRVFPAHFLRNHNAVLLYAITSAVNAASFIPIYYIPLYFQFTRGDDAILAAVRLLPLIVCLTVMILASGHLISRFNYFQPWYIGGSVVALIGGVLFSRVDENSSTGYIYGIMILLGLGTGAFTQSGYAVIQAMTAPSDLAYAISFMMLAQLGGIAFGLTISGAVFINTAIDGLAKILPDASHDELQLAISGTSGAYFQQLSDELREQATSVIVESMSKVYILVYVGAAFCLITSCCFTQRKMFKDAVNIVA

SEQ ID NO: 2618 - protein, 534 aa, Unknown
  Kingdom: Fungi, Phylum: Ascomycota
MKHPRSFTSQAGSQGQRARHEQNFSLATAVALVVTSFGAGVAYWNISSSVQQSQSPKYASKKDMLRAAEEIAELLGEDAVTYDHEVLEHHGHSDWSTANSSSRAVAVVYPRSTEDVSAIARICTQYSVPMVPFGAGSSVEGNFAQPHSGICIDTSYMDQVIALHADDMDVVVQPGVNWVDLNSQIASHGLFAPMDPSPTASVGGMVSTNCSGTNAMRYGTMKDWVLNLTVVLPDGSVIKTRRRPRKTSAGYNLTSLFVGAEGTLGIVTEVTLKLAPIPEDTGVAVVAFPSIKAASAAASSLIRSSGVQLAALEILDDVQMRVLNEHGSETVRKRKWAEKPTLFLKFSGCKDAVKGDIKRVSQFIKSFTDESLQIARTKQEEHDLWAARKEALFTMVSIRKPGTHLWSTDVAVPLSRLAEIIDASKQECSQLGIFASVVGHVGDGNFHVAMFYDPKDPEQTNKVRTAVGNMTRRALEMEGTVSGEHAIGIGKKECLMEELGSETVGLMQTLKRSVDPKWLMNPGKVFDAPSSAGI

SEQ ID NO: 2619 - protein, 304 aa, Unknown
  Kingdom: Fungi, Phylum: Ascomycota
MSGNVLVLGAGELGTSILEALAKHPLRSNAKISVLLRPTSIDSPSPEKRAQVERLQALGVTPQPGDVESPTSTLAAIFRNYDTIISCNGMGRPAGTQMKLADAVLEAGVKRYFPWQFGMDYDAIGNGSDQDRFDEQIRVRQRLRAQNQVNWTIISTGLFMSFLFLPDFGVIDLQHKVSRGLGTWDTKITTTLPRDIGRVTAEVVFDPREIASQVVHIAGDTLSYKEIADLVEERFGQGVFTRELWDMEALKKQLAEGQPVAKYKASFAAGKGVSWDKEKTLNVARGIEMTGLREYLKDWDLATE

SEQ ID NO: 2620 - protein, 487 aa, Unknown
  Kingdom: Fungi, Phylum: Ascomycota
MAQEKANITQLMEVMPSCAVECMVPLINVSNYMTSPDALCDFEDTECLCSSREFQGTAQACIAEECSVVDALMSRNVTTSTCGYPVRNSSYKLTIVAVTFSVLSAFFVIQRFAVKIFSPDLLLGLDDWMALLAAIIQAPLSGIAVAAGAANGLGKDIWTLTPDQISNFLYYLYVWSTIYFVNIAVCKLAFLLFFLRVFPAPRVRSILWATVGFVGVYGVFFFFMNTFQCSPISFYWQRWQKDHNGKCLNASVIAWVNAIISIVLDLWMICIPLYQLKGINLDWRKKLGVGLMFCVGLVSTIVSTVRLAGLIRHDWNSPNQSYVKLELAIWSIVEINVAIICSCLPAFRSLLVRVFPFMPLGRTHRDNTKETFVEGNRELGFGTISRSVAEKTHNRHLPIVPGAIAMSREYKVEHTIEPSRARGSGSTDTRDIMRLPSLEEFDSCGETLDGRSSFDMKSIERRESDDSRDSNDRKGSPNGEPSAWHRE

SEQ ID NO: 2621 - protein, 593 aa, Unknown
  Kingdom: Fungi, Phylum: Ascomycota
MSTTVTPGPQAQADAPRSSNDGTNSERPREPPKSVAEAMRKLWSPKLLAFAIGCLLIMNFFMNFTTYTANVYDPYATSHFQGHSLITTGAIINGLVRIVSYPLLAKLADHFGHPIGFSGAALFMALGNVMYAACRNVETYLAGGILDSFGDTCWNIFQQIFIADVTSLVNRGIIFTLPESITAIPTLYAGTYLGEHMLLNSSWRWGFGMWAIVLPATVAPTVLIMLWMQRRAKRMGLYTEKVSILHGAKPGSGTWGKIQHVCTRLDIIGSLLLIGGLAMTLLPMTIAGRNNTNRWKEPSSIVLIIIGVLTFIGFLIWDGKFATNPIIPYRTIRERNVIIACVFLQVAGFYTPGAATRVDNSQRVAYNIGALITGLLLKYFKNTKPFIVFGVVLICLADGLPIYLTNVNGEGIASEVAFITNKAILGVGRGFTQVPLQVSLQAVLQQEHVAVATAVFLSSLGLGHNIGVTISGAIWNSLLPRKLRARFDRDTADEIFGSLVVARSYEKGTPERDAINEAYRQTQQSLAIASVSIASLLLAIVWLNRNVKLAEEDEKRAAQASEELAWAAKQQEEQQAAMEQSRQHVLNEKKVAQ

SEQ ID NO: 2622 - protein, 305 aa, Unknown
  Kingdom: Fungi, Phylum: Ascomycota
MTTHTSLPLHQKRAAQSTNAAFNLPSSSSSSTSDLDDANADLPLPFPTALPRSDFLSSDFQPAAYLSALPTRHQTLEDLRSDLRDRSAAISTELLELVNSNYTAFLSLGDELRGGDDKVEDVRVALLGFRRAVEDVRGRVSEKKSEADKLNGELKGVRGSLEAGRQMVEVSERLTALEERLSPEGVLDANGERAWDSSDEDDSDAEDEGVPQNWQARSPARLQASAQQCAQTTAIFDTLDPAHPFVLKLEERLERVRNTLLLDLGYAVAEAKKAGVKGHDRLFRYMSIYGVIDAQGEAVKALRNG

SEQ ID NO: 2623 - protein, 309 aa, Unknown
  Kingdom: Fungi, Phylum: Ascomycota
MTDKTFKLNNGQLMPAVGFGTWKAEPGKVKEAVVHALKSGYRLIDCAYCYGNEDEVGEGLKEAFASGIKREDVMIMTKAWATYNTRLELALEKSLKSLGLEYIDMFLIHWPVLANPEGNDDKFPTNPDGSRDMIRDWNHVDAWKQMETLVSGGKVKGIGVCNYSKSYLEQLLPEAKIVPAINQIENHPSLPQQEIVDLCKEKGIHVVSYSPLGSTGGPLMSAEPVVKIAEKNGVSASTVLLSYHYARGATVLAKSTTPSRIEENLKIVELSEGDMKALTDYSDELTKNGKLERYVYPPWGVNFGFPDKQ

SEQ ID NO: 2624 - protein, 763 aa, Unknown
  Kingdom: Fungi, Phylum: Ascomycota
MARLRQRSNVEESAPTTRAEPTRALRDRQTSPMRATRHRMREDASDDSDNLDDSDVSDETSDALSDNDLEDTGLQSSPSRARRRGRPRKANPTVPAVTRTKPSARKDDSTKRARGRPSAASRQKRPRPVSRSHAGSRTPTKKAKIEVQLPIRQGRIPPWTDMRVPYAAWVAIFSYASIDGANSWLVDCATVCKTFLEPALTALYCNPFPSSTPRLRRLADLLARDPSETIMNYRMKVESLTLDIKDTPASVYFPLIHPLPRLKHLFIVTSLDRPPYRDLDAKLRWNYPKGMFKALESGASIQASETLDPAAPSTDASSTPEPQHTDASSLGLFVKPEDKPFPTTLRTWEWSGRMIGGAQGAVPTILNLARVHRQPYFQHLTTLSFTNFQTPSLLGLASNATATQEEDADIVAAQAIAHAISVLPSLRHLMFEASTIVDHNLLPHLPTNLRHLTLINCWEVRSDIFATFLHTHGQDLRSLTLSHCQSLNLEFLTSLGAACPKLETLLMDLSYFSLHNAINDSEPMYDYVLLPHQVPHWPSSLRVLSLDNVKNCSAEIAKMFLSSLLQNAERLRDLRHIFVKMMLNIPWQERATMRTEWRERMEDVFLRKVEPPTDFSQLNEPVVPDDDESKNPRKRKRRAAASPARRSGRLSGKSRGSRNDSKRLRHKDGRMDYRDPDTDHDDLASGTEEDDAPVSSPSEDENTPTGSGQYIQGLCNTVSILFDNQKPMELQYGMEDFRDSDVDSEDEWNGDDDDEDDTVFVWR

SEQ ID NO: 2625 - protein, 695 aa, Unknown
  Kingdom: Fungi, Phylum: Ascomycota
MYSLLTVNNQISLINITIAPSTWIATFTLLCVFLALYIPHLIPFIPRFTVPPFLRPTALLNAITASPTNPSDQKPLPQIPYDNHRLLLHDQSPIARDPSLYYLPSPPPQLQLDHPNNGRRRSSRRLFAGLRTPPQLPNPPSPTPSPIRTSNDRPRLRDGNRKPSSSPTSRRGSGPGLGNRLRSGFWRGPREHAVMAGMPLHQQSPFAILQDPMLMARMGSVAGGQYSRGASPETGISEQDEIILEQAMRTRLPMGSQSPRRGRSASPMRDEDPTLRLPQDSGNEPPSENYFRFALRAEVQQRTAPIESLLSTIRTKYHALTSTYTSLLTTLITILLAMTTLKALLRPASPLPAGDLVKVAGVARSFEPLIYYSEHAVAQVHDLQATSVAVWDLAESVRSSDMEGGGGIVRDLDELSETMKTLAVEMTKFFARVDGDIDGILNVMDWAKMHLNRLSSSPPPSTLSSLYDNLHTALLTTPLLQSPTTGHPTSLGHFTTFILGPSNPQREQRLIQLLFTEFLTILEDSISAELQHSLTLFALFEAVDFHFLNLARAVIRESSAQEELHADLLSGLWSRILGPRASSLRKFEQNRALLRNVREKTVRNKGVLVEHNGKLLTLKASLESLRSKLVSPLVRGANATTLSLEDQIKGLSDVSEYLTEVRRKQKGKVMETLFASVPGKKYMIDQDQGVIGQMN

SEQ ID NO: 2626 - protein, 487 aa, Unknown
  Kingdom: Fungi, Phylum: Ascomycota
MATLKSPETPLPLPARFAHIKDELIRGRHAEVQASWSRLLMALRAEIAEVAAMGSSAIPSIDYSDLHDPMIMNDFSSQLRHRGAAIIRAVVEPQEASQWNADAKAYLADTTSSAGSPTSRDHHLQGVYWSPAQIKGRVHPSVLFTQRQLMSSLWHNSSPPTVMKNGCSRADTPSLASDSTLLSTNYPVSYADRLRIRTPGDATFYRNAHVDGGSVERWEPDGYGSANTYSQIWSGNWEDYDPWDSGARLKVTSDLYNGTGTCSTFRMFQGWLSLSTLPPNDGTLLLCPMIKLSTAYLLLRPFFSPIHDNPSHADYLLPSNWRLDNPPTSVIHGALPSYTQELNDSLHPHLQLPLSLVQVPHLNPGDYVVWHCDSVYAIDRNQRSEHDGATVMYIPACPLTQTNALYLSRQRKAFLLGQPSPDFGGGRGESMHLSRPGVQEVHAAGGEDGLKAMGLMPWEEDEAVTEVDAEVVEMANRILFPDRYEMP

SEQ ID NO: 2627 - protein, 711 aa, Unknown
  Kingdom: Fungi, Phylum: Ascomycota
MAQAEQNDRQRRRFFLNAFVMMCSGHQAPGLWQHPDDRSHEFQKLEHWVELAKLLEKYRFDGVFIADVLGGYDVYRKSLAPAIKTGTQWPVTEPLSVVPAMAAVTKNLGFGVTVSTTYEQPYHLARRLSTIDHLTNGRFGWNIVTSYLDSAARSLGRSEQLDHDERYAQAEEYMKVMYKLFQSSWRDDAVKLDRKTGTYTDPELIRQIDHHGKYFNVAGPHIVDPSPQRTPLLLQAGASKSGKAFAAQHAEAIFTSAHAPAVCAKNVAEIRQAATEDFGRDGSLIKAIALVTPILGATEEEAKAKYEDYRQYASLEGASTLFGGWSGVDLNQYGDDEELRHVQSNAVRSMVDSYARFSPVNSKWTKHTLAEHISIGGNGPVLVGTPSQVADSLETWYDEAGVNGFNFGYVIFPQSFIDIGELLIPELQRRGLVADDYAVPGGTYRENFYETKGQKHPRDDHVASKYHWKADVPASLQISSCAFSTSIMARQRKEPSIKLRQPDRSGPSEKTLLDLAQERNLFEQAKQREQENAGANRSKKADKKTSPKIDDDDVPDPAVLSPGAERLLESVLWVSTLSMLYFTLYVLVQNQYGIMIKWDEIAMRTAISWPIFFMLFHPLHPHAVAPPLVPSLLPARYQHAARQVIFFVMSTVCGCAVIEVTNGEGYLAVMKRAPPLACLWIWAVVELDLAWAALSLAIAAAYLWANGYSVV

SEQ ID NO: 2628 - protein, 149 aa, Unknown
  Kingdom: Fungi, Phylum: Ascomycota
MSFLTEKMLRPMVRTIPRASIAFNAPRAAAFSVSMAARKTPVEAVKDAAKTVDRKVSDGLVTGIDAAVDAKDKAKATINSSDAAAKAEQLKDEAAAKAQELKGEAKGKAAELKGDANSAAAQAKGKAQELKGEAKGAAAEAKGEAKSKL

SEQ ID NO: 2629 - protein, 295 aa, Unknown
  Kingdom: Fungi, Phylum: Ascomycota
MPQVSIHPAIKHRLLSTPPTSSPALHPRPLLRTYVAVPGQTHAHHAYPQITTLLFDCDNTLVLSEELAFEACADLINEICVGRNLTVRFTGETLIKEFVGQNFRGMLTSLQKMHGIEISPEDMESYVTREEDAVIAKLKAALRPCDGVDAQLEQLASSKKYLMAVVSSSALRRVQASIDKVGQDKYFKTAEGKNLVYSAATSLPKPTSKPDPAIYLHALKELGKTAEESVAIEDSKSGTLSGTRAGIKVIGYVGPYAVDKQSEMEQVLRDAGAVVIMKDWSEFPAALQKIEAGEV

SEQ ID NO: 2630 - protein, 244 aa, Unknown
  Kingdom: Fungi, Phylum: Ascomycota
MKFTLSLSALAAFAATVMAQTEGFDSVTQPEPNAKLPAGETFEVVWSAPKDYAEGTVSLHLIGGETQDTQQPLADIAAGIPNSAEKYSWAVDAALGDAKFYGLVIKYESNPDIFQYSNPFHIVKAEGADSAADQTTTISKSYGEKTVTLSACDCEETTSSTSIITPPVISTPTPTPSPVENTTSTYVKPTTIKTKPVPIQTTEIEVVQPEPTTPATVPESGANARFGASSVALVGAFVVAAFAL

SEQ ID NO: 2631 - protein, 590 aa, Unknown
  Kingdom: Fungi, Phylum: Ascomycota
MTSTQEVSAAPVNNQKPQTEPQDARPDAAVHYVEDLELDPEPKVAWSTILAVFFMGLTYVPAISTAFLMPTQILQQIGMALGDTDNIAWIPGSWSIGAAVSFSIAGGLSDVFGRRWVLLSGQGIILAGAIVCSLAQSTLTIVAGTTLVGFGAGVIMVAYPGIAELLPNKYRGIGIGWTEFCITIPWGSLSGLIGTQLYLKASWRWCYYITIIYASIVLVGTFICYFPPSRPQHDYEKSRWQQVKELDYIGLFLFATGLTLFLVGVTFLGAAHRSMTLVAVTISVGACVFISAFIYDFTVPKKPLFPLKLLRMYREFTVYLIILFVCGMIWQAMITLGNQGTLFMFTNDIVDIGIISIPANVSAVLGGWIMPSLVHKIKHIRYQFLFALLLQTAFTASYATVIPHNKTGWMILPMFGQSCFTWVTVLSYVSSGLLVPQEELGVSAGLMGTFRSAGGSLGNAMFSTIVTSKINSDLANNIAAAAVRAGYSPKNLEALIPAVIKNASGVPFAMANVPGVTQQVLAATGTAFKDTYAKAFRTVFLSTIPLGVVALIAAAFIRDPSHLLNNHVAVHQEKYVLGKKDVENAGKIID

SEQ ID NO: 2632 - protein, 308 aa, Unknown
  Kingdom: Fungi, Phylum: Ascomycota
MTPEEIKPFLQSMVDSVHAPFTPILHHPGEAGLEYEDVFFPAEDGVPLEAWYVPCEHSNKIIIVNHPMRFNRSGYPSHLEPWSDFCGGAACGNDIEVNFIPDLKILHDAGYNVLAYDLRNYGLSGAAHGGMCTSGVCESRDVIGSLQYVRSREKTKNMTIGLFSRCLGANSTFFAMARRPEVFKDVRCVVAPQPLSTDALMSKALVSNGLDLGYMKTLDTMMKQSTSFSLSERAIIPKMQHVRTPTLIYQVRDDVLTTPDDVQAIFDAIPIEQKKLLWVEGTTSRWKGYTYFQEKPEQLLEWFAQFMG

SEQ ID NO: 2633 - protein, 432 aa, Unknown
  Kingdom: Fungi, Phylum: Ascomycota
MARHSISPTRLHFTTVNLLHQPHSTTQHNTPQHPQPAEQTSQTIMENHESNSNVKLTASCLCKNHHFTTNVPSSTLPLQAWTCHCTSCRHTSGALYTHDALWPGPTSDVTRSDLSVYQMTKNVALLFCGKCSTPMFWWERFEGQEECLDVLIGALEAEGCEGGEVVRTVRNAYVGDTGDGGAAPWLRSLAEVQEDIPTWRGKANESELLDPDWHMTPVQGKVEDPDEIPIVCHCRGVNLILRRGDADFANMKREDLPFFVDPSDHKLLASFDACGSCRKSFGVNVMNWTFTLLKHIAFADGTPVPTTTPQLKDACSAKDRDERFGTLAYYKSSPDVQRYFCSRCSASVFYAVDDRPDMVDLAIGLLDSPDGARAESRLAWALGPPVTWRKEAKGQWREEFVAKLEENTEAWRVRTGREKIWLRADRERAAGS

SEQ ID NO: 2634 - protein, 523 aa, Unknown
  Kingdom: Fungi, Phylum: Ascomycota
MLGQSIAHGPKHQTIEVSAPAKASSKASWIVPHDFASFSFPAHWFADFCGNATHPNLFSRDIFDLLYSKTGAHPFVRVGGTSTDRVWYNESQSVGLINYYEKSDSDLQSWGIPDWVYIGPAFFDGFNNFPGSHWSWQINMGKTFGKPGGLENALEVGQKVMDVVQDKLETFEIGNEPDLMARIFSHRPADYDMDDYVSEWLDYANATSETVLKGNKYGLEERRLFQALTFAGGENPVWNIQEAWKSGVDEGGSVKTITYHQYAASNQGWVRLKNSYMNHTANAANVTQYNNASNFAHSQQPPLPFILGETNSNSWNLNMEHVSGVFGSALWLIDHLLLGMVANMKRYNLIQGTVFSYTGWVPVEHLGRPPHVRPPLYGQIFAADVLGHHPEVKVYEVLKLPWNMAAYGIYESDQLERYVIINFEEYNATASYKRPVREHILKVPHGVKSVRIQRLTAAGADALEGITWSGQSRNYTAGRLEQHGKLKFETAKAHKGEVKVKVPSSEAVLVHLEGKRGRDLGSD

SEQ ID NO: 2635 - protein, 681 aa, Unknown
  Kingdom: Fungi, Phylum: Ascomycota
MAPPVRANQGALAATACRLCREQKVRCSHEQPTCARCSKLGLECAYPEPPDRRLIAARREQSKKRPAWDSRDSSSLQAGQQKRLRSVPDAFEQDPRPSLQSPMLAHEAGIIKSLPEPSSEASQLLQTAYFTSTFNSSLTFHYPSFKEDEANGNVPRHTVLAMQALGANFIIPLSSRGKQHYAVMRHLDDLRSAADSWALAAGKLALQEADEPTLYMGGLSTKYHVFCAADTLVWTLPLPISDTAFLQQKEEPLATISTAFATTQSSSKRPAREPSIMAEIMKCLIIWARIRDHIDLRRHFPEKEPWHNIYSIQRDIDVWRRQLHPDLRYSKRNLYHQLVVKQQQTYIMFHAIHHQSLLVLNSALVPHFSGIPMPQDMPFEVVRVSAAMVLQSARALANISAHLVALEWDPTQIAPFFGYCMYASASMQISALPRRRGTGSQAWESLTNCMKLLKIMKPYWAVLERLWTRILPLYETQIANFRRAAATSPEASRGTNEDEDDNSTAAAAEEEEFLTSPKEDNGNPHDSAETSALQYSLRTLPQDAPTSSDRSSSRVRDTTSVPAVNSDRAATLQNGVTAQAVLTSPDSAQHQEQDQEQNLNTNAATASSMPPLPVQMHSIPQAQLYNQGDEPSLPFETFHIAFQDSFPSLDALGMTGLEDNDWLQLDMDSSLQARQAFNHLF

SEQ ID NO: 2636 - protein, 1016 aa, Unknown
  Kingdom: Fungi, Phylum: Ascomycota
MSGFRPSFSLLVGLIVLLGLAGKAHAFGAGNIASLSKVEGQNWRHGDIEDALLTLAMAKGIGGKKFNKIMVSRVYFGNWLRDYSQAIDVGTVKSVSAEAIRLLLCILGFLSFGYGSGEFEVTAERLGCYRPEDHIDNPKDYAENQDARKYDRRLRGPVDERRELSIDPRSGMKNYIANEEAGIMTSAAHVRNLFGRCIELGRRYKDRNNKEDLYESLRLMGTGLHCLEDFFAHSNYIELALIELGERDVFPHTGRRTQMQIEGVRNAVYPLVTGTFGGVDFLHSVVGEVSDKMTQNEIQELEGTLKDSQKADTSMLRDLLDKIPDGIIGGSSSKKGDRIDEIQHDAQASQLQNMQVSPREPEEFTQYVQGIFKQIMPVIEFHDEVMQGISAAFEKIPILPKIVEQLEEQLTQFVFSIMAPFIVPLIRQLRAELKTGSDEIIQSSKNEQHIVFEKDSWTDPTHSMLSKDHFSNILNEPAGQGGAKMLHWVVPQLMNAIDDDRANVDGILNDIIYGVLHHPAQRDQGSRGQREGRQRIFTAIKEWWGEMPDRQRETYRRALSTEGVEQGRNHKEGVHDTGHGHGCTGKLKMQKLYGQPETLEDKIAGKAADAIFSGATSAISGIIKSETGFDMPSGNSGRKDDRKDDSGGLGGLLGAAGSLLGGAFGGDEKEKQSSRKEYSDGSVTRTEREYGHSGDKYGQAEYRETKHPDGSRESQYSRYEQRDSGGKQTSGRGYEEQTETHRTSGGGYQTHTERREYSGQSQGYGSGGNSGGHGGSSGGYDSGRREESSSYGGQSGGYGGSGGGYNSGRREESSGYGGSSGGYGGGQREESSGYGGNSGGYGGGQREESRYGDSGRETSSYGASGGGYNDSGRAEPSYGSSGHGRQEADYGRSSGGASYGGGEERHGRSEHKKKKKHRSRSRGGRDSDSTDSSDDDKKKRHSGGRGGNTYGGGGGYSGGSSGDHRGSGGGYGGSSGGYGGSSGGYGASGGDTYGQSGGYGGSSGGYGEERHGSGRY

SEQ ID NO: 2637 - protein, 307 aa, Unknown
  Kingdom: Fungi, Phylum: Ascomycota
MAPRPIFAATHPRACSTAFERVFMTRRDTMQSMHEPFGDPFYFGPELMSERFREDAEHRNKSGYGGQTYKDVLNEFAQAEQDGKRLFIKDMAQYLFAPDGKHTPIAESLGGGDETGNPTVLPLSVLKQFTFTFLIRHPRRSVPSYWRCCVPPQNEITGFTHFMPNEAGYLELHRLFDYLLEQGIIDRNQVVVVDADDMLDNPEPTIKDYCQRTGIDFTPEMLIWNDDDKEHCVERFEKWAGWHDDAIESDKLRARTHAQKSSTVESENKDWVNKYGEEAQKIIRATVDENIPHYEYLKQFCRPVQQQ

SEQ ID NO: 2638 - protein, 626 aa, Unknown
  Kingdom: Fungi, Phylum: Ascomycota
MGLFTRSKIASTTQDHRHPHDYQAQYPYQQQQYPQNRRKFSFTDPPNVYLPPAAPPPPTRPYKHHNNYSQPAFRPAGYLPPPPPVDWTAPPAMIMSAGVNSMQQMATGSSSKWADAVGEIAKTVSAYDDISKRFNDVMTMIDCECLDGSEMDLFSCSPNPSDGRHDKSRDKHRQARREPRRTKSVDDLEERALFKPSKKAKESEVKKHHSGDKTKASKEKSSDKDKDKVQPANVAASVVAGTYFSKVECYANARLSSNLPPLSLYMSTWPLLCLAAQFSQSVYERPRGHEREAHVPSDWRSGTKAMRIKSVPMDSMNTIVFAIRGTASFMDWAVNLNSAPVSPQGFLDDPGNLCHQGFLSTARSMVAPVARRLADLLEENPDRSRYSLMITGHSAGGAVAALLYCHMLSRTREARSELNAMTDRFKRVHCVTFGSPPVSLLPLLKPSRPELKKSIFMSFVNEGDPVVRAEKPYVKSLLELLASPVPTPTTSRNKSDHEKTRESGKGERKGRSKTEDNRAIALKRPSRPILKHSSTLPSPSKPTWRVPEATLSNAGRLIILRSGTPDAKAKDRKTVGERLDEGVMAVTCKEEQLRGCVFGDPVAHMMALYAGRIEILAVGAVTGRVG

SEQ ID NO: 2639 - protein, 225 aa, Unknown
  Kingdom: Fungi, Phylum: Ascomycota
MATTTQPFRLRPGTWADLPRAATLYSLAYDHDMLMDLLFPDRAKYPEEFPVAICRLLEVRYWTLGWRFTVAVDENDVPQGFTWWNRGKSFESFWKRWLSPTWWFAPMVRLYFKTRNLIFPLRLRINHFFAQVVGKETDKFLNTPRRRAAHYFSLVGVNPKFQGSGLGSMLIRDGLRDVDAAGAAAYLVRLKGLKEFYERFGFKEDGTVAVGDLEKWDGGQIMFRE

SEQ ID NO: 2640 - protein, 432 aa, Unknown
  Kingdom: Fungi, Phylum: Ascomycota
MLASHRDQENLVHSHQVPTKQNPKTPGARYPKTPSRFKDENAPSAFAGKSTVGGPLGGQEKAVNKGVAGRQALMTPMGNPSRAVLGNKTTNAKARAGQTGGVKGLPKDLEKPTAKVTTVQKPRQRAAEVAPIKFDVKQDKEESQEEEEEEEPEYAPPPVEPQPYESDVLPLGLTFEGLKDENLLRGYYDYYHNPVDANGISRKDKQLEEEMERLVERATERNERDLADLDWSARKDTDAAAKPQASKALAPKPSATMSSLHRNPATITSRRAAAALAQAPEIKKKPALRTTAAPTARRPLSSLIRGPQPKRTVSVARDPPAGPSATVASRTTLGYTKGRTASSVVHPRRNAASATSKTSNDLGVADEMSEQTITPARAKAALRRGPAPINPTRPQFLSIFDGHDDDDDLPPQIIPQYLLEDDDEDFELRLDI

SEQ ID NO: 2641 - protein, 171 aa, Unknown
  Kingdom: Fungi, Phylum: Ascomycota
MANLPSQHPNLSLHLTDHTLHPLITSSSSNTHLNSLTLLTTSALTAQTAIQRAGLGRPQRIMVEYPDRGPVVLQSYLDSPGTGASSTTAAAISSSAIPSTTNTGEEDEGSTAATKAEEPAPMLVSVVVAGSADEAREARRAAGRLERVGREFQKEWAGEAIDRDASQTTTE

SEQ ID NO: 2642 - protein, 272 aa, Unknown
  Kingdom: Fungi, Phylum: Ascomycota
MSSPWIFISPSSRGIGHALTRHLLRTTSLPILASTRNSDPASTKSSLLKDLPQAEDIAPRLSIVQLDVTDESSVAAAADRARELFPSKTHHLRLACAIPGMLFPEKNPKQINMEKALQTFQVNTLGPLVLMKHFAEMLPKQSVELEPSPKDDQLQLSDSHALWLNMAARVGSTSDNRAGGWYSYRASKAGVISLSKSLDRYLAARNGEKALAMAYHPGTVKTGLSKDFWDSVEGGKLFSPEDAAAKMASVMTGLKVDQRGKCWDWKNEEVLP

SEQ ID NO: 2643 - protein, 89 aa, Unknown
  Kingdom: Fungi, Phylum: Ascomycota
MLDKLVGLAMLVATTVVFLYYTIWTLLMPFVDDDHPLHSFFPPRVWAIRIPVILILVGSAVVGSFLAMVMIRSNRKKAAKAKAASKKKA

SEQ ID NO: 2644 - protein, 521 aa, Unknown
  Kingdom: Fungi, Phylum: Ascomycota
MSFLEFSSRGRDSISTQDSRQSPTPLTSQDLRRSSIGASRNTPNNNTRPQNPVCIDLTQDDCCSSNSESDLPDYDDSSSTNEHRHLVSSQRLSKSHPSTPVAPQNARQPPQSRSDTQEKDKQGGAGLCGQASNIGLRILPSDTSEQVQIERADPRTRSPQQQVTVNPASRPSSDLRRSAINSLERSYSAAQDQSESVDRSLSSQGRVLQPSPLSALTHQATRQPSHQDNTAVCTSQSVSSTAPKLGSTCILRERPRFITPPGRDSSSPESDPEVPQVTSTDERPSKGSAAIEPSSPRPVSRADPDVPPAKDVPQVKDVPQVASTDERSSNGTAVLEPTPRQPVSRAEQLRQRRLESFDSNAFDAAIYQQEGTNPPAGLQIPITALRQTIPLPAFAQKQALSPNRYIHGMHPPLPVADQAARDAEIAARGGRKLWYRRVAARQAMRIQKDRSVPAWQRPRIAFRVRDIGFLTEHELPKEVRENEGWMDFWRWYRQGKLEASRSLRRQRKAGLPSGCNLGRST

SEQ ID NO: 2645 - protein, 612 aa, Unknown
  Kingdom: Fungi, Phylum: Ascomycota
MASLGIVAPKPQSLVNLTLPDGQEDCDPHANLTLEPDRDIGGRGVIASFVGSGCLALIIVTIYYLFVFDPKVTQFPDRKRTFNKRRTTSLSTHETVRWAADDYVPPNPVDEYMYELQVRLYRTVKWRPSWLPGKPKIEEAFRRCILGLSDLQILTGLCVLIAGFSAIETISAYYWQLIVYVAWFSNLTHQCGLIFLRRYLHRKPWERGWRIVLITVLIILLIIAMIPSMYFNWHDNGIYDLLSRPASAAQPATPMKCFYNHETRHYMHEKTFGHPNTPLKFAATRAFQNVLISLVFLITSYMTRVIKLFNSSSTFFRYQVRGRAGYSIRKFFAWALCKFDAITQHSIGPQAWFLFIESPLLTLYFFFRVLLDIYASVISDVGWLYAGTLLGMWRLIAEKEAELDFVEDPAAFKAEDRLMDFGQLLPLMLLASPIFATIGTFSHRSVSDAAVPSERIRVVEGLDDANQQAKAIVASNRNFDLPQTDTALEQPSVKDKFNRWNRIHHILEDEKYWAAPWFSSALFTVCIGELSIFLVVYINLVISRGARTVFFQGLLAIVSILPLSTLPIQIGIALRDWSDKKVARLCWTITAPILGTYAWVCYRYAVAGDFFT

SEQ ID NO: 2646 - protein, 579 aa, Unknown
  Kingdom: Fungi, Phylum: Ascomycota
MSRTAVFTKGAPPPSPHLSQAIICNGMVYTSGSLGVDPETKKLASGAYEQTKQVLNNLKAILEEAGTTADNIVKATIFLSSMEHYAAVNKAYLEFFTQDPKPSRTCVAVAKLPLEGADVEIECVAALPKVKGILSRLVPPPPFHQLIVAVLPNKTQDGTETQHTLETWAHATHLAAMDLAFNHIEDSYVREQPSDDPSKSNQHASTLTEDIQETYKAFSASPWGAKIGGFLGTVRKQGESVYTQASKELAEVGEDATKGFNEIKESLVSHTRNLSINTATAQGSGTDGDDTQATPTGSRAATTQGDSAAESENMLSRLRAEAAKRLKDLQKAEDAADEALLKFGSNVRDFLKDAITIAPPADDAQGSTVLFESKDAQGKRVVHQSRYDAQLHVIHTSAESFTKDPGPAEYAEWTKEFDVEKKTDDISADLEKYPELRTTMEKLVPDEIPYADFWKRYYFLRHSIETAEARRRDLLKAAAEEDDVGWDDDSEDDDETAEKATEEAKPASGTSSTTIQPPAQPAQEGLLKPNEARKSNDEKSQADSEASYDVVGATSGKTSQAPNSPKDTKKSDDSDDDWE

SEQ ID NO: 2647 - protein, 579 aa, Unknown
  Kingdom: Fungi, Phylum: Ascomycota
MAEVAAKFKDLNPFRSKEDDDDQGEQIDFQTLGGAGHGHRDESHKKDVRVSQALKQYLAEKKILSKKDAGFGDEALTPALSQLVKSPHIQVPRECLDRTHPLPEYWISSSHNTYLLAHQLYGSSSAEAYETAIKTGSRCVEIDAWDNSDDPLEPKVTHGYTLVSNVPFRSVCETIRDCLDEELAIAQQDPTYSPTAIMISLENHCDAQGQMRLVEIMREVWGNRMISKAVRDQGSREEAGSGEHVTLQELGPRIAVIVEYHFDGEKSDSDSDSDDEADQEDEKKARKEYKEKKKASTASGIIPELAEIGVYAQSVKPVDNSWYEADEMVNRPHHHLINVSESGLSSHLPDHAVPISTHNSAHLMRVYPKGTRISSNNLKPTQYWGIGAQICALNWQTFGAANQLNHALFVGSDGYVLKPPGLRHGGNGTSGTGRKRKLILHVAGATDIPLHEDREAESIKPYLTCTLFHPGLMGKDPPKRKTAHYKPHKIGWLHKGENPIPTEPIWDETLEWEYADTEVSFLRMLIKSDDSWARNPMFAVTAVRLQYVVPGWTFVPMLDMKGHETKCTLLVKFEFADAE

SEQ ID NO: 2648 - protein, 559 aa, Unknown
  Kingdom: Fungi, Phylum: Ascomycota
MPFNDSSYYAELPTTGYANYEYTDPLYDASVVTNATSDTSYAHNGLSYVQPSVFISPQTNSDMTAPTATLPSMQSLQTQARLLPIAPRPSAVPPVVPQGPAPAGAFSCIGTRIRRRYNSEGLSKVNKVREDGACLRCKLYRIGCDRERPCSACQKVSGSAKISRGPCINPRLDTVQAFRAGDGDNGTFLPTLPNLKWVSQTQTARSKLGATFTPVLEHQSESSLMPATSMTIEITWPFNARIISKCPVTRLDLDRFEPNGQSLAEEWTPVNAGETRMVKLPPLACRDTEAASKAIESFLDECQRPLEQHISGMLHDPILKLTWTEVLRFRDTSRNPALTSAVRMYAAVLMNTRYPKSVRANIFDVAEEPEPPFFFEGNLLPPQLTYQIQMLIAQSQIKMQSDVIRALKHLMFPKRHEQWYMVFLITFVLLSCIELMHHNQTSFLQLKRKNSETNRINVSNVTRHMLGEWEDSAENLINHFRYVTRGNILFSQQGSSFERSLASSKLDHGAEAYIKRMREVTSGRIGEMLGMRESRKGPGERQNMWAICELFLPEDTNLP

SEQ ID NO: 2649 - protein, 1173 aa, Unknown
  Kingdom: Fungi, Phylum: Ascomycota
MDELYRPNHQPSQPSRCPAQVMDFEHSQEPPNKKRRFFQDPDDLSNETEPPIHAQNRQPPIDSPDHFFKQEEEFERTLVERPSFSSRDVDSRVDSDEVEASRAGLKHESSNVTFDKETFESFIGDSIEPSVLEVIRDNCGDNLERAVNMYFDGTYKKLKKKSISRPSGRGSAGSSSRSMPVTNVASPFEAPPRRPVPSSRYIGAFGVEGWSTRSGTDILKHGDVVKIERQKIQPLKPPKVKGKLGMTPQSARKGFPASTRVDVIVRFTNRDGMEIGRLSKDTASWVSTLIDQQMCEFQGTCVYAPERLRTNDTVFLQLKCFLLKTAFHKRGFQLADDRSTAFYEQSETADEKTLRLRQVALVRLMQEVNLQPSMANAASADSRTGLLQAAERDEQKQQEAKKAKNDTKEPGSSTPSEAEDGEGEELEQDQLDALYKKAQSFDFNTPEAEPAESFALQLRPYQKQALHWMMSKEKDEKNNREPSMHPLWEQYQWPTKDVDDQELPQMEEQVHFYINPYSGDLSLDFPAQEQHCLGGILADEMGLGKTIQMLSLVHSHRSQIAQEARTSNGGLSSVNQLPRLGRNASSVLDAPCTTLVIAPMSLLAQWRSEAEKASVSGTMKTELYYGNEKNANLQALCCSANAASAPDLVITSYGIVLSEFSSISAKNGDKSSHNGIFSLNFFRVIIDEGHHIKNRASKTARACYEIAAEHRWVLTGTPIVNKLEDLFSLVRFLGVEPWNNFSFWKTFVTVPFEAGEFVRALDVVQTVLEPLVMRRTKDMKTPDGQPLVPLPPKTVDIVNIELSRTERDVYDYIFSKVRKSFQQQVEAGTVMKAYTTIFAQILRLRQTCCHPVLVRNRDVVADEMEAGAAADAATGLADDMDLDSLLAHFTAETDEASKDNKVYGAHVLEGIRDEAEKECPLCFDEPMNDQLVTGCWHSACKKCILDFMQHESDRGVVPRCFNCREPLNNRDLFEVIRHDDEPEAAAQKPRISLQRLGTNSSSAKIVALLSHLRQLRREHPKMKSVVFSQFTSFLTLIEPALAKANIKFVRLDGTMAQKARAAVLQKFTDASGFTILLISLRAGGVGLNLTSAGRVFMMDPWWSFAVEAQAIDRVHRMGQEGEVIVKRFVVKESVEERMLRIQDRKKFLATSLGMMSDEEKKVQRIEDIKELLS

SEQ ID NO: 2650 - protein, 130 aa, Unknown
  Kingdom: Fungi, Phylum: Ascomycota
MPSDDYAPLGGGGALKLKGAKVDKKKKKKKKSKTDLVKNISGPNPDESSSKPKSPESVTEGREQDDAFVPQKTEAEQRHEEIRRKRLLEMAEKSGSRPELLKTHKERVEELNTYLSKLSEHHDMPKIGPG

SEQ ID NO: 2651 - protein, 200 aa, Unknown
  Kingdom: Fungi, Phylum: Ascomycota
MLLSEDPDKLISHTVDNFNIEPDKLAVSRITESLSTLQQARDLRVNDAHSTLKKLSRHLHTLSSQHDDLVSASNHGADHASRIARLDTEKFRTAKAASDAEIEAERLALKHADLQARLQELELQGVEGDEAGRRRDPVDDEVLLRLKVYRSLGIDLERDERDGEWTKAVVRNDRKGDVHVVNMDKKFSRYFYANYFWQTL

SEQ ID NO: 2652 - protein, 446 aa, Unknown
  Kingdom: Fungi, Phylum: Ascomycota
MHTPTVAVSAPGKVLLAGGYLVLDRAYTGLVFGLSARINVIAGEIHSSPGVQVTEIVVDSPQFLDAQWRYGYHRAGEDGGISITQLRVGEQTSRNPFVETTLSYVLTYIDRLTGQQDKHKLTSARLIILADNDYYSHTNNSSSAGGSETSEAGRFAKFGVPLSGANKTGLGSSAALVTSLTASLLVHYLPSEKFDLTSATGQRTLHNLAQAAHCAAQGKVGSGFDVAAAVYGSCLYRRFSPSTLSSIPEPGSPGFSETLAKVVDSDWDVDVKSDELAVPAGVTLRMCDVDCGSQTVGMVKKVLAWRAQDTDKSKKIWDDLQERNEALAEALSSGNTASLPEKMTAIRELIREMSTLSDVPIEPSSQTELLDAVSSVEGVFGGVVPGAGGFDAAAVLMRDDDETKERVEQFLAKWSAEKDSRVKLLDVKGEMQGARRENLDVYKGWL

SEQ ID NO: 2653 - protein, 2202 aa, Unknown
  Kingdom: Fungi, Phylum: Ascomycota
MSDQQRDVSQYKYAAMSNLVLQADRRFVSRRNNETTGDPESLAGRLSIRDMGGRGGREEVPKPKRQPGLPDVQRGSMQEGEDILLREQKRRKGEAPQMRGAGVLGFNEPFVEGIQYRPRTQATRATLDLIMSIVRNAMGDAPHDAIRSAADVTLEYLKDDDMKDLDKKKEIDDALDISLSPKQFNELMNLSKKITDYDAQDDDEDAEMAGADGEDAEMDERQGVAVAFDEDEDEEEGGIVNEVRDESSEDEAGEDEEDVAAADGDDDLALEQDEVVLDAGDSKGSADDKDKLTIPAREIDAFWLQRKIGTLYQDVHEQTDKTKRALEILSGEPDEPDGEPKTLGDIENDLMELFDYDHNKLANELVHNKDKVYWLTRLAGAEAAEERATIEREMVSEGLQWILNELRGTVTDEKKKADIKMDIDVPASFTEAPKTERAEGQLVGGLQPKRTIKLEDLVFHQGNHLMTNPKVRLPDGSTKRSFKGYEEIHVPPPKKRNDPSDTLIPITEMPEWARGPFGTTKSLNKIQSKCYPTAFQDDGNMLICAPTGSGKTNVAMLTILRELGKHRNPETGDIDLDSFKIVYIAPLKALVQEQVGNFGKRLEPYGVQVSELTGDRQLTKQQIAETQIIVTTPEKWDVITRKATDLTYTNLVRLIIIDEIHLLHDDRGPVLESIVSRTIRKTEQTGEPVRLVGLSATLPNYRDVASFLRVDPATGLHHFDGSFRPCPLRQEFVGVTDKKPIKQLKAMNDVTYNKVIEHVGKNRNQMLIFVHSRKETAKTAKYIKDKALENETINQILRHDAGSREVLNEAASQATDKDLKEILPYGFGIHHAGMSRIDRTDVEDLFARGAIQVLVCTATLAWGVNLPAHTVIIKGTQVYSPEKGTWVELSPQDVLQMLGRAGRPQYDTYGEGIIITTQSEIQYYLSLLNQQLPIESQFVSKLVDNLNAEVVLGNVRTRDEAVEWLGYTYLFVRMLRSPGLYQVGAEYEDDEALEQKRVDLVHSAAMILRRSNLVKYDEKTGRLQSTELGRIASHYYITHGSMETYNNLIQPQITTIELFRVFSLSAEFKYIPVRQDEKLELSKLLGRVPIPVKESIEEPHAKINVLLQAYISRLQLDGLALMADMVYVTQSAGRILRAIFEIALKKGWSSVTKTALDLCKMAEKRMWPTMTPLRQFPSCPRDIVQKAERIDVSWSNYFDLDPPRMGEVLGMPRAGRTVCGLVGKFPRLEVQAQVQPMTRSMIRVELSITPNFEWDDAIHGTAESFWILVEDCDGEDILYHDTFLLRKDYVESESNEHIVDFTVPITDPMPPNYFVSVVSDRWMHAETRLAIPFHKLILPEKFPPHTDLLDLQPQPTSALKLESYINLYPDWKHFNRIQTQTFNALFKGDQNVFIGAPTGSGKTVCAEFAILRHWMKEDPGRAVYIAPFDELIDARLQDWQKRLSNLRGGKEIVRLTGDTATDLKLLEKGDLILATPTQWDVLSRQWKRRKNVHTVELFIADDIHLIGGNMGYVYEIIVSRMHYIRTQLESSMRIVALSVSLANARDIGEWIDAKKHDIFSFSPHVRPVPLELHIQSYSIPHFPSLMLAMAKPTYLAITQMSPNHPAMIFTPSRKQTRMAARDILAACAADDDEDRFLHLDEQQMKPFLDRVQEEALAESLSHGVGYYHEALSLSDRRIVKYLYDQGAIQVLVASRDTCWELTSTAHLVILMNTQFFEGREHRYVDYPLSEVLHMFGKALRPSGDGRGRGVLMVPQVKRDYYKKFLNEALPVESHLHSYVHDAFVTEISTKMIESGDDAINWTTFTYFYRRLLANPSYYGLTSTTHEGLSNYVSDLVEDTLKELTESQIIEYDEEDGTVAPQNAAMIAAYYNISYITMQTFLLSLSEKTKLKGILEIVTSATEFENIQIRRHEEGLLRRIYDRLPVKMKEPVFDSPHFKAFVLLQAHFSRMQLPIDMSKDQEVILARVLSLLSAMVDIQSSEGRLNTMNAMEMSQMVVQAMWDRDSPLKQIPHFTPERVKTANDFEIKDIFDFMEAMNPEENPQYKNLIKGLSMSQKELAEAANFTNDKYPDLELEHEVLDEDEIIAGEPAYLAIKIARNLDEDDSEFDATVHAPFYPSRKTENWWLVVGDEKNKNLLAIKRVTIGRELSVKLEYTVPKEGEHDLKLFLMSDSYIGVDQEREFSVKVAEAMDVDDDEDDEDDE

SEQ ID NO: 2654 - protein, 173 aa, Unknown
  Kingdom: Fungi, Phylum: Ascomycota
MIPALSQGKQADVGCDVRVQVASFDAKFALEKKEKGKLQTRKGREKAIIELTNGAMMLPPTASSALWCELLPKLSVCQRKRLVLKTSIHRPDHHQHPDYPPIRTGTAVNTAIMSWFGVAPMKKFNAPFFKPYWPFFAAGLVIAYGANSAQNAMSNSAEFKNDPRNPNRSAGGH

SEQ ID NO: 2655 - protein, 462 aa, Unknown
  Kingdom: Fungi, Phylum: Ascomycota
MSYNPRMSIIPTSQQQSRSRKKEEEADAFMRLPDREIVGCITDIGIPFTIADLQKPNAAHIQQIFEWFAELLLNATRETVEPAMRAAAEDVCQEFSEVIPNDTRNLMGFYVSLRRLLSECGITDFSFNDLYKPTYDRLVKIFSYLINFVRFRESQTTVIDQHFNKAESTKTRIEQLYSENQENEGRLEEMQHKRKAMEAQVKDKSMRNEEIKKRLLELRRNQERVAARLEEAKQKKGTYTALLEQKTQEKVTLKQESNKLRPYMLQSPLALSENLNDLQKILSNDRSHIDSLDRRARALQTSSDTFGTVSTEVAASIKLLDEIAAELAKEEDEIARKTKQRDALSDRHNNAKEVERAKTLLNRQLEKWSERTTKLREQAAAKAQEAKERMLELKAMHESLHKERAEKDQDMEVRKVRIQQTELKMADLRTKTKNEVDKAREEYLKMESHIKLYITEMEQNIS

SEQ ID NO: 2656 - protein, 419 aa, Unknown
  Kingdom: Fungi, Phylum: Ascomycota
MSALPRGVKNVLTKSPSDVVILSSLRTPICRSYKGSLKDAYPEELLSTVLRATLEANPNLPPSVIEDVAVGVVLSELGGSKAARMAMNHAGYENTTSLYTVNRACSSSLQAIGNVAAQIRTGMISVGVGAGMESMTRNYGSRAIPVDLWPALKEDPNKDVRDCIMPMGLTSENVAERYGVSRADQDAFAVKSHASASKARSSGAFAQEIVPVTTRFQEVDKQGNKVGDEKTITVTQDDGIRDNASIEGMAKLKPAFKPDGASTAGNSSQVSDGAAATLLMRRSTATELGLTSSIKGKFVSAVTVGCAPDEMGIGPALAIPKLLRQHGLVNEDIARWEINEAFASQAIYCLRELGLEGAWEDGKVNPDGGAIALGHPLGATGARMASTLLHGLARDGGEIGVMSMCVGTGMGMAGMFVRE

SEQ ID NO: 2657 - protein, 570 aa, Unknown
  Kingdom: Fungi, Phylum: Ascomycota
MKFFNTRRTESEVPAEVAIDTLDEEGARDDGKPAAIETAMPGARGIEAAQALWGKTGRWLIIIGLAMMMITYELDNSTVYVYNNYSTSSFNALSKLATLSTASTIVFAVVKAPIAKVSNVIGRGQTYVFTVSCYVLAYILMASAKSINTYAAGVVFYSIGQSGTNTMNDVIISDITTARWRGFGIGVSFFPFLITPWVAAFIVEIVVDGIGWRWGIGMFAILMPFGASFLITTLLYYQARTKNMGLIVSKRPTVYEFCSQIDLGGIVLFSGGLAMLLLPLTLAATSPSRWNTPYIIALIVVGALFLIALPFYEAYVAENPIVPPSYFKNITISLCMLLIALDAAGFSCTHTYLFTWATVARKFGTRDATFFIYTNGVTQTLMGIVAGLIMAWTRKYKYLAIVGAVIRLVGYGVMIRLRGAENSKAELFVVQLIQGIGSGIIQMTMLIPAQISVPHAQMPQMTALLITSLIMGSSIGACISGGIYTNTLKPALWDHLGDQANETMVDSLFNSITGVVPEWGTPERTAVNLAFSDVLRYMTYAAVGTSAPGVLLTWLLPDHTLPERNNLVEK

SEQ ID NO: 2658 - protein, 401 aa, Unknown
  Kingdom: Fungi, Phylum: Ascomycota
MGLDEQQVRAHFPALAQDQVFLDNAGGSQTLGPVIDSITAYLSRTNVQLGASYAIGKEATSRYSDAYAAGARYINANVDDIVFGSSTTQLFRNLSWSLEFQPGDEILISALDHEANIAPWVDLARRQDLRLYWWKPREHRSSPELTAEALRSEISHLKRLRLVTLTHASNVLGTIHDIKAISKVAHDFGALVCVDGVAYAPHRPIDVQDLDVDFYSFSWYKVYGPHVAMLYSSWPARQKVRSLGHFFNPQQTLTDRLGLAGASYELLQSVPQVVEYLGAHDSERWKDVVAHEEQLQEELLSYLRDRSDVTIYGRSDSDPARRVPTVSFTVKGWDAKEVVETVEAQTNYGFRWGAFYSERLVRDVLSLGPSGIVRVSMVHYNTVEEIKGLVQALQEYVPART

SEQ ID NO: 2659 - protein, 312 aa, Unknown
  Kingdom: Fungi, Phylum: Ascomycota
MSLPAHVTPKRKRDEEDNITISPLKFSFDSSLGQDARDGSNSPRSKVAHRFRGLGLYEGDVATGSGGGVGASGSSQAQVDAEADQVAKRQRHDECMPDAEEPPRIVSELIRLQPGDALGITDHHGKTVPQPAPVRDEKLQHQQEQESRNSSEPVPDLTDSVVLGKKRAGTPPLRIKKLTPRAQDTSSDIVDPVRAALTWHEDEITIYDPNDADDDGTGINGVGFKPTAAIAHARVMKRRQQLAEYKRREESDARARRNQKRRGAGQSQRGSLVAFSSPPSSQADAEAGEGDRSPRKVRFTDNEGSKVAITTK

SEQ ID NO: 2660 - protein, 406 aa, Unknown
  Kingdom: Fungi, Phylum: Ascomycota
MGLKPPTTAMRAANKLKRRELYVQHKKASDKERHESRHRRRKEEAMDPELKKARLAKNKPKTLDEKRVWDDVDDDRLGAVVDLEHLRRKRIEQAEEEEEKSLEGEEEDDDDDSMLDSDEDEEAIQAAMERKREKRAARQNSAAPSTASTNMDLTPSSLALKFPTLFTEVPPPNPKILVTTSLNSTIHEEAHLICEMFPNSNYIPRSSHRYGHKYSLREICKFASNREYTAVVLINEDMKTPKGLSIVHLPVGPTFHFSISNWIEPKKLPGHGNPTNHYPELLLNNFKTPLGLLTAKLFQTLFPPRPEFQGRQVVTLHNQRDYIFVRRHRYVFRDKRETEKSIVDGDGKEVKGVEMIRAGLQELGPRFTLKLRRVDKGVGRAGSEGDDALQWQWKAKMEKDRKRFNL

SEQ ID NO: 2661 - protein, 734 aa, Unknown
  Kingdom: Fungi, Phylum: Ascomycota
MNPVGHQPTGSSDAAAALRGASLAFQNKSLQAPTTPNQKKDNGALTAANASSSAASRSASPSKRLGLQHTGGSNVTDTEGHVYNSGARLGAGGGIGASGGHLQPRVDSKSPSFIAATLAASRSASPSPMHRTPRRVGSIGSTASGGDAVDSLSIAPTTSLISMFERGKDGDPVKRASPRRIPTDTSEESLPETWRAPVKLPGIAKTQSISAKQTQTLGNTMNDSTRANTRPASTSQQPKAVARTFIADVAGSRDLKTQQNIARGVDDSPSQKLKPYTRSTPAPVKLSQEDSTLPDSEQSQPSITKLPAAKAKPTPQPPTKAKSQPVLDSTSTPKRQLTTHQPRGKAQRPQTSPKPVKPKPAPLSTVPRVVSYSTPEVLSPKPTRPPKPALQISRASPVKSANTSTEPQRTSSQRQKPPTPPKPRGTSNKPTPVVTSTRFVKSASDMGTGEHHKPKAMAMVHQGRDRSDTMSTDDSFVSASSYQSLDRLSPPSLPLRRGSITPSVASAPISPSRGTPRPHNNSSASLGLSNLTNAIMAGSLASARLTPHNTGSSLPPPSLPRRQKSPHLRETMRKPASTEPEEDGRHKPHKHKLSRGKHAHHEGSRKRWRDQITPRERKRYEALWASNRGALLPPTVTSSNAGMTSGGRDRDTTELVVNIVVRELWRRSRLPEDELAEVWDLVDKERKGWLGRQEFVVGMWLIDQRLKGRKIPRKVSDSVWGSANGVRVMKPKSK

SEQ ID NO: 2662 - protein, 478 aa, Unknown
  Kingdom: Fungi, Phylum: Ascomycota
MAPETITAESLPDLLKDDTKVKLAGLDVDGILRGKLVSKKKFLSVATAGFGFCSVIFGWDMHDQTYLKELKISNAENGYHDLLAIPDLSSFRRIPWENNVPFFLITFHDPDTQKPISPCPRGLLKMQLEKLQKKGYGAMAGAEYEFYTFRNPDPTKASPAEFLLQNPPHQLPSLTEGMFGYSITRPVHNQDYYYDIYDTCTAFKCDIEGWHTESGPGVFEAALEFGEIAQMADRASMFKYVVKSVGVKYGITPCFMAKPKSGLPGNSGHMHVSLVDKDGKNLLARETPDENAEWGDIANLSDIGRHFLAGLLEGIPDIMPILAPNINSYKRLVENFWAPVTVSWGLEHRAASIRLIGPPTAKAGATRFEVRVPGADTNPHYVMAAILGCGWRGVEKKLKIPCAPLAAGQNVGGDADKGERLAKSLKEAVVKFKAEGSVAREVFGDEFVEHFAGTRENEVRLFDEAVTDWEMKRYIETV

SEQ ID NO: 2663 - protein, 277 aa, Unknown
  Kingdom: Fungi, Phylum: Ascomycota
MRSILRITALAALLALTTAQTQDVTTDEGKYDLENIKGPEINADVGTNEGAKTAVNETTGGGDGLEIGGKGNIISGGQTNAEGSYNGYGNLNHDINSSYNGNTIINNYATAPKVVCIGDWCAEDPPCEDEACKHQRVVFQDGIFQTEVSDDMAWNRLVRCEGARCHYNRCNDEECEQKIVCVNGQCSQEKCQDDECLRKLVCEGGQCQHQPCEGNECGNKYDLEEGEYRICPTCKGAKCPRPQLPGSDFLTRVQTDMQRQALGKHTQQVVINIELCT

SEQ ID NO: 2664 - protein, 294 aa, Unknown
  Kingdom: Fungi, Phylum: Ascomycota
MAQNLTIKSTLKLNSGYEIPRLGFGVYQIPKEQTTGAVKEALKQGYVHIDSASGYYNQGQAADGLRESGVSRSDVFFTTKVFTREKPLGYQNTIDSLNAALEETKFSYIDLVLIHAPYGGPQARKESWKALVEYVEAGKVRSIGVSNYGVHHLQELEGFIKELEEERGGKGKGGVISVGQWEVHPWLTRPDIVSWCRERGIVIEAYCPIVRGERFDDPKVQALAKKYGKSPAQVLLRWSVQKEFVPLVKSVTPSRIEENAGVFDFELTKEEVNDLTTDEYSPCAWDPTKTPLEG

SEQ ID NO: 2665 - protein, 284 aa, Unknown
  Kingdom: Fungi, Phylum: Ascomycota
MSHDLQSSFLTTPAGHKLQYLSTAKKATPLICLHGLGGSTNTFLPLHPEIPSNFRFIAVDFPGFGQSQLSNSAPPASVSGYVADLHHLVTSLQADPSQPANKIVLFGHSLGAVVALHYAASYPDAVVGLGLLGAGRAAGHIPAAKERMLRLATGVREKGTQFAADLATKTNFYEDSEDRSVDPALKERVRAEVAASVPEAYAQAAEAMVAADHSDPDYTQIKCPTVFVAGDKDMISPVERSSGLSELVGGDSWVEVVKSGHQPILEDSAATIAALSKLLKKVQT

SEQ ID NO: 2666 - protein, 707 aa, Unknown
  Kingdom: Fungi, Phylum: Ascomycota
MNADELVHFLADEPPSVVRLEIEKHFEALNDQQKRYAHFISKAAFAGTRIVLRQLSPESEPIYDLIMTLHKQCAGDWNALAKKAGIEESEVTHFLQYAAMFLGNSGNYKSFGDSKFIPRCSDKSVAALAATSPEAAKFYEATNGAIFSSDEPSKMHLGYPDAGHMTTYYPDSPDITKDEIDAVSAWMEKKRLLPENNRLRKHKDGSFEILIASAITSVPAEGGDIGKETEFTVEDGVLKGKTIKITYGDYAEEMSNITAYIKQAAANAENSTQKSMHESYAKSFETGSLEAFKDSQRYWIKDKGPMVECNIGFIETYRDPAGVRGEWEGFASMVNLERTRAFGELVTSAPKLIPLLPWSNEFEKDKFLSPDFTSLEVLTFGGSGIPAGINIPNYDDIRQNEGFKNVSLGNVLSAKAPNEKIPFIREEDQEVYRKHRDAAFEVQVGLHELTGHGCGKLLQETEAGVFNFDKENPPVSPVSGKPISTWYKPGQTWGSAFGSIAASYEECRAELVAMYLSCEFPVLKIFGFGDGSESLDGEAGEVLYASYLSMARAGLASLEMWDPKSRKWGQAHSQARFSILKCFLEADDGFCKLDYKNEDLSDLTIKLDRSKILTAGRKAVGDYLQKIHIYKSTADVETGTQFYVDMTTVDPEFWGKKVRDVVLKNKQPRKVFIQANTTLDEASGKVSIKHYEPSLVGMIESWSDRNL

SEQ ID NO: 2667 - protein, 417 aa, Unknown
  Kingdom: Fungi, Phylum: Ascomycota
MRSSRLSRDTSKLFDRASTASPSSPPRRSTRSSLSRFYATSTTATTTPDIEDAFSSPSPKRRKVSRSTTASPIKSELVEDALHTISSPPNRRQRKPARKAVDPLTGTTTVTPPSDWEEIYNTVKRMRAPGGAAYPAAVDTMGCERLADVEASPRDQRFHTLVALMLSSQTKDTVNAVAMARMKKEMPAHTEGAPMGLNLENMLAVEPAVLNEMIWAVGFHNNKTKYLKQTAVILRDKWDSDIPDTIEGLTSLPGVGPKMGYLCLSAAWDKTEGIGVDVHVHRITNLWGWHTTKNPEETRLALQSWLPQDRWRDINHMLVGLGQAVCLPVGRRCGECDLGLEGLCKAAEKKKVVQGRKRVKDEEIVKEDGSVLKVEAVKTEVVIKEEVVNESLDIGNVLPSLGEESGVGRSRKRRSNR

SEQ ID NO: 2668 - protein, 537 aa, Unknown
  Kingdom: Fungi, Phylum: Ascomycota
MSSKDANPELESFRQQWISDLRSRDAPAPQASQTHSGPRTRSPTSRRHRPSASISKAPVDDDDEHEYVPTPSFDAPKQSGRTITDPGEPDEPKPLVSALDHYEEAMEKEAQGNMGDSLHLYRQAYRMDHGVDKRYREKYFPAGHVSKPKTQPTGDTSTEAPASTSLASSTVPKQAPEVPALAVPIGDLITSFSSLQIEPLAPDVEGAEAPPCPIASVPDEILVHILEDVASVDVAAFARLSLVCKRLAYLASHEQRVWRRVCVGDEFGFPGMHHHWQKAIEWTALEGDFFEVKGDALSGDDEPSSPKFLSREEINRRQHADKLALTLSLVPSAFPTWRAMFRSRPRIRFNGCYISTVNYVRTGVMSTNQATWGGAPIHIVTYYRYLRFFRDGTCISLLTTSEPADVVHHVTKGLLQSHRETPASSYLPSAMMRHALKGRWRLSSVLAEGGEDDIVGSSASQEPTEGDLYIETEGVGPKYTYRMDLSLRSAGKGARNNKLVWRGFYSYNKLTDDWGEFMLKNDKPFFFSRVKSYGFGE

SEQ ID NO: 2669 - protein, 171 aa, Unknown
  Kingdom: Fungi, Phylum: Ascomycota
MEAQCQCGSVKFKTPTAKPLALYICHCESCRRQTGSAFGTSAIFPRFPIPVTESLSCYTRPTASGHTLFCYFCKTCGTRLFHIEPSKDVISVKGGCIAGLDWNSAIHIWTKSAMVPIPEGSETHSEESSGSTTYGSTQEELDQPWSHGSPSGDETPASEKSAVHGACELSG

SEQ ID NO: 2670 - protein, 397 aa, Unknown
  Kingdom: Fungi, Phylum: Ascomycota
MKTTSAAALAALAAPAASSMLTHCPGSSSAGCYSWAVPSTSSSDIYFQISAPSSYTWIGLGLGSGMAGAEMFIIYQDGSGNVTLSTRTASGEVEPEYEARSGVELIAGSGVTGGKMVANVKCSGDCSRNMDRSGSNSWIGAWRRNGDLQSTSASAELQEHNDHFSFRVDMSKASVNSDSNPFLGTSQDSTKNNNNNGNGNGNSNNNSGGSNSGVTEESSSTSNTVINAHGIIMAITFAILYPIGAILMPILGRWLVHGIVQLIAFLAMWAGFGLGYYYANSQNTFFKNTHTRMGTIVVALLGIQPILGWIHHASYKRYQRRTFISHVHIWYGRVLMALGIVNGGLGMQLASTATKYRIAYAVVSGVLGGLYIGSAIWGAIKRRRAPLASSKNSGSSG

SEQ ID NO: 2671 - protein, 541 aa, Unknown
  Kingdom: Fungi, Phylum: Ascomycota
MAPDLNSMPASALHVPAKAPEAAASKPNILYIMADQLAAPQLKMYNPDSQIKTPNLDRLAQSSVQFDSAYCPSPLCAPSRMSMISGLLPMRIGAYDNASQINSEIPTYAHYLRTKGYHTALAGKMHFVGDQLHGYEQRLTSDIYPGDFGWAVNWDEPENRLEWYHNASSILQAGPCGRSNQLDYDEEVMFKSTQYLWDHVREGPEKRPFALTLRGLWAFLAISKNCSKRPAPEWCCPPVSLTHPHDPYTITKEYWKRYEDVDIALPKVRMAKEDLDTHSQRLLKVCDLWDQDFSDEQIKRAKRAYYGSVSYVDDCIGKLLETLEDAGLAENTIVIFSGDHGDMLGERGLWYKMSYFESSVRVPLLVNYPKWFQPHRVSQNVSTLDLLPTICDLIGVKPSPFLPMDGVSMMPHLKGEEGNDTVFAEYTGEGTVRPMMMIRRGPWKYITCPADAPQFYNLDRDPLELDNLARFRKIQPETVEQREAKEMFEKYDAEAMAKWDFDAITAQVFQSQRSRRVVWDALKEGQFTSWDFDPNDDGRQK

SEQ ID NO: 2672 - protein, 458 aa, Unknown
  Kingdom: Fungi, Phylum: Ascomycota
MRRSGAVALALACSASAFVLPDAQVPFDSQPQHPKTSESWWDSLRELASEGSLNPHVPSVDDLSAVLDESAEAISAGLDGVTKALTDLKDQLVDFVHNEEESSDRPRHGPKHGHHKHGHKEFPDHTIYQVIQHSKYTTKFAKALDDFPEVVKILNGTKGGNHTLFVPIDEAFEHLPDHGEKPSKEFMEHALLYHIGLGNLPAVKLLKANTVPTAYDEKLLGDEPQRLRTSIGLGGLKLNFYSKVVAADFKTKNGIIHGVRELLIPPPMVGRELTLFPSEFSTLLLAYEKTDFVDFIHDVKMVGSTVFAPSNSAFQKLGPRANAFLFNSKTGLKYLKAILKYHIVANATLYTDAFYDETESSDDLQAETEKREHFDLVTLLHDLHVSVDILEWASLKFVTVNGFAGVKVRDAVAKNGVIHVLDRVLIPPHKHGKENAEDWSDDVDIDVDDLKERLQEYI

SEQ ID NO: 2673 - protein, 225 aa, Unknown
  Kingdom: Fungi, Phylum: Ascomycota
MAAPFHHPFQENQFNLFTWHPKYVDCQRYFLDHAQYTRPVQTVAAFVNIQLPYQKGETPLSPPTASASSSPPIGYDPQAPQLYGSPVSSSKAAGKAAVREPSLAKTSLVPFIRRLVATGFDNPGTLHGFFGDEWREGVGEMHEIERRNFLFAAKSDTWLKVKAHYDMPDGQIIPFLRPLARVMEKEIQCAEHDWSQWLAMQDWMLGPRALPDDADPEPRVKMEED

SEQ ID NO: 2674 - protein, 1183 aa, Unknown
  Kingdom: Fungi, Phylum: Ascomycota
MVRILPHRLLSFSSASSSSPPRSPSPSISNLRDGFAARTASPMRNKQEASPSRDAGNGLALKVVIMRVSSFTFPCSYVPSHEALDAFNSRSTASMVARFMFEQLVSHPLLGNGARNLAAKDRGGTSDPYLVLTLGDSRAQTQAIPKTLNPEWNTIEELPVNSTNSLILDVICWDKDRFGKDYLGEFDLALEEIFLNEQTVQEPQWYRLKSKRPGKKTSIVSGEVQLQFTLFDSSNTSATPQQILDKLASLTAAVPIASNTPSMTPITSPGGAIPRSAPGQTPPIDEEDEDLLDELDEDTSDEAEDPSKPETAEKRRRRLRIKGLRRKKRLNPYAFTNGESDLVGIIYLEVVKITDLPPEHNFTRTSFDMDPFVVISLGKRTYRTHHVRHDLNPVYNEKMIFHVEGVEQKYSIAFTVIDRDKYSGNDFIASCSLPVQQLIERAPRASHETGLYDLREPPEYIKVASRGRFKKLGMSRTSSSQSLSKMIRPSLSKNPSTISTASTKDGVPVDPSQGIKGALLAPADALANTGIDVSIEQASMDADDPDFNDFTIPLKMKNLEKWEDKHNPQLYFRAKYMPYAALRQQFWRAMLKQYDTDESGNINRIEMTTMLDSLGSTLRETTIDSFFQRFPHKAADNEDLWELTMDEAVICLEDQLEAKSKTPNIGDKVKNLVPGMKNLLNVPNKRNEPDSEPGSGTTTPHIIVDGDGSEIPTSEAATGDDSDSADKDDSNDEHVVEIRECPICHQPRLNKRKDTDIITHIATCASSDWRQVNNVMMSGFVTASQAQRKWYSKVITKISYGGYKLGANSANILVQDRRTGQINEEKMSVYVRLGIRMLYKGLKSRDMESKRIRRMLKNLSIKQGKKFDDPASKDEIEKFIEFHGLDMSEVLLPIEEFKNFNEFFYRALKPDARPCSAPDNPHIIVSPADCRSVVFNQITQATQIWVKGREFSMKRLLGNAYPEDVARYEGGALGIFRLAPQDYHRFHIPVDGIMGEPKTIEGEYYTVNPMAIRSALDVYGENVRICVPIDTEQHGRVMVICVGAMMVGSTVITRHKGEHVRRAEELGYFKFGGSTLLVLFEPGRMVFDDDLVDNSNRPLETLIRVGMSIGHSPNQPQHTPDMRKKDSDITEADKKEAKRRIQGNVTLQDSPDGSGEDVDENTRPPSRKMSMRPTIDTLKASAM

SEQ ID NO: 2675 - protein, 897 aa, Unknown
  Kingdom: Fungi, Phylum: Ascomycota
MSSSGLPDADASRPRSGILTPTSEGSSHRHRHAADIPSPEPSKDTGSRNGAMDQLLKAPIAVKPHPPDLHVKPRTLHPIMLLPRDQFALAHIDLGNPCGELPLSRFFECRVKILELEGRMGTATSVVIARSDVKSSIYALERQPTGLCVICKLGSWVDLNELARHATVISQEEWRPVELVRKPSASDNALGKPPVYKEHKQKRAAIEAIQSLVRKRPRSATSASIDIPIKTELSDPARLDEVQPGPVSKSVEVPATDTVLASLSNAVHSMGPDGANPDGPPASETILETVRTQYFEALYKSMGSLAYFAKGPLSRARSTFHLDLDTNLDMADLIEFLKSMILTTVQIDKKYRETVPEILAKPPGHVDSSDDGRRKKRRARKMKLGKNGLYPSEDEMIQKWWSLHKPEASEEDGASPLSESRSHVAMLRTRETQLQMILILEILALEPLKTTEEATESMLPDLPGASQTQDSMGPPAPKKRSKHNFPVLLDVHADRLTIWQSTAFDDHVWSTESQSAAAAVDSQVDKQATSEPLRDFCVDVIVPFFSARLPQQCDVINKKLGGPTIVSPPKAKKQSSSKSQKPGSLTQRQIPKQPRTLQRALSTDLQHRRSVSRGPSNALALLRSASSTAVAGVKREGSEPVVVGDTESARQGHGILSRSSSMNNTKNPRADKKALVEAELKNAISALRKPNREVVSKAMEEAAQHKLLSSKKLKKPSRASMSSGVIEATPANNRFRDVLAARSDNIMDMPLSNSEDVIPPSSVGQAVPSTGRKVMRDFSAASPFGTIGSTPVKTSASSNFLRRPEREMAIPPSSPLMARKAPPIQQRLSASSNSTAQRGGPGLSQSRDISIFMTPIKKTAALLNISAPENIGPSPIPEQKETSIYDKLGWDDDFDDL

SEQ ID NO: 2676 - protein, 462 aa, Unknown
  Kingdom: Fungi, Phylum: Ascomycota
MADDRYRQDYPQNPQQSEASLPPGANESQRHNSGTPVNMAASVTLPSIHDPRSSGYGPPPPPNANQSRGYAPDPRYEPSRETPNGYPPPGHQPPPPGSGHLPPSQYHQGDPRSPAYPPPDQRGYYADQRHAAPYPGHDPYRQEGYYYPGPPPAGYSPYGPDGRMAYGPPGQGQPQAAPRQRTSIACRYCRKRKIRCSGYQSAPGGKCQNCARMGQECIFQPVSSSSSAAFIPVSAVPGGVPPGTPLYGAYGQPLAPAHHQPYPPGPPPPNGPHGPPPQHHMAQGPYYQPAAHSPTESYSSYGDPRAEEAAMAGRRRRRTSEENDEGYRLPPPRTSGEDDPRRRSPAEFSNNSSPSGFGHSQHNTGARQSPRGPPLPQPPAGPTQAPTNAGGRSPGIANGSSGASTPAASGQSGQNSQQAGGSSVMSLSNLVDKNDIDQGMIARLNRPKAPGAPPSNASNASR

SEQ ID NO: 2677 - protein, 345 aa, Unknown
  Kingdom: Fungi, Phylum: Ascomycota
MKFFAALALAAVAAAAPQKRASPLDVKLEASGNSAIKATVTNNGKNGLKVFKTGSFLDAAPVEKVEVFAGEHPIEFDGVRLRLAEGPKADEDFEFIAAGAAVEVTFDVAEFHDLSLGGAFSVHSSGDIAYAEEGSNELIGTVSYDSNTLELKVDGEEASATRIEFHAKRTRVQSTCTGARLTASQNALSRCASLARAGQQAAQSGAAAKMTEFFKSSTTATRNEVANVLSRTASECASTNAGVSTYYCSDPYGYCQGSVLAYTVPSASVMAYCNSFFNMPAQSTSCYGQDQANTVLHEVTHLRQIKGTEDYGVYGYSAVRGLTAAQNLNHADTYTLFAQAISRGC

SEQ ID NO: 2678 - protein, 523 aa, Unknown
  Kingdom: Fungi, Phylum: Ascomycota
MSHVMNDGSSSPNGMMEPKSEVRKRHGSAGNNVAADDLLENLGYKPELSRNRSTLQVAFMSFVLASIPYGLATTLGFPIVGGGPVDIIWGWVAVSLIIVCVAASLGEITSVYPTAGGVYYQAFMLAPSKWRRVASWICGWLLLVGQITITLAVNFGTTLFFVACVNVFKDSEGNGIFEGTNWQVFLIFLAITLLCNAVSSLGNRWLPLLDTAAIFWTFAGVIAIVITILVMAKGGRNDAKYVFTSFEPISGWPDGWSFMVGLLHAGYATSSTGMIIGMCEEVQDPARQVPKAMVATIFINTFAGLLFLIPIVFVMPEISTLDTVQPVPQIFLEAVGTPGGAIGLLIPLMVLAIMCGIACTTAASRCTWAFARDGAIPGSKWWVVVNKKLDVPLNAMMLSMVVQILLGLINFGSAAAFAAFSGVGVISLTAAYACPIAISLFSGRKQIKDGPFYLGKIGLACNVIALAWSALAMPLFCMPGALPVDVDTVNYAPVVFVGATVISGLWYWAWGHKNYAGPPTHEM

SEQ ID NO: 2679 - protein, 390 aa, Unknown
  Kingdom: Fungi, Phylum: Ascomycota
MKLTHGLTAALAGFASAASSQQPAKIYLLPSSDTASTQSPAIISASLARLIFLQRLSPFGQGPSVIDGSAGADLDTVVKTMNRFGKAPPSLHPESELSPQQLVLILEDMTTEQMSELEKQVKGAYKGMKPAFEISNPPSTRAHDDLVEIDFYNAGLTSHTKCDIELVIDPQNEKCWDAAANANVAKYNVLEDTKIMDKSGDVLKAISKLTKNGAMQAMIVALPTVESTSPTSWRPEELRRRQAEEVMSIVDTEDEPVETSKAQEHEFFVSTKAGKTIQSCFNSADSCVTATGNCSGHGECQNRYAKKDGSEGKEVCYTCHCLSTVSKSGSLTHWAGGACSKKDVSTPFWLFFGFTILLLGILTLSINMLFSVGEETLPGVIGAGVSRPSK

SEQ ID NO: 2680 - protein, 384 aa, Unknown
  Kingdom: Fungi, Phylum: Ascomycota
MSRHVLGMGLLAITVSAQANFASSGFEYVGCVEAEPSLFGLNIDFFKPFTPQECQDACAGKATYAALGGGCKCDVPHQGTDVTFRVLDEEACTVLCIPGSPDAGRCGGSGEGDQPGTQLFNLYKKAGEVGAAGGAAMEEGEGDCNEGDAAVHNQVAELPLPSIVVETIYSCPPEKEDCPLRAAATKLAVPVCPPEGCQPSPAPEPAPEPAPTAAACPPEGCQPAPVPSPPPAPPATPVPEPCPPEGCAPVFNKVPVCPAEGCRSCPPEGCPPCGDGQCLPACPEGCIAPPAPEVLATPVAPTPSPAPVCPGGCNVPTTLTPAPVPTSSAIPAPPSPPQPRPETTEESSPPTDNKPTVVSEARKSPAVTVEMLTIMGAAIVLLVF

SEQ ID NO: 2681 - protein, 625 aa, Unknown
  Kingdom: Fungi, Phylum: Ascomycota
MDSSTSTSSPAPSLASAPSSPLSRLSRTPSLPNSPVMGPLHDEAARRYPSPSPTSTTTSGSQSPTKQLSDPIDMPTDVSTPSARDGPPPAKKRKVAAPKERTTEYLDLMKEELEFNEEDTLQLNRLKAALHKKKKIVVIAGAGISVSAGIPDFRSSNGLFASARSQHKVKASGKHLFDASVYKHDSSTQSFHTMVREMAQMSQEAKPTQFHHMLASLAKQGRLLRLYSQNIDCLDTSLQPLATNIPLNPKGPWPATVQLHGGLQKMVCTKCSELSPFDGKVFDGPEAPLCPSCIEQDQVRTAHAGKRSHGIGRIRPRFVLYNEFNPDEEAIGNVSSADLKARPDAVIVVGTTLKVPGTRRLVKELCQVTRGRRDGFTAWINIESEPKGIDFKDCWDLVVKAKCDDVAREANLDPWDLDLGENFLVSKEDEASDLERRSKYTINVDIPQVKSEDETAEPAQKAIQDVQQHMPTPGASPIISAVKPASKPKQSKLSFGTKKGTTTKSEAKVPAKRGRKPNAKKATAEAPKQMVTSHFKIEKVADRSLNGKAGLVEKAFNLPELRPERKQPTSPPFAWTPESADRITEALVVSDIPTTPEQEPLAQPPSGDTISPKSVPKGMSALIDV

SEQ ID NO: 2682 - protein, 1104 aa, Unknown
  Kingdom: Fungi, Phylum: Ascomycota
MFLLQLNPNTVTVTVANPGFEESGALKSVVVRCWLPLDHKVQQVTVAPHALWCSLDYYRISTSPVAFRCIFTTRSLPTCAASPPLVNLDDPVAKQVRGRYGSAARMPITKLRGGHVSSRPFCTIVFLTTLYIAYSYLAKTTDRQPFVDDEVQLLRRSEKLECRDVHRAVDQCAFVKEVCADDDAGLIPYLQLYYCGVGNARPVTLFFLIVWLGLLFTTIGIAASDFFSVNLSTIATVLGLSESLAGVTFLAFGNGSPDVFSTFAAMSSNSASMAMGELIGAACFITGVVAGSMALVREFRVDKRTYARDICFFIVAVAFTMVFLADGQLRFWECWLMIGYYIVYVITVVCWHWYTTSKRRRRRREGEARSHFYGAVSQQSDELAGEPYRDDPDDVDGDHSTRSHPADLDNAAAEAGPRIEIESPNATRVPAESPDEDPEDHERMVAAEVASSMRVLRTRGKRSSTITPIRPSLVGALEFRSALAQLQRESNHKLAEMPERAYSENRLDGSSRQRAKSVVPSLSYDDRDIWESHGANSGRGRAWSVGDASERANQGPTIAVTEQGDTSLLQPFSDQATASNEPTAPYTVGGSLAPPPIDGTGHSASGASTPTSAASVEEAPKLLLQIPSRRSSYSDRSSPASPFPTFMESPMVITPGGLNDPPEFLLPAPARRDSPFRGLHTPTEEPRPVSWWPYAALPPPHVLSATLFPTLQGWREKSIWDKFMSTISVPSIFLLVITLPVVDSETTSGSSLLETVQDASIGPQVGHLAPVISTEEDAIEPQSEWERYRRHTLSRNHSFQSYRDASPSMSPRMRSLSTEDTAVGQPLIEVSNMSEFHPMAKVTSNTASASIVQEETPGWNRWLVCVQLFTGPLFAVFILWANLLEDFESPGATLARMVLYTLLGSLVALALLLSSTSEHRRPKAHYLLCFLGFIISIAWISTIAGEVVGVLKTFGVVFGISEALLGLTIFAAGNSVGDLIADITVARLGYPVMALSACFGGPMLNILLGIGIGGVLMMVRKANHKHHKHPDREYTYGPYPVQVGGTLMISAITLLVILAGMLIAVPMNKWILSRKIGYTLIAAWTLSTIVNVIVEVTGVWADVA

SEQ ID NO: 2683 - protein, 127 aa, Unknown
  Kingdom: Fungi, Phylum: Ascomycota
MSYPQQIRPPHTRWCIATEPVIALPQRAKLNNKDIERHSAGRLVEKVNPVFISATGQKATTAGNTSDTANCTFSSAFVSMESINAASLSSSVVGQSCGKAQVDRKVEERMEPSTYPELELGTHVAKK

SEQ ID NO: 2684 - protein, 496 aa, Unknown
  Kingdom: Fungi, Phylum: Ascomycota
MPSLTTVATRLTALLSLVAVAFAADDISAAKIASKKANILPGPLKVTELTFTVPLDYDDPEGETITLFGRTVVDYEVPLVKPDEDEDDEVELSDLPYMVYLTGGPGFGAPEPQNFPLTGPALERGYQVLYLDHRGTGYSTPVSNRMLQELDDEDAQVNYLRLMRQDNTVRDCEAVRKALNKDKSGNAAKWAILGQSYGGFISLSYLSLHPEGLSEVFLTGGLAPVGKTAEQVYQSLYPRVMKRNKAYYKKFPEDVANIHQIADFIEEEGGAVELPAGGSLTIPRLMTMGIDFGGSGGFDSVHSVILKMKTSLDTVGFLTRSSLTPIEGFSGYDDNIIYAILHEAIYNNGPNDTSNWASDRVAREQNLFTWLPSSSNGTTERNTSEPLLFAGENIFPFFFDTHPELIPLKSVANKLAEIDDWTYIYDKEQLAKNEVPVYAATYVDDLYVDYEFSKDTAKLVKGTQSWETNAISHSGLRSDSAAVLGALFNMRDNVMD

SEQ ID NO: 2685 - protein, 634 aa, Unknown
  Kingdom: Fungi, Phylum: Ascomycota
MAQKKACDACYKRKIQCDFDSGVTRCDWCDHQGLACTFNRVRGRKKADAKRLTRNSQSKAQTHQNTPKESVEEYASEQQSRSSSDLDTSAGSVPQPCYQADLATRQPESYQAPIAYSHINYDGRHFGHMSHLNGIPILSEEGKQWISLRTGEEVSFKRFETDAHHQATPHWLSLQQHNKSNDPYELPDQSVVTRIFDIYIHSAFSKVFPFVDRPLFPETISLAYRPRTQPMSVEGGYTEFPPLDVEKSAVQARYLLSYTAETPSLSTLQAVVMLAFYEISSGRDQSAATYHAVGCRIIFKLGGHIRLPPKHIKSVEDFECNQARLLFWLGYVLDKDIALRTGQPPLMSGEYCDLTIPDGYDECYSYLSLLDDNLRLGDDLILTPHLPEDPRLSQLKEKVSQRLYSAQAAKKNNAELLRDIRELDEALEAWRLSIPRAFRPALSISDKSRVDVGEMPVPRSMCRITLHLGYHHVMIAIHRASGRCMSSAESAGDAEQSLPGVQSSMALALEACRSTLIYLRAAISGVAGEAFWIIVFYPTAAMMALFLNILMDPLNPQVEADVALLASTADLIHCLPIHRLTSHEVAHVELVTEFVAELSALSKKAIAKATAECAQRRKHDSRTLTALNVKMCMN

SEQ ID NO: 2686 - protein, 93 aa, Unknown
  Kingdom: Fungi, Phylum: Ascomycota
MASTGVNVIRWSALAFGVFFGFSHQRTITATQKAAHDQHEFEHKQKLIDQAKAEYAKLKNPAPASKGDDVITDVQNPNFDLEKLLLKVAKENP

SEQ ID NO: 2687 - protein, 556 aa, Unknown
  Kingdom: Fungi, Phylum: Ascomycota
MDSSTHKMPAAPPVKSNVLLYTVGGILCAQVLFMFMAAPMLRVFITFLSWGLRKKTEGRRQQLMQLMTEDEKTADDQRSSSSEEWEKVKSTEEEKPKPESKRVTKEWNRTWDGLVGFFHPFCNAGGGGERVLWAAIRATQNEWPKAKCVVYTGDHEANKDAILARVKERFNIELNAKRVTFLYLSKRKWVMASTWPRFTLLGQSLGSMYLLWDAYSLVVPDIFVDTMGYAFALGFSKLLFTSIPTGAYVHYPTISTDMLSSLDSQSATEGVNAGQGAGARGFFKKLYWNFFGYLYSWVGGTVNVVMTNSTWTYRHIRRIWGPFRGARKNALSPIAVVYPPTAVKELEGEVEVSEANEKAREPILLYIAQFRPEKNHELIVKSFAKFVKTGTAAAKKAQLVLIGSVRDDHDSKLVYQLRLLVNELHVNDQVEFELNAPWPTVLGWLKRASVGVNGMWNEHFGIGVVEYQAAGLVSVVHNSGGPMLDIVTEVEGKPTGFLATTEEEYAESFEKALTLDDPYAMRQSARASAARFTEEAFDAKWVTQFERLVYMTKVGF

SEQ ID NO: 2688 - protein, 329 aa, Unknown
  Kingdom: Fungi, Phylum: Ascomycota
MFARSTFRAAQPLRTQTCRYTSEAPKPKSGGLPTSFLVAGAVGIAATSFYFLSSRPAVNKAAAAVGVEPKKAFTGGDQGFVSLKLAEIENVNHNTKRFRFELPEEDMVSGLHVASAILTKYKGPNDEKATLRPYTPISDESEKGFMDLLVKQYPNGPMSTHMHNMTPGQRLDIKGPLPKYAWTENKHDHIALIAGGTGITPMYQLCRAIFNNPNDKTKVTLVFGNLTEEDILLKKEFAELENTYPQRFRAFYTLDKAPKEWRGNSGHITKELLKQVLPEPKSENIKVFVCGPPGLYKAISGNKVSPKDQGELTGLLKELGYEKDQVYKF

SEQ ID NO: 2689 - protein, 654 aa, Unknown
  Kingdom: Fungi, Phylum: Ascomycota
MDTLEGVMLIPPDRGQLLGRAVWKSRYVTVGRRGTAKEHQSSPSYTKLTSSSRASQPLAKISIDDYCLSIYKTKVNPPQRLSSQRQAKPDSIQPPVDRQDWEPTHQWPLSSVVDCTVQTVAHRKQGPVLPTLIVTISDAQRKRRSSRAAGLITSSKESSSTTVLWFRSPNDEPHVSLHEWVRFIMSRRGGPMSPDSPMSPVLTNPFSPKPRDGSDYFPRPGSHGRGLQHKASTATYSTAGGARERPLTFSSESPSLRSKRSDVSSPSSFNYPVQQLPFNIPGQHYTTVLPSDIPSPITAGPSEYQGEFIEGWTSAQGRSSTVSSPTRGRDSISSHAHQPSVTESSSPPAPRETILDRAFQLRCIPGSDADVPGEEKLSSLARFDALMKEADEKRRQREATQRAEQAAMRSTFDADDSSDEEEVVPESDTDTDNSDRYSNEADNRSQPSLIPPTTKRALKFIASRHDLTEEHDDQTPARRPMSRNPVSFHGGMMTSLSQIAPSRPHTAHGKSRPNQAVSGPQSPPLPASATETSMRSPVGRPSDEGTVRPSMEKRQSTSSAKRLSFTEFTKRLSSTSSLLLVQTNASSGSSREGGEGPGHHSQQHPQIGVGLVPRSSQALRSSMGPSRDREREDQDSKCGWRGSVGVIGGEGGFL

SEQ ID NO: 2690 - protein, 249 aa, Unknown
  Kingdom: Fungi, Phylum: Ascomycota
MSGQASQSKSEAIPRRALIAVTGATAPLGKEGDSTGLFISEALHPYNALRAAGFEVDLSSETGSYYPDALSLTEGFLNGEDLKTYEDTNSEFRKKLDNMPKASDLNPSDYGLFYASAGHAALIDYPTATNLQRVATDVWSKGGVVASVCHGPAIFANIFDEATGELLIKGKRIAGFTSEGEDVLGVSGQLKTWDKEVVEELAERVGAKYERSEGPWDDFHVVDGRLVTGQNPASATSTAKAAIDVFESL

SEQ ID NO: 2691 - protein, 859 aa, Unknown
  Kingdom: Fungi, Phylum: Ascomycota
MPAQTMYAHGGDMKHGSADNMAYPPQPGSPTLTNPDMILPDYDRADSPDDLPEPNILMWNTQPSATLRNQMLPPESFVAGPMTPTTPIIYGNGTMLSDIGEVTEVESNAGGYGARRTSSRYSAQSIENVAVRSSPTIGVAMANRIPQKTMRERRSSIESTSTIRSNGNAHFADFDDVVSVDDSNFQGDDEESMASSWVDDNPLQGHVAVQQPVAPRAVEEVYSTSSISQRAEQILANAKRRLTTMEGNLTRARTSLSNSSVSNGSTPSPPLTRPRTAMHEAVTSPVASRHVRNKSEDGLHAGAGPTSFPTRSASALGAAGGYRKPSSGRTGDVSGAGVFRGNHLVSHYPLDTALEPLSEDDDGSIADSARDSGQYSSSATPTFGTFSEKHLTRSASAAQMREIQDQMQGLKGKISTLKEQARADSMKRRSLQSLRTPSPFTHARWDHGFGGAQGANDSEPPSPALNGPEDDETTPTETVPPKLPLPEQKVLPESNIAQVDEDRPDPQEQPQVAPEDVGQALSPDFEDAPSSPTESMSDAAKEVTQTSEDGVQNDSGEDSSGRADSQTLPDGAEVDSEVSAQEREDSLSDYDSDAGDSLYHDSYQHPVSHEDREDAFDYEHFFLHSAMGNLRNDRRGSTSSIESNESIETARGPDRRSSIDTTASAESFRTADEGRASRTSVSHEETPRASEFDQRPISHRAQHSAYSGFRFGTESTERPDNRPRTNSVIHRPVSAVPAASMHRPSVSSFESTGTTRSFPLVNKARLNGGVLTPQASPDQSVKQTGPFPLPDTPTLHDSGFPSTVSMLAKEDQVLVEGLIAGLGQCVLKLSEGSRASTEGRLNLRRLEAARRILEGLDDV

SEQ ID NO: 2692 - protein, 443 aa, Unknown
  Kingdom: Fungi, Phylum: Ascomycota
MPRDPLVGLVGKPSAGKSSTLNSLTDASSKATSRTSSIRTEAHGYEGLEELWNEETDNKNSFTTIDPQRAIGYLQIECACARHKVSDRCKPNYGSCVDGRRSVPIELLDVAGLVPGAHQGRGLGNKFLDDLRHADALIHVVDASGTVDAEGKETRGYDPSVDIAWLRSEIVAWILGNLMNKWGSVKRRHIATKANPADTLLGQFSGYGGNPTTVQRSIDRSEIKEALEHWSDETVQLLVESFVDEKFPTVIALNKIDHPDADKNISKIAKQQDPNTIVLCSAVSEIFLRRMVKQGYIKYLEGSEFIDTREDLIEQGDPEGGGLKELDEKNRNRIENLKDMVLYRFGSTGVVQVLAKAAELLGLVPVFPVRNTTTFQSGASESKVVFRDCVLIKKGSTVGDVARKVMGDAPIAFVEGVGNIRVSEDDLVAVGKNDILSFKVGRA

SEQ ID NO: 2693 - protein, 620 aa, Unknown
  Kingdom: Fungi, Phylum: Ascomycota
MRSRNLALPRRKLQSLSTNASSVCIFCSHAPPTQRPRQPSTRRFQSSSSIVTNEARKDLSEALSQIQTRFPNLVSLSKLQLALRGLQQPAGREAVRIAVLNLQDPTKESKNAARDVLRLLLADPLQDEQQWERQLAEHPSGEPLIVRIRASEAADGTLTISRTNTLAEVEISSPELNGAELELLFSDIILPSAPDALMSAEDVQAAILEPEVMIPEGTHFSPLSTPVHKALVVGTGFSEATRIASLPLATGDDAILTAINLKGLANQELDTTFEVIDTDMASQGVQLFRKGPQHGIEYERLWYASNLPALTKWLRSGIKSADGVTKPAVRMVISSVLRDAYSGIDKRHAQEASASLNVQAVPVTIRGGVSSWAQNAHAELQDQLDLAFTGRRWRKLGWWKLFWRVDDVAMLTNETLAQRFLPTAEQELVYLAGQVEARLQLQPAYSQPASASEGDAKTKRLGSGEVAPVVFPAAANGLPKWPGHIAFTRRYLQNETVPALQALAQKLVLQSVGTSGVTTSLAALLYVSSFASTFYEAGAVAALGIMYSLARMQKKWETARGFWEGEVREEGRKAVRAVEESVAGALEGGPPSADTSSSVAELQEARELVAKAEEALKRLQ

SEQ ID NO: 2694 - protein, 264 aa, Unknown
  Kingdom: Fungi, Phylum: Ascomycota
MSVKFEETVKKAQDVMSGAEGGNIPGTSGKHPIAARVGTALTGGRDNAGTKGYLAAYIKQIEDHPLRTKVLTAGTLAGAQELIASFLAKDRNKHGNYFTSRVPKMAAYGAFVSAPMGHVMIWMLQKVFANRTSLKSKILQILASNLIIAPIQNVVYLVAMALIAGARTYHQVRATVRVGFWKVMRVSWIVSPICLAFAQKFVPENLWVPFFNLVGFIIGTYINTVTKKKRLAALRKKHFGDGRSSGMGPRQDDYNPSIGPNPPY

SEQ ID NO: 2695 - protein, 2186 aa, Unknown
  Kingdom: Fungi, Phylum: Ascomycota
MVPPPRAGSFSPNPASNLQTGSIHSPHPSHTAALSAGASPSTSSPTGTSSLTKIVVAQVYLLLSTIKEDKDRAKFELQVDQLRKLIDEHGMEVFSKYFTRLVAGNAPQIFPGLNRPVANPGNYHILVGEMRKIAHDIDQASKIAESIESGTEDIFRDFDLSTFMEHFKLDALEKTLLALAFKLGSRSDLKTKADAILSTNFMTFADIISRPDLEAHQDLTPAFIALIVDRLLQNHPPSFNASSRRDLSTCVSKRFANMDQPPPSEVLAALDIGRILAERPANALARYIQKTGSEFTRDEETCVSYLQNRLNNVNLNADQVAPALTYTAISITPNYDPGVLVKALLRVVPKSFDWMEVILCFDQPSARISPPQFLRLYQALLPVTPNPNFDIQRLWGGPWSEPEALLSFVCAYASHSPEQLDATTIPGLHRSINLEDYVNSPTNVQERAAIAIRHPLTSVVALTSIFNMALSSMHASQSVEAKRLFQDVVVPNLDVFLVSAFEVPRQSWANMAVETINSLFDNFLQKRSPEYDFVLDSLWKKDKDWVINRLTEAHALRPLDLSKIFEHAVQHKWLDELVYRNNGFGLDLAALAHSEGYLDLAKWARVNADRSHEYSRSLLQFLMIKANLEMQFQHPTDGEPPVKSTTTLQVRTVAALLGILEDFLPKAPVHDLIVVQRQCITAYPRLINYGEGFDDIIDANGQDGNALPPTASSKMEEHYKKMYGDETQVRNIVETLDRYKHSRDPLDQDVFADMIHGLFDEYNHYGGYPLEALATTAVLFGGIISHKLISDLPLKIGLGMILEAVRDHAPSDPMYKFGLQALMQLLARFREWPGFCKQLLQIPGLQGTEAFKKAEEVVREHEEEVARGRNGASTPHSIGFGSEPFANGNPEEPATERQAPPFASIGVEPIAASSNFEEPAEDAQDKIQFVLNNITEGTLQSMCAELRSMMESRHQQWFASHLVEQRAKMQPNYHHVYLQLVTMFQDKTLWNQVLRETYISAARMLNAETTMQNSTERTHLKNLGGWLGLLTLARDLPIRHKNLAFKQLLMEAHDTKRLIVVIPFVCKVLLQGAKSSVFRPPNPWLMDIIYLLIELYHHAELKLNLKFEIEVLCKGLDLDHKSIEPSGEILNRPVVEEPAEVITQEQLDAFDSLSLNGLTSAVGQGMSPPAVPLTLPDLGPLVNIPPTNEMVVSSSRLHEIVRSALTRALQDIIQPVVDRSVTIAAISTQQMIHKDFVTEPDEHRVRTSAINMVKATAGSLALVTSKEPLRANFTNYMRNLSNDLPSGLPEGTIIMCVNSNLDLACNIIEKQAEERAVPDIEELIEPELEARRRHRIQHPNEPFYDLTSTNRWALTIPNPYKLSPSLTGLNPEQMAIYEDFARQPRSALTTGASTSHQPSTSDATRSIANEVLQDAYMPAPNVPSSTDTPTSQHLSAPMQSYPPVHNTAAGNMTNGRSPGFQMDVRNLAERVNKLLQELLRVASEAREEHFMGLPRPHPVLDVVDALVQLIIKTSQSSEEFAIYAAEQITSLIFQQVDDNLTLESLVHVLETLRKISGPALNNRVRAMFSSQPGTAFLSLPLLAALVRTDLLEWRNIDLALSKALEARKEGSLEFLEQMLDLALLNNKPIALFADFVRTLEASWAWISEDPNNAVALRLKSKLIGPAHENEDQAVTQHEQMEYVFEEWVRLFHNHHASEKAAMLFVQQLQTKRVITGRDDFLVFIRIATDIAVERFEHMLHSGLISETYVATDALARLISLFVSLHSNEVLTRAKFLDSVLALVTLVMNHHQVKRGEQFNQRVFFRLLSMLLYDLQLMGEDLSEEDRRTIILSFAKRMATMSPSALPSFSFGWLSLLQHKAFTSVVLQLSDNAGWDAMSNLLDQLMDCLGELLKAPEVSPVGKEMYRATLKLIAVLQHDFPDFIAANHMKLCANLPPHCTQLLNAILAASPQGTKLPDPLHPGLQIERLEETKLLPTLVDNSPSVLDESGLLNVIDQACQNGPSEDIVAQLVHAMTQNPNRQTSFGYFPLNTDVRVITAAVMYLGHQGAHRAASSSGALSVTGSEPEVATLSLLVHELSPEARYYALCTMVNQLRYPNAHTDFFSQTILYIFGKDINDPEETEIRQEITRILLERLAGFWPTPWGLMCTIIELVKNEKYMFFDLPFIKSTPDVADRFAAVLQRQIPQ

SEQ ID NO: 2696 - protein, 975 aa, Unknown
  Kingdom: Fungi, Phylum: Ascomycota
MANSEDVKEPITVPQPAAGGEASDIASQENVSPRNQVARQNSTKNQVRHRASVACQAECNQCRRTGTECIIKNDDERRRPISKAYMSSLSERIALLEGMLAEKGVAPPPAAHPPKTRHDPHSKSSDDQKTAPQTTTQHTSPSQGVPSPPDSRNEDFMLGGDIDHNDGMMSNSQMLSGLSKEDSPFRMLDAKQEDIVYRLLATKGNLSFDQLSGRLRFFGPTANSHVYAESPDQFDSREPPEQVRRAERIIRSLTTSTHDYLMNHFWEYYNSVLRIIDREAFEADRDSQTPKFYSSFLHICVLAMGYRGADMDRDDMKKISLGNRESTLHREAKYMLDIELERPGGIPSVQAFLLLSDLECGVGRDNTGWMYSGMGNRLAFDVGLHLDCRTNGMPEQEIKIRHMVMRACTIYDKYWALFLGRPTSIKSQDIGMDLLQSAFSQLTSAFADPTPAERDVTGEIYEQLIELMDLAGRIVETRDHHVVKNNIDRNNVFAIGEAEDNAYLHVVNLDRQLQNWYRRLPDHLAWKPANVKTAPYSYFLLHQQYHVSMILLHRPWAKYGAITGDGASTGSHPSPDSTHLNMGPDSAPQHPGAGAGADHSMGMGDPHSMVHDSRTSLSRSICTQQAIRVARIFWQHRQRFDGRKIFVTGIQHAGTASIALIAALAYQRNDADRRTYLGYLEILSDALGDMSHTYQPAGRMDGLLKAVLAQIRSSMGEPPRSSNSLRGGLPLDSFSGSAGRTRMSGASDMTAPIIPSRREAGESEIINPAKRRRPGNSRRASEYARPPPPFFQGVQATGPPSYTSELHQRTHSHAEQQMMFNVGSADGTHMNLDFLGGSAVDMDASGEEQMDGRQQNGDDMNLMGHGGDNWGLGSMHSDHTAHHTFNPSSLGAEWNAGPAGLSASSVLGQSAALTNGLMSTSNTLGATPRTGDEDERGAHAMMNGMSPGSLNGLVQSVEKDGDMSRNHDLDFFSFT

SEQ ID NO: 2697 - protein, 412 aa, Unknown
  Kingdom: Fungi, Phylum: Ascomycota
MANPKPEREPCSSAMSTLCKLSNLRQVASTSLAPSALRPIPVTSLDRLAQATEKVTTDDKTDHPEANTVLYLAYGSNLCAETFLGVRGIKPLSQVNVSVPTLRLTFDLPGIPYGEPCFANVDWRKLPKHPEVPPVPKLPPTSPIGPPIEPPKPPKVGPPFASTDNRTNSAHTQMRWDGELVGVVYEVTKEDYSHIIQTEGGGASYKEIVVPCIPLPPAMEIPEKPPIPELPRPFLARTLFAPYIPTDKLPDDPNKNKWWYKFVVPPHRPSQDYAQASARYLKLIRDGAREHELPEAYQRYLHSLQPYTITTCRQKIGRLIFAGVLLPLLMLFFTISRFFADKNGKLPPALMLISAAFFNISWKFYDNVLKPTCGDGERTEDRKGKHGQSQIWRPNQSLSDEEKASLLDSESS

SEQ ID NO: 2698 - protein, 165 aa, Unknown
  Kingdom: Fungi, Phylum: Ascomycota
MTADDNVTNIYSSLSRTVFALIIINKAGGLIYNKNFSDAGLNKISTNDYLVLAGTFHGVHAITARLNPLHAKRSSIEGGRLEARSGLEVMETENFRLQCFNTLTGTKFLLFTDTTQTNVDVTMRKVYDLYADYVTKNPFYSLEMPVRCDIFDRKLHSYIREINNR

SEQ ID NO: 2699 - protein, 622 aa, Unknown
  Kingdom: Fungi, Phylum: Ascomycota
MEAKDTRVLADTSIMENSTTSTAQQPMTDSEKMANQPLTPDSDGDTTRQLTAEKHREVGSKGGFMGIFSKLGDLPEYSFRGSKLQGKALNWSIGFIASCGFLMFGYDQGVLSALLTLDDFQKSLPLMTPLEESNYLCYHDYPANNDRNEAMCTGSPNTQAAAVAIYQIGCFLGAVLILFYGESWGRKSSTFWGSLIMIVGTIMQASTFSYGLFVAGRIVGGVGNGMVTSTIPTWQSECARPHQRGFLILISGALISGGIMIAYWVDYGFYFLEGSIRWRFPISFQSFFTVIVMWGLLYLPDSPRWLAMKGRHAEARDVTARLLGLPIDAPEVKAEVDAITEALEAQSRAGKFQFKELLTNGPSQNLRRTLLGMVAQFFQQICGINLITYYATFLFENSLGFGPSMSRLLAALNGTEYFLASLVALPLIERTGRRKLMLFGAFGMMASMAILGGTVSTGRVADNGAPILEDRFGIPAAVFLFVFNTFFAIGWLGMSWLYPAEVTGLRIRIQANALATCSNWLSNFLIVMITPPAFANLGYRTYVMFAVFNAAILPCVYFFFPEPKGRSLEELDVIFASAHADGVNPVKRAKHMRHIEGPELETELSRYFGAGSQHVENGTREA

SEQ ID NO: 2700 - protein, 261 aa, Unknown
  Kingdom: Fungi, Phylum: Ascomycota
MFMQARAEMGNPDGPSRTLIIALSTTIPGVIIVTVLILAVYQCRKRKFRFLNRGITPIDDEEIESWRTEKIEEKMAHSVKADSPRRHQPSMSASSIQKPPSIMVYGRDTHFTARPSIDRSPGLGRQSVDVPAPVIAVAPNARLGLTDDMIQGDDAFVPRVKRQPSRLAKAQPPSPPTKHQHNRSTNSHSSMHAAWYGYQEDNYYAATPVRNSSERRPQTPPRGGCRAHDRTFSNTNEDEMYHGGLSPRPLLHQSDIGRAIG

SEQ ID NO: 2701 - protein, 539 aa, Unknown
  Kingdom: Fungi, Phylum: Ascomycota
MAWEEIAKKKQDARHDAVQAAAKYSNDRETPAQLEYKSLTNITTGIINGEITAESITLSAISSAVKAHLDTNCLSEPLFDQALDQARCLDEYFLETGRLVGPLHGVPISVKDQFNVKGVDTTLGYVGSSFKPARADAVLVRILKSLGAVVVAKTAIPQSILWGETESPLWGVTTYPGRPELTPGGSSGGEAALLAMNGSLIGWGTDIGGSIRGPAHICGLFGLKPTSTRFPYAGVPVSHEGQSHVPSSIGPLARDLETLVAATREFINAEPWLLDPNVTPLPWREDMYQSIQNQRLRIGVIFDDGVVKPHPDIEVAVRQAAILLERAGHEVIQWSTSDHLSCINIMDQFYRADGGEDIRLAVSEAGEPLIPHVQALVDSAKPISVYEYWQLSRQRTAAQIAYNKKWNETTDDEGRCVDVIISPVLPHTAVPHRSACWTGYTKIWNFLDYAALAVPFSSVGGPQGMDEEHELGLGSEEARRRFEEHQPRNAMDKQNQQTYDPVLLHGLPVGVQIIGRRFEEEKVLGVAKVLDDLRNRQHA

SEQ ID NO: 2702 - protein, 462 aa, Unknown
  Kingdom: Fungi, Phylum: Ascomycota
MQLSAICEDRNKNIIPGLLSAHHAVLHGDGNIVDMSTAENWAIKETLIPKVRKALARISEQNSKDLAYASGVGGCTKTRTGIARLLNDHFCPSQTVDPSHIVLAAGGSFALSALIDQICDPGDAILIAAPYWPGLDIAISIHSRAEVVPVHVPLDEFFQPESVQYYEEALRLASSRARGVLICNPHNPLGQCYPRTTLHEMRHFCAKNNLHLISDEVYALSAHQPIPDDTVPFTSILSVDSEEAGKGNPDVHVIYSLSKDFGCNGIRVVRYRTLAITSAPGILTNPAKFFCRARWRLLTKHSSVSSKGALVNQTNTALRMGAALSVHSQVSTLSTFLASNVLLAPEAVEEVTSHGGSQCRQSYETVRSFLQGWTMDFIPVQYGVYVFARLAELNNQDEEAELQKCLKQRGVSVSTGTSYHLANPGWFRICYGMPLAELQRGLDRLDKGLKDYLQKKNYPPHN

SEQ ID NO: 2703 - protein, 334 aa, Unknown
  Kingdom: Fungi, Phylum: Ascomycota
MLALTHSGASPSAELTMAVLGCGGMGVAILGGILTSLADLQGPKPLQTPSGTPFEELPPRLPSRFIACVRSHEGVKRVKSLLWEHSSILKVVRNDNLHAVQQSDVILLACKPDIVSDVLSQPGMAKALHGKLLISVCAGVTVEHMETAIYGAVSSNDPEDDGRCRVVRAMCNTAALIRESMTVIAESQPPLPPQTETLVTWIFKRVGDVVYLPADTMDASTALCGSGPSFFALMLEAAIEGAVAMGLPRREATRMATQTMRGTTGLVQNGTNPAIVRQEICTPGGCTIGGTLVLEEAAVRGTISKAVREATAIASQLGKGAQHVNGTRHMPPSL

SEQ ID NO: 2704 - protein, 132 aa, Unknown
  Kingdom: Fungi, Phylum: Ascomycota
MSSQPLLQTAPGKRIALPTRVEPKVFFANERTFLSWLNFTVILGALAIGMLNFGDRVAFISAFLFTGVAMLTMIYALVTYHWRAKSIRVRGQAGFDDRFGPTFLAIILLLAVVVNFVLRIMDQSKKEKHSQH

SEQ ID NO: 2705 - protein, 546 aa, Unknown
  Kingdom: Fungi, Phylum: Ascomycota
MHVAAALVALASLASAIPGSDRPAIKSSHETAKKNAHHIFNEIHSAARQWGSSLNHNGMGFIPATVLKGSLFYHGTFYKDTPTVPEWLAFEAEHAESFAPSRRWRNPDDHEDDTPWSISAGEQNSIGSEADGRSKFRGYLHTYQARRDLNLLYLDGLGAAKASSGTLDSQDYVLRRIGSDHDFWDERPRANDLCNIVTPWGYDGVIRTEIGFEIIHCNFTDSLDLVSRTRTEIGENKMSWYDTWQFDWARAASRRYDGVGADRLKLDYSSMVSGYWFPMNISSQVPGRPDLMRLASAEPEELDTIRDLVEEVARQPRRHTVDWQGIVDQVITRFADRFIILTAEEGVSDMAFKSELEGMTLTYYDAPPHPLDENSVSMTAYYEKREKEAVERCSKQFLLPATIFKDQFSPQDDLIHTAVSEVTHTICEKTQKTWIQLNQTTTEDSSSWANEDEASLGPSLELRRRSDDLTLASAVSEARSAIRDLMQELAWTEWKKTRPCAADSMVYVAMWPFGEKRDHWNPGCRTLKEIEDIKHGSSYWDDLAAQ

SEQ ID NO: 2706 - protein, 1003 aa, Unknown
  Kingdom: Fungi, Phylum: Ascomycota
MLRNAASAARKAVTELSQYPKPGDKLHGFTLVRSKHVPELELTALHLQHDKTGADYLHIAREDSNNVFSIGFKTNPPDDTGIPHILEHTTLCGSAKYPIRDPFFKMLPRTLSNFMNAFTASDHTFYPFATTNAQDFKNLMSVYLDSTLHPLLKQSDFTQEGWRIGPENPMAEDEAGKKLVFKGVVYNEMKGQMSDAGYLYYIRFHDHIFPDINNSGGDPQKITDLTYEQLQKFHAEHYHPSNAKLFTYGDMPLADHLQEANARLDAFEKIARDRQIHEPVELDGPREVTLYGPLDPLVDADRQYKTSVSWITGDTTDVVESFALALLSTLLMDGYGSPLYRGLVEAGMGADWSPNAGYDSSAKRGIFSIGLTGVQEADVPKLKAKVQEILKEARTNGFDPTKIDGSLHQLELSLKHKTANFGFSMLNRLKPKWFNGTDPFDSLAWSDTITQFQANMAKGGYLEGLIEKYLLNDNTLTFTMAPSATYGEELVREEQERLSSRIQKAIKEAGSEAKAREHFEKQEQDLLVEQNKTNTEDLSCLPTVYVKDIPRTKEPITVRDAVTEDVQVQWREAPTNGLTYFRAINTLNNLPDDLRELIPLFTDSIMRLGTKDMSTEQLEDLIKLKTGGVSVGYHSTPSPTDFHDSTEGIIFTGMALDRNVPIMFDILKKMILETNFDSPEAALRIRQLLQASADGVVNDVAGSGHRFAMGFAEAGLTRNAWLKQQVSGLSQVKLITSLASRPESDKLEDVISKLKQIQVFALAGGNMRAAITCGSEGVQDNTASLAKFVSGLPSIPREQPVELRKLQQDSKTFFPLPYQVYYGGLAVPTVSYTSPEGAPLQILSQLLTHKHLHHEIREKGGAYGGGAYSRALDGLFGFYSYRDPNPQNTLGIMRNAGRFATERQWTDRDLEEAKISVFQGVDAPQSVNSEGMGRFLSGVTEEMKQKKREELLDVTKDQVRDVAQKFLVDALNKQEEKIAFLGEKQPWVDNSWAIKDMDVKGAD

SEQ ID NO: 2707 - protein, 1333 aa, Unknown
  Kingdom: Fungi, Phylum: Ascomycota
MASSPPASRDSSPELLTPQAKLKALLNSVDSSGDESDAQKTKRKLNYRAGLPKRLSASPRQQQSSDEESDVEVRPRGRLAARMQGAAAPSSSSAAIPESSLPENARERVRRMLLQEEAEKTKSDDTVEATHVDEEEDEDELPVARRRLTRKAPAQLSTDSPQQTSTQARRSASPTLFVSSPVRLSPSKATDRGAESDNDLPALKSDRFKALVERKRQEREAREAAEESRKAERRAQQDKLTSELGELDSDGGNGSSITDDEGGRQLTQKARPSRKASKKAIEDMNRETQRMARNMQLAHEAKTRKRITKNAMFERFNFHPDGQPEPKTASSSRPGTPTSDTEMKDADTAPSSPPTARKVITEDTIQQTPPEAEGADEVLPSVDELALQTPTLDKGKDKAVDVDSNHEQQPAAKPKRQIRVKMPMPVNHVALDDSDDELQVTRTTKDKLLEIFEKVPLNKAKESHSLHALRALAQLKSPGQNRKQRSRDSGMTEAELHLNLRQRVRQQAVLERERRMEELKAQGIVIQSAEEHEREKQEVENMLLAKAREEDRRLMQEERAAAKKEALENGTADPLAWDDSEDEDFVGSTKEGDDADVEASEIELSGSEDEADEEEEEDEQEGEDNPMLEAEAEEDMEDAAPEATVILTDPLPAEDDEEAQLPSMSRRRGRNLNAVLSDDEDDVVEATPKPQRVTHTSPAVLATDSPAAPGSVLRSAKKTFIPGLPVESGGPAGLGLTQIFAGTMDDSQSQMTPARGPTQSMMPDFDHFPDSNFSARSEARQDKLGPQNEDTQTSTQGVKFDLTQSQIRRLDSLLVAPETQASEMIEPSQDGGFQEHTPLLDRFAAGTPTSTVQTVVLDRTGTNTQPVDSPLVQRGRFRRKLDVIQESKGSQSPSAPTAFNALKDAAEKQKRREQQEDFDRKKSKAKEMVQEQADESEDEYAGLGGADGEDSDDDSVASVQEMIDDEAGNDKDKAKIAAFYAERERLEDEQGMNKLYKDITTGNLRRKRGADYDLSDSDDGGEALRKMKRRQFNKQQAALFSDERVKKLAENKGNAAFLRAMQDDESDNDMNLLDMGEAAEEIPDSTPPQKEGDVQTVPDSQPRKALGNAADNSRAPANLRRTNDGKKPSHIGEIRETLSSLLEETEGSVIPATQPESDSEAEHDELANDVRQASFRSDKENGAPNPRRGRVAVVDRISLKRNSSSTISASRLAFATTAGGSNSAIKVPMFLRTASSAASSSLGSAGASASSTAGAATATGAFGEEAKIKKPTGARGRSGIHGFGAARSGAGVAESEAMAKVRESERRRQEKRARGAERRMGLVGGMLAKGSFE

SEQ ID NO: 2708 - protein, 839 aa, Unknown
  Kingdom: Fungi, Phylum: Ascomycota
MAATMEDQKPWFLRYSYPVLFPTHEALTKPQEEFNAFVLKEIKSRHVDADDVEDVTMDEADTFDSTTLMTESTTAEMRRELKDMEMDADEATEEDVSGRPKVETKNTFLDLLHQYDERKSQQNNQSAQNMENKTFTANGDLTNASTLNPLVDLFAELEDTVSGPRLQDLLRSAWEADSLMTLKIIFNARSIHLGKSSRVTFYRCAGWLAQNHPATLVANLRWLARPVIEKKGKKDPKDEDLVVVDEAKDEDDPLRFDVKHGVAHGYWKDLLNILALAANGELTALGDPSGTLNPENPEYFIGRTKRKRQAKQSGRGGGGRSTKTFRGDAATKQQELRDLATKREEMGTKEGKQTKRDNLERLFNDDAVYRALHLTVARLFADQLTDDLLDLRSDNAKVKRNISLCGKWAPSHDRFHDKHTLIVSTIAELLHPRDSFDHVLDPTDTRETYLRYAREEYRKDISALRKHLDVVERKLSGKEIQAIKYERLPSKAMQNYAPMFIEKDFERFEKYLDKVAEGKAQISGATLLPSLMVSRARGQAVYTPELMKSLPPAAMVKAKVAAMEARVADGQWKALVQRIKDSGTLSNCIAIADVSGSMSWPEFKDGTTPMDTSIALSMIIAEVAEPPFQGSMITFNNKPQVIKVEGSEKTFTQKIKEVEKFPWGANTNFTAVFEDLLLPMAIENKLTQEQMVKRVFVFSDMQFDEAQNTHYGDQRNRYASSLDRIREKYKKAGYEVPELVFWNLAGGQHDNGGGKPVLADEKGTSLVSGYSQGMLKVFLDNGAFEEEEDDEDEDEEEMVEVAEDGEEVVKKKEKKKMDPLGTAKKAVGHRAYEMLKVVD

SEQ ID NO: 2709 - protein, 882 aa, Unknown
  Kingdom: Fungi, Phylum: Ascomycota
MAEAEEDFSSLPLSDRFSHKVWKVRKAAYEDAAKQFALTPDESDPCFRPFLNDPGLWKGAVVDSNVAAQQEGIIALAAFLKYGGRDACLRTRNHTITPMCEKALSSTRAAIKQNAIEVLLLYIELDVANPVVEDVLPVLANKVPKNVAATLNALTQIIHNYGCKVVDPKPVLKTLPKVFGAADKNIRAEATNLTVELYRWLREAMKPMFWGELKPTQQTDLEAQFEKVKAEAPPKQERLLRSQQAAAEAAPAGGEDVDEGEDEADAAPEMDAFDLAEPQDVSSKIPANFSDMLASSKWKDRKEAVDGLFTAIDVPRIKDSDFNEVNRGLAKCMKDANVAVVTQAALCIEALAKGLRKSYGKYRGVVMQPIMDRLKEKKVTVSDALGAALDAAFMSTSLTECFEDITTYLGNKNPQVKEGTMKFLIRCLRTTRDVPAKPEIVSICELGKKLLSESSPALRDGGAEVLGTIMKIIGERAMTPHLEGLDDIRKTKIKEFFDTAEVKAKEKPKAAPPPPKPAAPAGKRVVGGKKPLARKPAAAVMPPSPEPAAPPPRPAAAASKVGVPKPSGLSGLKAPQRRLAGPPGASSPRRPPAGPPVMPDDDAAPPPQPRLGVSRGLAGRSLAKPVMPSEAPAPSEPPAASGLSAVERAELEELRASNDRLSRQVDDMRQERSKFMSEIQELKNQNAGLIEDHTRDVLSIKAKETQLVRARSDVEAKEQVNERLRRELERLKRALSRAEGLGSASGTHSPVVMSPTHDDAGIYRDTGSAAGRNRMSFTSTMSEEKENGEPPAFARTKLSPDLRYAGDSASSGRGSPARGFRSAASHREEGSESGVSITRERPTSSLPQPSGGVESWKRAAEVTSQLKARIEQMKAKQGMNRP

SEQ ID NO: 2710 - protein, 235 aa, Unknown
  Kingdom: Fungi, Phylum: Ascomycota
MSSSTIRRAQQQQQPPPKHHGHGDVAPTMAQMREHYNQKNKSVGYYGLSVIIGFLALAYGSVPLYKMICATTGWGGQPVRAHGADSDTDPDIARRLVPIKTANRIKVQFNASVSDVLPWKFVPQQREVSVYPGETALAFYKATNNGDQDIIGVATYSVTPAQCAPYFSKIQCFCFEEQRLNAGETVDMPVFFYLDPDLLNDMNMRNVETVTLNYTFFKARYDNNGRFKSPQPVTI

SEQ ID NO: 2711 - protein, 624 aa, Unknown
  Kingdom: Fungi, Phylum: Ascomycota
MSNPLPSMPPGQPTAIPVDASSGLWDRLTSWASENKAVVYTIAGVAFVVTGAGVVYYLNGDSTSRSDASPKLSKKERRKRKEAERKAADTKETPAPSQPQAASVQTESELPEIDEASVAALTQQQREEYAAKLKQAGNKAYGDKAYNKAIDLYSKAILCKPDPVFYSNRAACHSAMSEWDKVIEDTTAAITMDDEYVKAINRRATAYEHQKKYSEALLDFTASCIIDNFKSDSTAQAVERLLKAFAEEKAKEMMASRPPKLPSPIFVGNYLQSFRPKARPSGLEDSVELDENTGKGQLQLGLQGLEKRTGDGYEEARKAFSKALELGELGEHEALAYNMRGTMRTLLGDHAAATEDFDKSIELDPGMTQSYIKRASISLELGEPAKADEEFAKALEQNPEDPDVYYHRAQAHFIKGDLSDAQKDYQKSIEIDKDFIFSHIQLGVTQYKMGSIASSMATFRRCIKNFPKVPDVYNYYGELLLDQGSFSEAIEKFDTAMEMEKQSKPMAMNVLPLINKALALFQWKQDFKEAEKLCQKALIIDPECDIAVATMAQLLLQQNNVPGALKYFERAAELARTEGEIVNALSYAEATRTQVQVTEKYPKLAAKLAGGASGPPPGLRMGPQ

SEQ ID NO: 2712 - protein, 839 aa, Unknown
  Kingdom: Fungi, Phylum: Ascomycota
MAQHSDPGREPLRRNDEEPPHRLSSRISSWSDISDIDSNPYDPPSPSPYRSRDSLVSPSSINVPPEEDIGEGSSYPGARSWSASRGAVRGSSYTPLGGRVSRASSSRTSVQSSFRAKIRPERINEEEYDMSLLGSAAPIDGAAHTLGHAPSFDLSAGMLPQEEDFQGQEASGTLTGGLGQGWVPEARVRHEDLLASPVVERSLSRSFSRRLGTMRLNRARALQDVGQDEANRRGEVIEVVIEEQPADLSLMEGPSTMAVNDMRRSTFPNRMENTAIFYPQSNWKPFPMRFPWLCMLVLVSVGLAVMQELLYRRYHETGILRFKSPDDVDPALYFAVKFGPTLAAVVYGVLWQFTDFEVRRLEAYYQLSKPGGALAAESINVDYVTCFTFFRPIRALKCGHYAVAVSSIATTLAISLVPTFAAASIVLTPGRSERMSDPDQEKVLHLTSSWSRLLTSVLCFCALSGIVLFWLLQKRRSGLQADVRGIAGLASMAVVSHVLMDFKGTDQEKHKEIHYRLKNHRYILRNLSLAPDDENPLSLQDREKFANIHLSENPHPLMLRPAGIVPFFFCLILFTGFIPAFLFTRADVVTAEAPWFVTALAVCLKLAWNGMETAVRMMEPYYILSRRHAPSKTLTLDYTALPFGYLPLRALFNGHVLMFLVGFGTVMAEFLTVLVTGLATVEGRDFLVDYRKKDDDKSGSSGLDAGAETVHSFLVSLALTLFILLYMSIITLMVFFGRRHPFLPRQPNTIASVLAFIHQSKMLYDFVGTTKMGSTETARHLETKRDAEGKSKTYGLGWFKGRDGQEHLGVDEEELIGNYKHGRRFHMGNQPWNSRWDEY

SEQ ID NO: 2713 - protein, 472 aa, Unknown
  Kingdom: Fungi, Phylum: Ascomycota
MLFSILLATVSLVSGATAAPAGDASVTEITVRADHKHQKIEGFGFSGAFQRAQLLLNVTEEKQHELLELLYGREAGVGFSMLRNGIGSSNTSFNDWMNTILPESPGSPDGEFNYVWDEYDSGQFWLAQKAVEYGVDRIYANAWSAPGFMKTNRDDANGGLLCGVPGSEGQCEYDWRQAYADYLVKYIEIYKSEGVKISDVAWLNEPDLTTSYASMRSNAEQTADFLPILWQTLKDAGHDVGIACCELTGWDETVEMAEALQALGAEEYLSTWTTHEYTSPIDSELETGISVWQSEYCDLSGSWTTAWDSGVSNGDGHYWARILHRALTVGNVNAYYWWLAIQDEATNNNNNEKLIMVEDGEYYVAKRTWAFAQYARHVRPDAYRVQTEGGELSTTAYENKDGSLVAVILNTEYEATTVKLSLVSCKLKKVSKVQAWLSDEDHDMEEVEVTINEDGTVSAELTARGLITIKAT

SEQ ID NO: 2714 - protein, 365 aa, Unknown
  Kingdom: Fungi, Phylum: Ascomycota
MPGLPEIYTRNIVLEVGDFTLFGCVASAAGFPTFTLAQSNPKMDLDICATLCSGLNYFDVHDTACYCGDEINPATSRVTLDQCDIECPGDNTQFCGGNLTPSFGGPVVTTFTTTVTDAEASSTATEVITATLVLLSNIDCDENLRDMGETGWQGVLEDDDDFAITDKICAKKCGDSLQKWHDSFSKHCAEERILEGPMVDGRNQLCDEDAKTGRYCNVIIDEFPESDEDYGVGGLPVKYLCEPCYVRRLWAFDISSYSPANGWIEDMRERMDKECPKSVLAQKDALTATDALSTTMTASPETSKVSSTVTSTGESVTTAESTPSATNSAVTEVTASPEDNAGARPGSWELGKSLLLTLGMAIFNL

SEQ ID NO: 2715 - protein, 367 aa, Unknown
  Kingdom: Fungi, Phylum: Ascomycota
MISSTMLLRRSLLPKTFTRTLRTETIPSTRIKILRTIPSVRRWRRPQTLDHRSVALVPTMGALHAGHLSLIRAAARENHHVVVSIYVNPAQFGRNEDLDKYPVTWEKDTKILADLDRELADDGGNLGRVSAVFAPGTKDMYPGGFPGQDLDSKGSFVNITPVAEVLEGKTRPTFFRGVATVCMKLFNIVQPERVYFGQKDVQQTVIIKRMVEDFMLPMDVVICPTEREADGMARSSRNVYLGPRRRQVGLVLNQALRAAESAFKSGEISRSAILGAAQQVVDETLKAQLALGPEERALFEIDYISLADPETLVEVDEVDSEKGAVLSGAVKMLPVEKAAEGEDLGFSGGPAVRLIDNIVLPPAAVQQ

SEQ ID NO: 2716 - protein, 879 aa, Unknown
  Kingdom: Fungi, Phylum: Ascomycota
MSDSSHRQPGSDSGDSEHHHSDSHSAPTTVSGEHTTAAKGGSTSELHDHAREKKRRRPALACEQCRKRKVRCDRNKPCGPCLKGRIAPCTYAPTHVPAARGTKKKAATQDGPESASGSTDASSGLVPPDARLIQDPTAIRQLELRPALATRRGSFEGVWATLKGVLPPPEGYSPAGKPTSVEASTPDKSSDIDWLVQRVNFLQEKLHMVTKDPNDSQGPKKWPGHATLQHQEKGKIVKTRYYSCGHWMHGAYLFPTELSILVHAESNKDEAYWNLTRCKDLARTIKESRLQPLLSTNIGQSLPNRVLADQLIENYIRAFEGQTRILHIPSFRAEYERMWQSPESASKPFIMQVQLCLAIGAALHDDTFTLRQTAMQWVYEAQLWMMLPPEKDRITYMGMQVMCLICLARTVCSVGADLSWLGGGQLSRMAIYMGLHRDPRKLGVMSVYRAEMRRRLWATVMELDCQFAIDAGASSSMDNMDYDTLPPANLNDDQLTDDPEKERPPGAEVPALQVATQTSVQVALHRSLPVRLAILRHINGTQGDDSYNATLGLNSRLTKECRLLTKTLNELRESSTNPTSPISTFHVNMSEIGLYRFFHTLHQPMIIQSLEDPRFYFSRKMFLDSALKAANICRLTPRKEDEDSRPKTLSEQDFDRFLNNGAGMIRNVVAQSMMGIGLRIISLKEEQSLTLGYFSTGFDEGLGSKELMVYLQRTMELAKRRIRSGETGVKMLAFVSAAMARCELTEQGAERTVLHKAILEKATEASRIGLELLKERAVLEGTPVPAENAESSNVDMSSGGFGSGVPGFGLGMGGPGVPTIFGSLQAFNSGLGDGMDWMTDWAWDDMSEFGWPAGGGPAQQGFDQGIPTGPIDPAQTMNL

SEQ ID NO: 2717 - protein, 722 aa, Unknown
  Kingdom: Fungi, Phylum: Ascomycota
MRIPWSSQPVKDSAESTVNQGSDDNERSLPLRVKDKSTLSSSIDSGERLQIHPLPSRDAVLVKIQPPRQPEQAIEHIPCDIVLVIDVSGSMQDQAPIPGEASEDTGLSILDLVKHATKTIIHTCNSHDRIGIVKFSNEAEVVFPLTDMTPENKKKALERVEAMRPETATNLWSGIQCGLGLLDSSTSNVPAMMVLTDGMPNHMCPSQGYVPKLKTMLPLPATIHTFGFGYALRSGLLKSIAEMGNGNFGFIPDAGMIGTVFNHAVANLQSTYATKAVLRVKYASPLEIADSMDDRVDPKAIANVEGGLKELTLPLGNIQFGQSRDVYLRVRKLPSARITAISATLEYRPAHVVSSFSEPELADFESSADLSVSGQLSDAEVAFHESRAQICFFLLGFYKFRSDQERRRADMALERWQTQLETLITNLPARAFVDSDMDNAALLEDLCGEDPAGQIKAAVSKVEYLNKWGHHYFLSYLNAHQRQICNSFKDPGPQRYAANSPLFQRCLAHLDEQFDKLPPPKPSRIVYDNRTGKRLFKSVSISRYNSSNAPCFAGSTAVELASGRTVSIKRVRRGMRLSTPLGPRRVAFVLKTPVDRGALRRIGPLVVTPWHPISLDGGKTWVFPAEVADGSVVRYTGAVYSILLQQDPRTESHAIKVEGAWGVTLGHGIMTRGAEDIRGHEFWGDWARVSKEIVRLGVDKSGVVVGNGVLRDEATGLVTGLR

SEQ ID NO: 2718 - protein, 230 aa, Unknown
  Kingdom: Fungi, Phylum: Ascomycota
MDMDIIDGQEVGRKSFGRNYFDHTKFICQRKGTEDDYYYGIGKCRFADATPEQISTMRLVKIPNELIFPKYEEGLTIAPDPLPHNVYIKSPRIIDFGGSEASANVSLHLLHEARMWGLVRGLCFQRYPLNLQKRAAENIPINIDHCFKHIKKGVKHMHTLGIAHNNIRPTNIMMDGDMPIIIDFASTLGFGKGLAGWRAGSQPWIPPEAIASDEYNDHYAAQQIYHWLRA

SEQ ID NO: 2719 - protein, 421 aa, Unknown
  Kingdom: Fungi, Phylum: Ascomycota
MAIELSRNTSPFTSANQSSIMAAEIPYESVSQGIKGSRDALWSMNSTIYDNPELGYNEVIAHDTITACLEKQGFKVKRHAYDIATSFEAEFGEGGRLVIFCAEYDALPDIRHACGHNLIATSSVAAFLGLAQAIKDSNIQGRIRILGTPAEEGGGGKVKLLEAGAFDDNPSAAIMMHPTSAHVLPPHITGVAGVKFVASLKLRVEFHGHSAHAGGAPWEGRNALDAAVAAYTSVSMLRQQIHPDERIHGVIEDGGKSPNVIPSHTKMNWYIRSPTVARGSELLSRVKACFEAAATATGCTLTYTEAPTYMDLRINNTLSNEYAQLMSKLNVNFVPRMEEPFTFSTDMGNVSYTVPSFHGAFGIPGSNGALPHQPNFANAAGREDSFDIALSCAQGMALLGWRVLTDGDVADGARRDFEAVE

SEQ ID NO: 2720 - protein, 381 aa, Unknown
  Kingdom: Fungi, Phylum: Ascomycota
MASAQIPLWLDCDPGHDDAFAILLAAYHPRMKLLGISTVFGNASLENTTHNCASLLTAMGKHKDIPFYIGENKALERPALHAPTTIHGITGLDGTDLLPKPECEPSTTPGVEAMAEAIRAQAPGTAWIVATGTLTNVGALFRKYPELAAHVKGVSLMGGSVGDNFSDAPMGKVDGKTRIGNWTPYAEFNILVDPEAASEVFGNPDLKGKITMVPLDLSHQVLATPEVRNLLLYGRDGPKTGAGKSTLRTMLVELLYFFAQTYADVFEIHAGPPLHDPLAVAAILVGTEDEIRFFDWDEKLSQGPKHDERFEVTVITEGSIEEAKAGHKETGRTLAKELPVGEPGVRIPRGMDEAHFWRVIEECMEKADEVNKKFGRFYIDF

SEQ ID NO: 2721 - protein, 574 aa, Unknown
  Kingdom: Fungi, Phylum: Ascomycota
MHSKISFSALAGAGLALAQNTTTPSTTPSSSSTFSNPRVPTGTPIVGDYDGRYRPQVHFSPPQHFMNDPNGMFVDSNGTWHLYYQYNPTGIVAGNQHWGHATSQDLYHWINQPIALFPPNEDTFVFSGSAVIDVNNTSGFFPDQDNGVVAIYTLAQYPDGQPGPQTQAIAYSHDGGFTFTPYADNPVIDSDSSQFRDPKVVWYEDHWVMVIAYAQEFQIGIFTSPDLKNWTAASNFTGGLLGLQYECPNLIKMPVLDESGDRQDDLWLMAISINPGAPLGGSITEYFPGTFNGTHFEAVDGAARIADFGKDNYAGQWFYGTSEDDLPVSIAWASNWQYTQVVPTGEEGWRSVMSLPRENYLTEVPRLGWKLVSRPYNLDPVLGDSLASNSSLGNGTIVVDYSEVESNAVYFEANVTNIPDSGIPGTATLNFTFSSVQSGEYVSGGFYFGGDTPFFVTRGGARGFENVFFTDKFSTNSLLTNKTSWSMSGVIDRSILEVFVDGGIESATNTFFSNTPLTLMVISASDLTEDMEVSVRVVGLESAWEKEKGDDGLVAGNSTRTVGAEKMRRMFGSV

SEQ ID NO: 2722 - protein, 226 aa, Unknown
  Kingdom: Fungi, Phylum: Ascomycota
MAFGTALAMPTVRGLGHHHNFNDDDTEPFPQVPSIEVMGAPSSPTSQTGSRRRDRDTGFPEPFNDDRNTTLPYPGADLSPNARITMEDGLLNTDPFSSKRSFRRSRLNKHKRTVSYGRITPQFEALNSVMSIVDATSGMSRTSSAGTRPDTGNATTPAAPATTAEAPMQASRVPATPISASYSSPRTSRDETDSFRSKRDDETPPSSPESHTSRKGGFLSRWRSRG

SEQ ID NO: 2723 - protein, 369 aa, Unknown
  Kingdom: Fungi, Phylum: Ascomycota
MAEEDYEIDFYGDDEPEQADQKQQQPAQDDQHAQTNDDRDQTKEHHDSREQNGSTDDRMDDQQDHEHYENNTEQHAHQGSKRKSEDEGPVDPDATTALMISELNWWTTDDDLRGWLREGGCEDGVKDLTFSEHKVNGKSKGQIYVEFSSLKAATAAKHLVSQMPTDSGNLGKKISAAYWNTSMNPFRTLPKDAPARGGKEQGRTSSGSYSDRGGYSDRGGYRGGRGGFNANRGGNMGQNNYQRNNYNNNNNNMGYNSGGYNNGMQGQFGFQPRGGMMGGMRGGGMRGGRGGPMMGMNMGMPMGMPGGMPGGMPMGMMGPGGMPAFQGMPPNFGGGGFGGYNPNQQGGGGGGGGGGDWGNPHGAKRPRPE

SEQ ID NO: 2724 - protein, 383 aa, Unknown
  Kingdom: Fungi, Phylum: Ascomycota
MLFNVAHRKIHQAASFSASQPKRDQRITMSQPSGSGRIAIKFGSGNRNKPSSSSRPAPPSALGKRSRSQPWGHDDDDSGSDDGRHNGTHETITGFGASGAESEDRRKKPEKKEFVISRQPNRDWKVEARGKRGRHTSPPGRATQETGQGKGGDIETEPADQDKGIQWGLTITRKDKTEEDAKEAEQGPEGSSEEVPKSPPQAPRTADDEALDALIGKAPKKDDLVIPSAPVTEDTAYQAAVATAGEASTLADYEAMPVEEFGAALLRGMGWDGKERAPSKKPAVRRPNRLGLGAKELKDAEDLGAWDQGKKRGGGRDKRPPKLSEYRREEEKRKERRGEDSYKREREREKERDRGYGRDGRERDYDSGRDRHRDRDYDRHRRR

SEQ ID NO: 2725 - protein, 623 aa, Unknown
  Kingdom: Fungi, Phylum: Ascomycota
MPYLSSNPVDKVKEPLHDCILSGDLLSLRELLSAVPFGGVSKLAGRATEGENRRHTPNGTPLQFAACLGDLAAVEVLLGAGVDPNWAVRGHELVIDGDLRRIAFTPLHLAIVYGHREVAARLFNRVTAAMKDVLPTTRDEAKQGQPKASATLGGCLFLAAHAGHVDIVQDLLSSEHKLSFEAFEGALRVAAEKWNPNVTDALLSWNGACSSLALQSALDMALSRACSSKHDQLLQVWYESLPCSGLDHVNRSALIARLIKAGANPNHTDHGGMTLLMCAASAANSTGVLKALLENGADPNMISETLGTTALSFAAEAVMEYSVDADVEMPKFMWNETALKLLLEYGASGTIRGPDGTTPLHRAARTSNVRFVGLIAGSDQKSGSPLILPPSILQLENNRGETLLHYACLGGRLDIISMLLDHGLDVNQRTKQGLTPLLCALKLGDEWKPEWWHDPMTAFDNWTNKTTTIAVQAAHLLLSRGAEFQPESDDGRTALYILCSLRDGSYDPHRGVYNLALQLLEQNKALITSPMTTSTPPIKSDSSSNDDGSDSTHESRRNITLLHWAVQKQSLAVVKALLDMGADTSATDANGYTASRAAREVHRTQDTSLGSAVLRLLEGETGE

SEQ ID NO: 2726 - protein, 413 aa, Unknown
  Kingdom: Fungi, Phylum: Ascomycota
MAADSGSAQCAASKPTLRLLAESHIQNCATKETGGSYFSSAQWTADGTCLLATSSEQVVSTFVLPTDLLDQREQPQDLSPEASVQLPEPTQAIAGAPYFSLAEPPSQLFLAACRDHPLQIRHARSEDPHAAPLAIYKLIKTETEAYIAPSSLMWEHPGTHFICGSMNRLDYFDVQRAGSDGPFLTIPTGPSRANRSKGYSIGMKGYISALASTKPDQHGCSILAAGTRTRWVGMYDIHRTDKAIANWAISGKDGLSNDMDTEGRGVVQLKWSPCGRYLVVNERRANGLLVYDIRGSGRLLGVLGGRSLNTQQRLSCDVFAGDTNHDTSFEVWAGCEDGSVKVWDHVGKHEGLTEPSWDWKAHESPVSGTMLHSSGSVVATCSGAWGYPNGVESDDTPRAKVMEESSLKLWAIS

SEQ ID NO: 2727 - protein, 631 aa, Unknown
  Kingdom: Fungi, Phylum: Ascomycota
MRVGVLVPCLWVALGLAQAFYDFGTDVAKFTRRQSDGSRIIVGRLPVLNNNTIPRRLEIREMREDAYKWDLFILALSMFQYVNQDDPLSWYQIAGIHGVPFQTWNGVEPVPGAAASGYCTHSSALFPTWHRPYLALFEQEVYRLANLIAGMYQNSAERALYQRAAADLRIPYWDWAKNAPTGQTHFPDVFWNAVITQNGPRGPQLIRNPLYSYQFRPVNEDAFIWSPLKYWSETKRAPDMNVSIFFPPSRNDQINAALLGKLPEIQQRLYILFSGYKDFNSFGNKAWAVAQNLSTVDSLEAVHDVIHIYGGLKGHMTYVPLSAFDPIFFMHHAMTDRLVAIWQILNPKSWIQPMATGETSYNSLKGTVQQSSTPLTPFFKSHDGAFWTSDDARTTQAFGYTYADTDPFLAVNQNFRGELARKITSWYGGSSPIALRAKATPEQGTEPAGGVLPRDGRFKSLRPNVKIDAPDPPFQMIVREGTYTEWVANVHVNVEALDGSFTIHFFVGESSIDISEWEGAQNHIGSVNIFAMNRNTGSQSKISGTLPLTSALLKLVALGALPSLDPSVAGSYLRSALQFRVVSGDDSEIDPRWVEGLFIGVSSSDVKLPDTDLELPQWGNAIKRLELWPTP

SEQ ID NO: 2728 - protein, 910 aa, Unknown
  Kingdom: Fungi, Phylum: Ascomycota
MQDENDRAAKNPEDSDDADSDLEELQGDIAKFDESVRQFLASHHGATDTGSSGRGGPRGRGARGPRKAAKPRGDITARLAKVNQAFLSGDYDRALDLAFEVIRINAETHQAWTALSSTFAEIGDTSKALSAMVYAAHLRPKDVAGWLRCASYALDTAAEDEASNLHTARLCYSAALRAEPHNLDARTGKASVSHRQGHLGTAVTDYEKVLKRRPGDIDLVRRLAEACMDTRHAETAVPTAIAAYQRCFRLYMGESGDLEPELDLWYDVGVFVEMYAYTGQYLEAIRELKSLVRWLLGRGGEKFWDQWQDDDREWDLDDHRRSQMPHSIEMPVNPEGLNEHRQLPPDLRARLAIYRFRLEQPEEALHHLSVLQSNEQTAETFADDFPYLAFDLAASLAQYSYNAEAKVFLDSLRNLPGDVDPAVLLELGRCNLALGDTSAAEECFLAAIDADEMGIEPRIELANMYERAKEGEEALILAAEAMAIREAQGQGTVFPASSSLDIASNTSEYTARHRATVGSVSQPSVPRVRPMIPRRYRPKRLADPTKRRQEEQAHAVKLAQQYQIVTDLKRQIAHGQKELIPTWMASANDLIDDFRSLKRFYTWDRYLNFLGSNSNKDPTEPRSAQENDLSQLYQRLARNVAPAEERSARADVASIFGAHQGITFDQWLELFLDHAIALAIDHRQEEAYRVCESARDSTVFQSAEHNFSIHVAWSAQKFILRQIKTIDAAHASTSNLPLSDAANQIRITPPESKLDICLLMLYGHILFTSTSYTFALGYFLRARSIDSNNALVNLSLGLAYVHYGLKRQSANRQYILLQGQSFLTKYASVEGGDQGGLGSAESNYNIGRLFQLLGISHLAIEYYSRALRASEDASDDENVARMAMVNYVNLLILLKQRQLALALTRQNLVL

SEQ ID NO: 2729 - protein, 522 aa, Unknown
  Kingdom: Fungi, Phylum: Ascomycota
MASQQHHQQLRRRCSSAADRAPVEPLAEPEATTTTLPSSEHSTPVIAHETTMMALEFGPFNAGSDADAMPPPPLPTGTGVEASSPTRKARSTSAASRNANRLSLTLPIAPPTSDPSRPTPTSAVSSSIPPTPIDSPGMKTPSGTNEFIIAVAAQERRVLELREELARAEADLIKLKKQWTAQEAQQKRASLRQLDLSRTSTPTQDDEPRSARLSTDLDRRRSLMLNQSTPTNTPGRRRVIRGGHTRTLSLLSPPKSDAGFAVHEDKEHEALKFPPAELRAAQLTNPTLSKRSSWQPRMSHAQLQQAGGAAMPQLVEDFKLGFRAFVEDIRQITVGEEPINGQNGTPGQSTAGSTENTPKDNNTIRPSQPARPNIMTTFDLAGSLAATPTPPARTRDVGRENVRPIKNKRFSWTPLGFDSLDDTDWSNWESPASTKSSRWSGSTVNTSATEDTPPIPETEEESSRFNRLERDTPLSPAKLKEMLPSMVNGFSPSNIKRTATTLMTEWEKSLITPEDRDKENDM

SEQ ID NO: 2730 - protein, 118 aa, Unknown
  Kingdom: Fungi, Phylum: Ascomycota
MLYELIAIVRPGSLSEVKEIAQTVGTLVLRNGGVIRGIANWGVSALPKPISVHQIKQTHGHYFVMRYDASAKIHDTVRSTLRLEPRMIRSAHVKLGDGRLTTTAKFGAPKWKTKFGEA

SEQ ID NO: 2731 - protein, 332 aa, Unknown
  Kingdom: Fungi, Phylum: Ascomycota
MQAISRSAVRSAALRQVSNRAYSSASSPYSKTIENLRINGDTKVIFQGFTGKQGTFHAQQAIEYGTKVVGGTNPKKAGQTHLDLPVFKNVSEAVKETGATATALFVPPPLAAAGIEEALSAEIPLVVCITEGIPQHDMVRITDMLKTQSKTRLVGPNCPGIIAPGQCKIGIMPGFIHKRGRIGIVSRSGTLTYEAVNQTTQAGLGQSLVVGIGGDPFSGTNFIDCLKVFSEDEETDGIIMIGEIGGSAEEEAAEFLKANNTVAGGKPVVSFIAGISAPPGRRMGHAGAIVAGGKGGADSKIAALEAAGVIVERSPASLGKALYDEFVRRDLL

SEQ ID NO: 2732 - protein, 365 aa, Unknown
  Kingdom: Fungi, Phylum: Ascomycota
MADHASPATTPAPEAAAPAQAQPATQISEVTGLPEQTPQEAIVQGPVQVDDDLTEDDGYGGSEGTGSYVTSLASSVVNYKYENGRRYHAYREGTYLMPNDDDEQERMDIGHHIYRLMLGGELGLAPIPKNPARVLDLGTGTGIWAMDFADEHPASEVLGTDLSPIQPKWTPPNCVFEVDDFESEWAHRRPFDYIHARELGGCISDAPKLFTQAYNALTPGGWFEINATRPGRFLSDDGTDKLAKDAQFWMTNICEGAGRFGKPLDSAHEWAQQLREAGFVDVKEEIRKVPCGPWPKDPTLKEIGKAQIHQETQLISSYTPAIFSRVLGWEEAEIQVLMAKTKNDLKNPAFHLYLPVYFVWGRRPE

SEQ ID NO: 2733 - protein, 295 aa, Unknown
  Kingdom: Fungi, Phylum: Ascomycota
MASSTTTPARHDDIDNYDAGDLSDDPFASPPPDSAVKKRKANGDGGLGIDEEVSVQKRARVPNVKLDEDRLLGPAGIPKLKARAASLKIKGKGHEFSDAARLLSFYQLWLDDLFPKARFLDALAMVEKAGHKKRLASARNEWISQRPKQTDDDDENSEENTRSAAHFSAAVNGTGDKPSRPSRDVPDDDDLYDATPRAARQTAPAADVPEDDDLDALMAEAEVNDRSKQPASTSAGPKAGAEDDGDELDALIAEAEGTSSGSKPVLNGDASRKADRGNDDFADEEAAMQEMDGLW

SEQ ID NO: 2734 - protein, 436 aa, Unknown
  Kingdom: Fungi, Phylum: Ascomycota
MTGSGAPGGGPSPGFGGGAPHRSFEDRAVAREQMMSNIRETSQQDRRVYVGNLSYDVKWHHLKDFMRQAGEVLFADVLLLPNGMSKGCGIVEYATRDQAQQAVNQLSNQNLMGRLVYVREDREAEPRFIGATGGNRGGFAGGMQGGFQGGYGGPPGGAQGGGGGGGGGRQIYVANLPYNVGWQDLKDLFRQAARVGGVIRADVHMGPDGRPKGSGIVVFESPDDARNAIQQFNGYDWQGRMLEVREDRFAGAGGMGFGGRGGFGGMRGGFGGGFGGRGGFGGRGGFGGGFGGRGGFGGGPGGHGNFDGPPPAAAAPNPFTDYATSGTDRSEIIFVRNLPWSTSNEDLVELFTTIGKVEQAEIQYEPSGRSKGSGVVRFDDAEMADTAISKFQGYQYGGRPLNLSFVKYLNQGGSGSTAGDAMEAESHGGMTQDQMM

SEQ ID NO: 2735 - protein, 285 aa, Unknown
  Kingdom: Fungi, Phylum: Ascomycota
MAFTTNATIASFGGRILKLTHQSSTTGTPMNLNLFLPASASTSKPSPLLIYLSGLTCTPDNVTEKGFLQAHAAPLGLALLYPDTSPRETNLPGEHDSYDFGSAASFYIDAKKDPYSKNYKMESYLTKELPSLLFQEFKELDSGRVSISGHSMGGHGALTLYMKNPGAYKSVSAWAPISNPSKCPWGEKAFGGYLGDDKEEWKKHDATELVGGWKGPLNALVDVGTGDNFYKQGQLLPENLEKAAKAAGVDGLQVRYHENYDHSYFFISTFGKDHINHHAKFLSLL

SEQ ID NO: 2736 - protein, 263 aa, Unknown
  Kingdom: Fungi, Phylum: Ascomycota
MTDHDDNDDLFTGNLMDDPEDYYPPSPPPTQTIYTLKSGHPLTLNLVGSSPTEAHHLWNGAKIISDYFEALPSRVSGKTVLELGAAAGLPSLVAGLLGAEKVVMSDYPDVEIVQNMQKNIDLCDEGAPASLKGKIATTIDAAGFIWGTDVQPLLQRLPSTSSKFDVLILADLLFRHSEHGALVKTIKEAMKGEGTAYVFFTSYRPWMREKDMKFFDVAREAGMEVVKVEEVRLEKPMFEGDPGDLEVQKTVTGWELTWPQKKD

SEQ ID NO: 2737 - protein, 197 aa, Unknown
  Kingdom: Fungi, Phylum: Ascomycota
MQFSVVLLAAIAGLASAQNDVQSKPFRLELCSDDKSLNGKGLTACHTGAAIESLCLYDGKGSDFRFNTTKGDTAQLKGFTPSGELIFNLPLGDKSSVSSAMSFSMEPSTNVALPLFMPGDSPAQYVAFDKKSGALRVFSYIDDTKKPVKNTGARALNRWYICSTNYLGYNYKTLSWVYGKDKPQNPSCKKVDVKRKF

SEQ ID NO: 2738 - protein, 196 aa, Unknown
  Kingdom: Fungi, Phylum: Ascomycota
MSLETLTLEHLPETHKACLAFYRDVQNAAFLHEQLLARNSDFEYAFIDASVIVSRLQVLSAVFKATSTAVDGTLKTPNVHSEIVASLTSSNNIAEAYRRFGVSPATKDLIVIKVTFSTATTEPLSADKVWRHLEENVKGSPTELTDEALVEITDLQKVRKYYKLNGLPWLDNLKDEKAKRKELEGLILGGMALRGI

SEQ ID NO: 2739 - protein, 1232 aa, Unknown
  Kingdom: Fungi, Phylum: Ascomycota
MAVLDDKRAEAQASGSSEQIDNVSSSSVAAALAEENLAIPPLEPDHDAPPAYGDSHNQMHFSQPGLDAGAQVTDDGRVKISINTKNNRLADILRPAIQRQLQREPTLPPGYIPPSLGGQPGQEPPPKLNVVIQIVGSRGDVQPFIALGQVLKNTYGHRVRIATHPTFQSFVEENGLEFFSIGGDPAELMAFMVKHPGLMPGFDAVKSGEVSKRRKGIATMLVGCWRSCIEAGNGLGPAPRPHAKSAIFNPHDDLPGDGTNAPFVADAIIANPPSFAHIHIAEKLGIPLHMSFTMPWTPTRAFPHPLASIQSSNADDVLTNFMSYTLLEMMTWQGLGDVINRFRENVLDIPHMPLTAGPGVLTRLRVPYTYCWSPALIPKPNDWGNTIDISGFYFLNLASSFTPEPSLAEFLDAGPPPVYIGFGSIVVDDPNAMTNMIFEAVKKAGVRALVSKGWGGLGADDIGVPDGVYMLGNVPHDWLFQKVSAVVHHGGAGTTAAGIKAGKPTLVIPFFGDQPFWGAMIARANAGPDPIPFKQLTADKLATAIDVCIRPDTQERAKELGQKIASEKGSDEGGQMFHKHLDMGSLRCSIAPHRNAVWRVRRTPIKLSPLAAAVLVDREIIQYSDLKPYRSKEYVTESQPPDPISAAASSLLMDISGIGLAVADMPRQLFKSARACSPQRDGKKKAKDEDSQPASGSAMQQALRGRQRGGSGSKSSLSLVSSPDSFDASSTLLGETDSVTSQSIKTQDSDSTGQLTPSGTMTPVSTEPPAPPPKTNTQAQDSNCAVGADAIIEAGKGVGHIVGMGVRTPMNFTLGLAKGFRNLPRLYNDDTVRPEEKVTDFRSGLKLAGKEFGLGLYDGISGLVTQPLQGAEKEGAAGLVKGFGKGIAGIVTKPAAGAWGIPAYTMQGLNAEVNKMFGRSLQNYITASRVAQGKGDALSATPEEKEDVVVRWNAMKEDLKPFYNMKEGRHRLSHRHSGKGKALDDTESAASESDVPRTGFWNTRHLSFDERKKLHAQKAAKKQQQQKVTGTSTPHPADSSSIYSMSSEDAEFEQAIRASVKETSRGNPEEDVMVEAAIRASIRAMKEKGVSIPQPEQVQAPPEKDPSIFKDPEYQVTDEQYQELVEQALQKSVEGQAHGSHATSAGADDEIKRAIEASMADVQKEDSQRTEEDIVMEYVKKQSLAEEEFRKKHPGAISGSTVEEKGEDEDLKRAMEESLKMSHSGGGGPSGT

SEQ ID NO: 2740 - protein, 1009 aa, Unknown
  Kingdom: Fungi, Phylum: Ascomycota
MPSLLPLATGLVAISVTVGFIVFQIILASSAPNADAVRITAIISIAAQGLVVLGLGALCVTHIVETLEALVKRHMNLTIGVGFTLSTLAAIASVATLVLLSKTTSDLGPDVLGMSKTTMLITSAILVGTAYPLQLLFYVFQFVIGRKPTSDAGPSIFQRGKSPTSGSKLKAIPYNQTNVSLDQRQANNSIDAPSFAASVVGRKSGVESSGSVSSRTRLLPLREKRRPASLESMANRSSTEDTFESWDTSSVDAHNRQTVLDVSSSPPTAQKPRFLETIPASPTGSRSPSPGSSIDLAPPRRARRRSRSYSPASSRRASITSMPNTSEAHIHPLFRSDSAEPPPVATPGTSVVASPIAGQVISPRPSMRSLNRMRSGSLPAAPSPLSRQSSFEDAVAKRLQDEQSSIKEEKEDEEEGGDDDSVRKMTPPIPDWIMRWRIEAVGDRGEQMRMQMRFIMMITTGFFTKYTTDGQEAGLFLSIIVRNDPKWCIEKVMRDHKLFSGPSGPHQRHSRQLRHLGAGPALAKPRFPPLREGASATTTSLAVTPLRSLGTVAKVPSVAAQPRLQGGSLFSSSAYLLQLRLYTTPNRARTSLIASKVSHAASRSFWNFLHHNPTLHPSASGHRSHTLAIMKVTFRDLKQQKFSLDVNPDDLISAVKEKISAEKGWDAKHQKLIYSGKILKDEETVGSYNIEEKGFVVCMVNKPKEKPAPAAAAQSSSAAPPATPAHAAVASTPAAPAAPAPSLSSAAAAPSTPTPQRTTEAPAGGNESSGLALGAERTEAIASMEAMGFERSQIDAAMRAAFNNPDRAVEYLLTGIPENLERSRPAAPAQDLAPEPEAGEGDDNVNLFDLAAQRGGGEGRGAGSRGGADLGAAAGAGDMGNLDFLRSHPQFQQLRQVVQAQPQMLEPILQQIAAGNPQLAERIASNPDQFAQLLSEEGDDDAPLPPGAQSVAVTPEERDAIERLTRLGFSPDQAIQAYFACDKNEELAANFLFDQPDDDDQPPGAGGQN

SEQ ID NO: 2741 - protein, 726 aa, Unknown
  Kingdom: Fungi, Phylum: Ascomycota
MDDPWGSPWAADDSQPKLDLPAPPPQVHTPQTPHRLASPWGADDEDDAWGGWNGAEGGAGTESPGWGRSPGLRPARSGTVSRHVSPDPWGRMGMLDSMSDVTDDRKSIKDVPPTVDSAISMGEESLAVSFQDEKTTVGKHDTHDLHIEADEVDIRSNSSQSKDESVGLESREPELPASPTGKPSPALGGPDRPEAMRQSSKVQELVHMYDGIARRKDPPAEPLLTGPRIVLIGSDGTEESDGDIQLEPAMRDIAPSKPESRPESPERHGDEEPGNGNTGHSESDSSKEEHDIEPAIDTWEARHEPSIDAKVPSVPYGYDLKYLDELFPATPTPPVDPEPVPDVIIDDTFASISERKAWYRTSRRGPMRQHNQGNDEDYVRLDWRSSEVRSRTLHIVRRWMEEDSIAGRVVLGRRTGPVGASMFNWDSQAPQVQIGDLFGKKEHKRSISGASRGSRGSLPSPASATFAWSGGHESPAASIGKPSLDEPKRNSFIAPPPTMASSTIPSFGWNSEPRGAGMMNGGAQKAPSPIPAAPTRVLPPLDAVVANGPTKEPLRAETIEETEDEDEWGEMVSSPTWPSEPLTHDKKALPMSPDHATTPRSDPPDPIDALVMAAGPETHGASALPETYPPNKRETIATLPGGFGGVHENPGLDLEIPVVREAPIASAQSVESDPWDSFEGPSVDPSPNNEEPEVTPKTQPQSLTEDEEAIVKQLLKNIPDMSYMLR

SEQ ID NO: 2742 - protein, 251 aa, Unknown
  Kingdom: Fungi, Phylum: Ascomycota
MVSKLALAATVGLAAARPAPQNKPLIVGGVEAASGEFPYIVSLQQGGSHFCGGSLYSSTVVITAAHCSTGISPAQVTVTGGTNTWASGGTTAAVSSIVIHPDYDAGALNNDIAIWHLSEPLGEGEGIGYVSLPTQGSDPAADSTTTVAGWGYLEETSWDVSPTLMKVDVPIVDRDVCTTQYADINPITDAMVCAGYDEGGKDACSGDSGGPLVDGDTLVGIVSWGAGCARADYAGVYTRVGAFIEWIAENL

SEQ ID NO: 2743 - protein, 1525 aa, Unknown
  Kingdom: Fungi, Phylum: Ascomycota
MPVASSRPSRRAATRRNAVVDSDDEEDQIANTTRRTENEEEDFEPEASQSPKRTRRSSRQSSIAPSQPPAPTRRARTRKSVAPDVSVAQDITIAEREEESEADLTIKAAPETPPKRRKMNTPSIAVATPASKVMPTPQSAAPSDFTTVTATPLSDITTTSINTRLLDDTQATVKPIRTMDAIMENPIDIKLKSRTMTTMPVVEPEAPKSRIVLTYLILTNFKSYAGRQEVGPFHATFSSVVGPNGSGKSNVIDSLLFVFGFRASKMRQGKISALIHNSAQYPNLEYCEVAVHFQEVMDQPDGSQYIIPDSDLVISRKAFRNNSSKYYINNKTSDFTTVTTLLRDRGVDLDHKRFLILQGEVESIAQMKAKAGNEHEDGLLEYLEDIIGTSKYKTPIEEAATEVEALNEVCVEKSGRVQHVEKEKSSLEDKKDIALAYVRDENELVTKQSALYQLYTHECNENLVVTQEAITEMQAQLEAELEKHHGSEQHIKDMQKQYAKGSKELEAHSKQAQALAKDLAKFEQERVKFDEKRKFLDDKKKKLEKTINNAEKNSAEADETIEQCSEEIETRTKEIADLEEQVKAEEVELGNIRDSLKGKTQAFSDQIAAKQKSLEPWMEKINQKQSAIDVAESELNILQEKASAGAKAREDLEAKAVQIEESKLTKAKELKEYEKKKEELSEEKAKFESEMEQLAGTEPKMRAKISNARQKADEARSSLASTQTRGNVLAALMRMKESGRIGGFHGRLGNLGTIDQKYDVAISTACGALDNFVTDTVEAGQQCIEYLRKNNLGRGNFICLDKMRSRDLSPINTPEDAPRLFDLVQTKADKFRPAFYHALQDTLVAADLAQANRIAYGAKRWRVVTLAGELIDKSGTMSGGGTSVKKGLMSSKLVADTSKEQVAKLEEDRDAWETKFREFQEYQQECETRLKELDREIPQLETKMQKLTLEMESATKNLADVQRRIKDVSKEHSFSAADEKRQSALRTEVSKLKREIENLHSETASVEGEIKALQDKIMEVGGEKLRAQRAKVDGIKEEISSSQEETSSAEVRKAKAEKQKVKLEKDHNKASKELNAALGDLEKLDNDVSNQGEKADELRAKVEEAEESLKAQKEELAALKSELDEKAAELNETRAVEIEMKNKLEENQKALAENQKQLRYWNDKLSKLALQNIDELIGEPDKAPVAPQPEEGAEADEQDGEPAQDEAASSDVDMADARSEQTSSDAEMVDARSHQTTDSSEQGDDEGDESGTIDGDNTMVVETRAAKYELPQYTPDELAGMSKKTLKGEIAALEEKTQNVNIDLAVLAEYRRRVEEYVARSSDLNSALAQRDSAKKRCDDLRRLRLEGFMEGFGAISLRLKEMYQMITMGGNAELELVDSLDPFSEGILFSVMPPKKSWKNISNLSGGEKTLSSLALVFALHHYKPTPLYVMDEIDAALDFRNVSIVANYIKERTKNAQFIVISLRNNMFELAARLVGVYKVNQMTKSVTIENRDYIARPQPAQRQAPRHAMGGSGGNTTTLALR

SEQ ID NO: 2744 - protein, 331 aa, Unknown
  Kingdom: Fungi, Phylum: Ascomycota
MSSPKLIAVYGATGAQGGSVVQSLLANKDHAFKVRGITRNAESAKAKALASNDVEVFQADGFDKEKMVAAFTGCWGAFINTNSDDPAVNQPGGPNEEELGKIVIDAAAAAGVKHVVFSSMISVTDLTKGAVPAISFDHKHAIGQYAIDKGSFETVNLISPGWYMENHLMEEMAPVLGGWPFVADDEGYLTIHVPRWGGNEKIPFIAISEDWGDLVHGAFLQPERYNGKLVHGMSQEATATEVVEIFEKVTGKKSRYVPIEDWRTFETYGESGLETVKYMFGFCQYSGGLYYAEPNDVSAAADLKKIASEAKGVAGEALTTLESFLKKHFVV

SEQ ID NO: 2745 - protein, 743 aa, Unknown
  Kingdom: Fungi, Phylum: Ascomycota
MSDIPVGAAIEEAAAPAPAVNNAPTFEGANKFQHAISSWRNLDFTTLTSNLDNTASEIVTYQRDSTVQRKDLAQKTKDFRKYDDATKLTEVKGLLKAYQTFIDLITNHSKSTNSAFLQAYTSLSDVPDPYPLLEASVDAMLLAEETVPKLTEENKHLQENVANLTSQLEETEARLQTERAARKELEDNLEARVKEVESSWTAALDEKKDNWEAKEKSLEEKVENQDRLLNEIRASYEVNQRLGKSGDEQDGQKGNVSSAEFEMLHADLERTSSRLAEVEARNENMRIELAQAKASQTSHPEKSLEDDPGYMRVRSENSSLIRRLDATRVEKDGLKRDLDTKLRSMEREVQLLKEEKDTLKAKVQKWSDYDDVKQELEVLKSIEFATGDDDETRDQLEGVVANGASGETLEKLLLSRNKKLGDELAILRVSHQDLQTRLEDLQEELSRTNAELEKSQNLNEKLENDLESMQAEGANAFPSGASVAGTYITRNAGRNRGGRISPTSSIISGMDPRSGPGEREPMGGGSGILPMVTAQRDRFKKKNTELEHEISESHRTVQQLRQEVAALQKDNLNLYEKTRYVSTYNRAGATASSSSAYATNPNPSTVSIGGASSPGVGLDRYRKEYESNISPFAAFRGRESARAYRRMSLPERVVYSITRMVLQSRMSRNLFAGYCVALHVLVFFTLYWLGSADFESHATNMGASAAAAAAAAGQAARGQAAGAGAAAGGGDSAWKPAAFDGKT

SEQ ID NO: 2746 - protein, 233 aa, Unknown
  Kingdom: Fungi, Phylum: Ascomycota
MMRLRPTTLSITTSELKDFELRSRYRKYLRSTTQAKPHDKSPAKLSRNPFEDCLSFLHPNAARAGSLSADESELEADQGFIYLGDVTRLSSIAVEGSTAQLQGLVLTRQQETMSERQNGYDLNDPGEDASMHAAIVQASLSPRGSQDPTVTLPPPFSSRPRALSATTSPATTTDGPVPNLDGCDGGSLDTDLTNEAEVGEVDIRMPGQTILYLPVANRLGPSSLRSSFTTACN

SEQ ID NO: 2747 - protein, 474 aa, Unknown
  Kingdom: Fungi, Phylum: Ascomycota
MPRSITGDTGSVSTATIADQNPGATPAAKTPLEASDIKKHDRQDVTSRAADVADEKKAAPGPPAGPPPGMRPEDFPDGGFKAWLVVFGGWCALFCTFGLVNCIGVFQKYYVSGPLRDMDPSTVSWITSVQTFTMIFFGTIYGRLFDNYGPRWLLLGGTVVYIFGIMMVSLSRTYYQFFLSQAIVSSAGSSAIFSASMASIVTWFLRRRAFAFGIMVSGSSLGGVVLPIMMDRMIKSVGFPWMMRTMGFMFLALLAVACATIKSRLPPRPKPFVFMDYVRGLQDILLSLTALSFFLYASGMFIPFNYILTQAEAAGMSEGLIPYLLAILNAASIFGRIVPGILADKFGRYNTMIFVNAISAIFVLAVWIPVKNTAGIIVFVIIFGFSSGGFISLAAPIVAQITPDLREVGTRLGVVMACQATGALVGSPIGGAIVSAQDGKYLGLQLFCGIIMTVSVIVLLVIRWMQVGFKLAAV

SEQ ID NO: 2748 - protein, 137 aa, Unknown
  Kingdom: Fungi, Phylum: Ascomycota
MVPGTGVRSGRRWVLPAPNLNTKPTTIVSSRDRSPKAEYSYPAHPIEFYIMSAAPHFWATPLKYFRWASRERPALFWSVVIGFAGPAMLPTVPPIRRYFGDVDPAPIPVTYPGTHGILFGRIECSQVEEYTKAALTI

SEQ ID NO: 2749 - protein, 327 aa, Unknown
  Kingdom: Fungi, Phylum: Ascomycota
MAVLVTGGAGFLGHHLIKVLLERGRDVIALDSLWTGSVDNIRDFESSKHFAFIKHDVRDVLPITEPVEEIYHLACPASPDQFENAINILDTCYQGTRNVLEFAVKHNARVLLASTSEVYGDPTIPTQAETYFGNVNCFGPRSCYDEGKRVSEALCYSYHTQNNLDIRVARIFNSYGPYMDFKDGRAVPNFIAAAMENRTISIYGDGQATRCFQYATDCVVGMVKLMESDYDKPVNLGSDLEMSVGDIARMVAKVVAEKMGREEAVGVELLPKRKDDPMQRKPEIAVARDVLGWKTEVSLEEGMAMTVDWFLERRGKMTNGHGSHKPT

SEQ ID NO: 2750 - protein, 1330 aa, Unknown
  Kingdom: Fungi, Phylum: Ascomycota
MTSNPPGDCCVTGNLHEGTPTGEDITIQGSRIKAYLSRAKTPKSNNGAILYIPDIWGISPNSKLMADNFAAHGYTTLMPDLFEGDAVPIPRPEGFDIMGWVAGGTNGKQPHSKEQIDPITVAGIEALKEMGFKKIAAVGYCFGAKYLIRHYKDGIDVGFVAHPSFVEEAEFAAIPGPLSIAAAENDTIFPVENRHKSEEILRKIGVPYQITLYSGTDHGFSVRGDPKVKSQKFAKEQAFRQAVECTSSSWRPPHQLTPAPESDPTPALAPTAESKRQLRHSTAAFCHHRQSATTSLLQCRIQSSISVDLAHRPLTSIVQSSLSSTVVYHAAEPLLMAPSADQGEPPPLPSPILTPTTPTKPSLRSTDTNATLSTIPSDEDRSSEESSLRSSPGRRDRSNPSSISDATPDAEEDYLNNGEATPAAPTHPERWEEPAPVTNSRSRSSSSATNKKSVTSDGVQRLTAAEIKELASSPDSLPVAPAPARRSLDQEYVARFSEQREAIRQSMLRHPEIHQPDMPPPASVPRDGRAPRGFRDGTRRPSPAPRTLSTPPTSRSQFSEHPARTLSPRRYSYQPTPHLAPLHLNTGLDGSVSASPSPAPWTGPSSLPTQPAHSPLPRAPSPIPPMIPLPPMSLPTHLQLELAAQRPSPLYIHQSHTADIPYESSAVKFERLKNVLLLPSYLERTLYFGALACLDAWLYTFTILPVRFFMALWILVKWWAYVVGKETCWVSGFVWSGIGRLWERERGRGGERSRRPSELSETMRSRSRSGVSEHAVDTDYPITNPAERQQFLRRTSQTSQNGHGRIKSPTGPSQHHPGPKSGTFRQHRRTKSMPSSLSAYHKADLLQGCVILCSSIALMSLDASRMYHFIRAQSAIKLYVIYNILEVGDRLLSALGQDILECLFSSETLSRNASGRSKILLPLGMFLLALAYNCLHSIALYYQVITLNVAVNSYSNALLTLLLSNQFVEIKSTVFKRFEKDNLFQLTCADIVERFQLWIMLLIIGMRNVVEVGGLSVPGAGLDVGSDDAGPRHTSSNMPASFTLMPSWLMSGEVLSPFLIVVGSEMLVDTIKHAYVTKFNNIKPAFYSRTLDILCKDYYTNAFSAPSLTRRLGLAVIPLSCLFIRASIQTYHMFLSTHVPMPGPPTTQTSLSDPSATPSSPAVLAALTRFDSLIRDSLGRATYGYPYGSPLNSRPWYSWTSDDFIATLTMVIVFFIVFLVLLILKLLLGMLLLKYARNRYAKMRSRDQAVARGTLDRETYESAGRRVGGFGHIEVGDDRQRWIHADKTEGLRDAKGPGGKRGGGIDGEKKKPEVEFSGVNRYDMVAKRIW

SEQ ID NO: 2751 - protein, 347 aa, Unknown
  Kingdom: Fungi, Phylum: Ascomycota
MAFSLCFNGLLMRIFAYFACHGAFSLGQGTSEQQPLLEEGSFASVTDVIEEEFTLSDGRSLGVAHFGAENGSPVFYFHGYPGCRLSGGAFFDRAGKRLGAKIIAIDRPGIGNSSPQPGRELLDFASDVHELAEHLKLKSYGIIGVSGGGPYALACARTLSPERLKAVSIIGGMGPIGVGFKGMSWGNWLTFVGLMYFPWIIRLLQKKVVSVLNTTPNEQVIKQIEGKVTERTAKFVGSDVMYLLDPDRMATMLDLYREHYKQGIEGYMEDGRVMTTDWGFYLKDIPEKVSVQLWYSKKDTNVPFQMGEAIRSRLSSPPEFHVDEDATHLQLVLKCSGSALERLLEKI

SEQ ID NO: 2752 - protein, 691 aa, Unknown
  Kingdom: Fungi, Phylum: Ascomycota
MAARERDHDDNGDSLDPELLYTKEYCIGGGSFGKVFKGVDKRTGHAVAIKVIDIESAEDEVEDIIQEIAILSELQSPFVTKYYGSYAKGAELWIVMEFCSGGSCADLMKPGLIGEDYIAIIIRELLLGLDYLHSDKKLHRDIKAANVLLSSNGQVKLADFGVSGQLSATMTKKNTFVGTPFWMAPEVIKQSGYDHKADIWSLGITALELANGEPPYADIHPMKVLFLIPKNPAPRLEGNFTKAFKDFIETCLQRDPKDRPTAKDLLRHPFIRKAKKTTYLTELIERHSRWSANHKDTDNDDWDSADGGAPTRREQVEEDMWDFGTVRLVGDRGGVVHRPSLNALDENATNARAARSNENTGDYGEKKREGSPTKTRDFALQPDTTLKANSRQSSPQRKPVAQGQMPGSPTKVPLPPSPMKTLLRDEGLSEQTPRGQRLLPAVPSQSPDYDRELQAQLQRDIGMLNLNIAPTLQPSTGSPRSSVASRTAAAPPVASLQDQSRPTSSRVAPIQLPEIPPFRGGQRVPSQQRVGPTPPPVQAHSPSPLMNPALAQLPLPSKSQSPAPSESSIAPSSFPSPAPANPNGELDALNDVIFPALEEALKRRQIRLQHVLKPAGPGVGIAAPTPRQQRAEASHEKLRKLVYKLAHVCKEIDHYDKAEPVGMGRDVGSFLEGLLEEILVRVEPLDEEEVA

SEQ ID NO: 2753 - protein, 364 aa, Unknown
  Kingdom: Fungi, Phylum: Ascomycota
MSSTTGSHRLGKDGPLVPAIGFGLMGLSSHSYGPPPEDEDRFAILDRACELGARFWDSSDLYGDNEEFVGKWFQRTGKRDDIFLATKFGFVKGRKAYEVDSSAEYCKKACAESLRVLGVEHIDLYWLHNANPKTPIEETMRAMVELQKYITPYVPLVHFTYANNTVREGKIKYIGLSGVSSTTLRRACKIAPISAIQADYTVFSREIEGPAGSDLLATCRELGVSIVAATPLGRGILTNNFESGKAEFSDTDNRPQYMPRFQGENLNANIELVKRFKSFAEKKECTIAQLALAWLLKQGEDIIPIPGTKKMKYLEENWGALEVDLSDEEEKEIREFGESTGFAGLSAPPKFLEYLYRDTVEEST

SEQ ID NO: 2754 - protein, 401 aa, Unknown
  Kingdom: Fungi, Phylum: Ascomycota
MAEPANTPIPASTPRSASPVPFAQGSTGVSHTSLPLSPTKFAALSIHQHTNIAGSKKPRVLHIGDPVQYNLDLYLAFVTQCEVVRPAAGERERDEFITALKEKRWGDFQAIFRPFWGTGGEMGNWDAELIDLLPPGVKIFASAGAGFDWADTKLLGRRGIVYCNSGLAAAEAVADFAVAMIISTFRHLPWCTSAALDPARFSHCHHSATTSSHLLRANALGIIGLGNIGQQLARRCRHGFGMRVHFYDVERKPSEVITDLHATAHDSMESLLGASDCVVLCAPATNVSGPIINATTLSQFRPGARFVNVARGSLVDEDALYQALQEGHIGAAALDVHANEPNVHPGLARIAQEEGRVMLTCHNAGGTVETHQGFEELSIRNIMAVLGGGKPITPVNLQYLQ

SEQ ID NO: 2755 - protein, 263 aa, Unknown
  Kingdom: Fungi, Phylum: Ascomycota
MDAFRRKLKESADAEYDKLHAPLRTPDKLNKQYQDSRSSEESGGPAPRELEDYYRTQPRRNWLLLLIVLLLTATLIVLSTFHVLLLHEISQHQGLLPHHHKATPAAKRHADCGASVAEAKAKGCIWDELTKAWIPSQCPQFGLDEYKTEGMLANPHDNATSWPYYADQDGEVEVNLLVLAKDEERDPLDALWTTSRQHLTHCAWSLKRVLWSYENGEGHYDKISRLRHVNHCIDTLLRRAVRLDDGVHLITTTVKVHFGWCDF

SEQ ID NO: 2756 - protein, 285 aa, Unknown
  Kingdom: Fungi, Phylum: Ascomycota
MALSASASSMRASFRLLNTARPLAATTTHALTARSFTTSLPVLKKRKPERAEEKPSSSKSHHANTKQVTGGKQKNIDPAASTNSPLDPNAPDPLDFSALDNAIGPIDTHFKSQLQGLVHGGRFNPETIGALSVHVKPAHDAPADTPTDFPLRELAQVVPRGRTHISLLLNDVEYTKPIMSAVQSSPDFNQQPQKSEDNELELILRVEADRKDETVKRAKEVTQQWRDRVRQARSKHEKAMKEWKKKKLVLPDDFKLAERELQKVQDKKMKEIDTEEAQVVRQIQR

SEQ ID NO: 2757 - protein, 269 aa, Unknown
  Kingdom: Fungi, Phylum: Ascomycota
MRASTLLLPAMAMLATAAPKYPEFDLKHMKEPGAALETLSNYFNLIAYKTKAAKVIGRPPVCDVSTAQMPIAPEPLAAPSKGLKPHHVALGRGTQNYTCADNRASSVPEAAGAVATLFNISCLASVSPELVTTVANMAIHFSVDEAAHRALGPTPWPVSGVHYFQAPGVAYFNLNEGSTAGKFGEAPCQKNGSTVAPAAAAVGPKGEKAVPWLKLNVIEGATQDIKEIYRVDTVGGSPPATCEGMDDTFTVEYAAVYWFWAGKIVEDEE

SEQ ID NO: 2758 - protein, 352 aa, Unknown
  Kingdom: Fungi, Phylum: Ascomycota
MSITNLYQGYPLATTLVAITLSTSLVLLFQFLRKSQKSHRRSPRSLLPLPDVDEIVALYVYPIKSCRGFPVKSARLLPTGLELDRNWMFVSADTGEFITIRANSNMTLIRTGYDEEADELSVSIRDEKKFVIPAHPTPEWLRDNTELKKAGIWGQQTDAWEYSARLTQPISDFLNSDVRLVYKGPTPRVLRGCGAPELLGRTESVKFADMMPVLIASTKSIGELNSRLAEAGENEIDIERFRPNIVIRGGEPWGEDSWKTVRIHGEQGPLELDVVCRCLRCQVPNVDPDTAEKNPRQPWNKLVSYRRIDPGLRHKPSFGMLCVPKAAGLVSVGMKFDVKASTHDHFFINPMK

SEQ ID NO: 2759 - protein, 295 aa, Unknown
  Kingdom: Fungi, Phylum: Ascomycota
MASPLVSKYKSSIPHQHQITSLSEARLMRLTAIRRLAHVAAKMALYNPPSKDKLIFAPAGNQATGQADQFTLSKLSLSDLDRTSPIRQFHSWFSQAQQAEAVPHPEACSLSTAELPSGRVSSRMVYLKELEAEKTSSDASSKADPGFVIYTNTGHSRKAADLTTNSYASLLFFWEPLQRQIRVEGRVTKLTREESQVYFDTRVRGSRIGAWASKQSQVLQPQGGEDDGREQLVGWVKEVEEKFEGEEKIPVPEFWGGLRVVPERVEFWQGRESRLHDRFVYEKDGEAWTLNRLSP

SEQ ID NO: 2760 - protein, 1231 aa, Unknown
  Kingdom: Fungi, Phylum: Ascomycota
MRPMHGGHQDRNGADNDQEQAERGRSKALPALSLPKNRSTGNLARSPDPTSATAADKSRYRMSFDFSSASNLDPDSALTRSPIMADHEHGLGLSGLRRIRQHHPPSRTPTLPNSNSSSRSPSVVALSRSTSMSAMLAASNSFPLSGGPTSPSFTEDLSRFPTESLHSFSFAHQSEEFLHNRQNVLKRSIEYMKDRKGWSVSSMQAGLASAQARVTGDVEAQHMLELLARAQLIEAGNLPNAESSLANPGPLTGPAEVSGENLFEKHFIPRTASPEPIESASKSTVASDSAKAKRIAMEAPELRMKTDLSSKNQNITDSEESSRTPTGESATTADTSPPASRPTSLKRTLTDTHGITMQTRLLDTLAQPYVLGQPTVPESLTSPTMQQFTPTAPSFPAALGPAAHGHTNRWVPAAQAIFTTEAKPPWTIIAANDLACLVFGVTKAEVRKMGILEVVQEERRSWLERQLLRKNDDETAESNEGKKATPAASAASALLLGGRGGITAQLLSKPNSRAVPPKTPPRRAQTVHSGDPTPPKTRGSSNHRSNLSRGVLLCGDVVPIQKRNGATGSASLWVKEKRIGLIWVMEEIHEDVANVTLDEEGVVQKITGSSQAIWGIDESQKGFDIAKLIPRVPRQGINPNEGDVDFAQIARRRYFTSVNSKKTNIPCTVEQVRGKIELKVSTFPHMAGIVVVDPENMQVRSSNAAFCSALFGFEKLDGLSINTLIPDFEKILQTLTQEEGLQLMDGMVIPEHRFRRASAFLALKEHRPDAAAAFLQPDGLQARHRDGSDLKIDVQMRIVKSEKQPSIAEETVVEEGSESEDDHDGDDTFQNRQSEIVFALWVTYSRHLHASQAKLGASTPAASEATTPLHQPSPGQTRVTSPMELSSDGEEKKKKTTPKPAPLSKQIKDAALSAAAKLTGHSKPSAKPEEPPAVETSSDPPHKKTIEDYTVLEDMGQGAYGQVKLARNKRTGKKAVLKYVTKRRILVDTWTRDRKLGTVPLEIHVLDYLRRPEFRHPNIVEMEGFFEDDVNYYIEMVPHGLPGMDLFDYIELRANMDESECRSIFIQVAQAIHFLHTKALVVHRDIKDENVILDGEGNIKLIDFGSAAYIKNGPFDVFVGTIDYAAPEVLAGKPYGGKEQDVWALGILLYTIIYKENPFYSIDEIMDRDLRIPFTLSDESIDLVRCMLNRDVGERADITQKRDEHELDDDTANYDIHCAACFEDFMSLSAL

SEQ ID NO: 2761 - protein, 1230 aa, Unknown
  Kingdom: Fungi, Phylum: Ascomycota
MPSSGDNGNPDDGVDDKSGIGITSFLTSIAVAVAIFAVQTLIFLLLRNKLARIFKPKTYLVPERERTEPPPTSPIGLIRHLFNFSDREIIKKCGLDAYFFLRYLKTLLIIFVPIVCIVLPILIPLNYVGGIGQKIDVKDDNKNSTDGASVRGLDTLAWGNVSPAKTSRYAAHLLMAILVIIWVCAVFFFELRVYIKVRQDHLTSAEHRLRASATTVLVSSIPAKWLSEEALRGLFDVFPGGIRNLWLNRDLTELLDKINRRDKIHKKLEGAETDFIKAVKKAQLKQRKAEDKKNRKKLNLKSLTKKERAERDAQEDAEAQRRANASDGLNAGDQHQVPHNVGEGVDESKDQDAQNPDQDHEHDGTGFKIPRFVNPLSLVTHGVKGAVGAVEKTGHGIDKELETTNGFMGMGGQTVPRQDPSIDTYRPTTQGETVPRTSASDTLQPKATRSRSPSNVTNDSAQAITKPSEPENMLQLNTVRKLDNIDDMYKKDDVKFWQFWKEPPGGYASPVPQGVEAQDYMTRKANEKRSVWDVLKNSIPFMGGIEIEPLEYPASHNPDYTEEMDAEAEWALYLKKKKRPTHHLPLFGVMALPGIPFVTKKVDTIYYCREELARLNVEIEEDQKHPERYPLMNSAFIQFDHQVAAHMACQSVMHHIPRHMAPRINEVSPNDVIWDNMAFKWWQEWLRTGIVFVLIAAMVLLWAIPVSFTAALSQLNELIQDAPWLGFLRDNSAVETVAKALAGVLPAAILALLLVLVPIILDFFASFKGAKTGAQKSEFVQLFYFVFLFVQVFLIVSIASFFAASVDDLFENLASLSNVQTVLDILAKNLPKAANYFFSYMILQAMSTSSATLLQLGALFFWYVVARIMDTTARHKWSRNTKLSEVQWGKFFPVYTNFACIGLIYSVVAPMIAVFAVITFGLLWVAYRYAMVYVIRFESDTGGVMYPRALNQTFTGLYFMEACLAGLFFIVVDEKKNRPCTTHGIIMIVCLILTIVYQVLLNYAFSPLFRYLPITFEDEAVLRDEAFQRAQDHRLGFDDVDDEDWHGDQGNKVASPLSEKSRLRGEMSNGDIEMNDLKGRQGTSHFMRNPMRQVGTWAKDGGQQLKKLRPRANSQATEYRLQRRQKDLEAQRAIGEALYGGFHDEIEDLTPEERDWMVRHAFTHSALRARRPVVWIPRDDLGVSDDEIRRTKEFSEHIWITNEGTALDSKVRVVYGKNPPDFSEVDLINL

SEQ ID NO: 2762 - protein, 4918 aa, Unknown
  Kingdom: Fungi, Phylum: Ascomycota
MAAIDVSRQRWSLLQDATAMQLLPAELIAIMQDNSSTRLLDAVAEAALSPPLTERIFVHFEDIFADICARWITTAVDESRRIRVTSSLARVLPFAPYLSAFIANPTSPSQHHDNSSHTQQLCLRLPDFGAISNDVTEAQLTQLLLTGWRLNHFDARTFSRAVSPSSIQRLFKHTSAAVRYLAIRIYCQLLRGEEAIYGDFDGQVIDYGFLSLHEQKRAKRVLVARDRIRGQATDSLSRLPLQSLSPYVMAYENAILPRPLGPTGDLSHLVMTATTKRNLESFARILQTNDPVLLHGLPGSGKTSLIHEIARDLGMYSDMVTLHLNEQTDAKMLIGLYSTDTKPGTFQWRPGVLTTAVKEGRWVLVEDLDRAPTEVLSTLLPLIERNELLIPSRGEKIRAANTFRLFATVRTSKGMNGKENLPSLVGMRFWQTLHVEPITTTEVEQVIVEAYPFLRKFVTGILNVFRRLAAMNSGPRMRNTGRPITMRDLLKWCRRLQDCLRTAGSRTGDEPISETTQDWMFLEALDCFAGSTPDVQTAHHLGQAIAEEMHLSKDRAEHYMTANIPPLEEDETRFSIGRTRLRKNKFANRMRKSKRPFASTAHAKRLLEQIAVAVKLEEPVLLVGETGIGKTTVVQQLAESLGHKLIAVNLSQQSEVGDLLGGFKPVNARNLAVPLKEEFEDLFSATGISSTKNQKYLDQIGKCFAKSQWTRVSKLWKEAPKMFLKIVAELERKQDEQTEARSNEDQPAKRRKTGSKLETLLDLRPRWDAFAQSLEQFDIQIASGSGHFAFSFVEGNLVKALRNGDWVLLDEINLASPDTLESIADLLTGPQERPSLLLSETGEIEKIVAHPNFRIFGAMNPATDVGKRDLPVGIRSRFTELYVRSPDTDLKDLLTIIKTYIGSNAKNDQAADDIARLYLNTKHMAEEKRLVDGANEVPHFSLRTLTRVLTYVNTIAPSYGLRRALYEGFSMGFLTLLSRDSEAMLVPLIHHHLFDRHGSSQSLLSQAPKHPNDGKEYVKFRNKDRDRQYWLFQGDQEPVQRTDYIITPYVERNLLNLVRATSTRKFPILIQGPTSAGKTSMIEYLANFTGNKFVRINNHEHTDLQEYLGTYVSGTDGKLKFQEGLLVQAMRQGHWIVLDELNLAPTDVLEALNRLLDDNRELLIPETQEVVKPHENFILFATQNPPGLYGGRKALSRAFRNRFLELHFDDIPEDELEFILQQRSVNTSPPDCRRIVTVYKELSRLRQTSRLFEQKDSFATLRDLFRWALRGADTREEIAAQGFMLLAERVRNEDERLAVKDIIEKVFKVKIDIQALYSIDALPELKRIAGKDNSQGVVWTHAMRRLYVLVARALRNKEPVLLVGETGCGKTTVCQLLAEALSKELHIVNAHQNTETGDLIGSQRPLRNRGAIIDALQQDLRTALNAAGAGSDAQTSELLDDYKSLSPELLQALPEDLKARIALGEMRSKALFEWSDGALVEAMKDGQFFLLDEISLADDSVLERLNSVLEPSRTLLLAEKGIDDSLVIAQPEFQFFATMNPGGDFGKKELSPALRNRFTEIWVPPLSNSDDVYQIVETKLDTKARHLTPIIIQFASWFGAKFRPNSATAFSVREILVWVQFINEFGADNPLISLVHGASTVFIDSIGANPSALLAVEGKTVNQQRLICVQKLSELAKDDLSGLSQTQPELVMSSDSLQIGSFNIPRLPSGIADPGFAFHAPTTRLNAMRVLRALQMKKPILLEGNPGVGKTTLVAALSQACGQPLTRINLSDQTDLMDLFGTDVPVEGAEAGNFAWRDAPFLQAMQKGEWVLLDEMNLASQSVLEGLNACLDHRGEVYVSELDQVFKRHPDFRLFAAQNPHHQGGGRKGLPASFVNRFIVVYADTFTEDDLTLIAGHNFPDLSAEVITSLIRFVTQLDHELVVSKSFGSQGGPWEFNLRDVLRWLKLLTNPDPVLRTGKTDDYLDIVIRQRFRSQRDREQVDRLYEAVMTTPPEPHSLYHDITPHIGQVGLAILRRGLNTQLEPFPRIDVVPRLPELEALMICVKQNIPCILSGQSGSGKSALLEHVAAIAGKALVVFPVNADIDTMDLIGGFEQADPLRELNAALKDLYEFLQESVLSLAPAEAPPGALDLIYLLQGIVTDPDLIAPIRQAVKTLSEQVSAKSDVGRALKQASNLLERPMVLSDPRFEWLDGVIVKALEKGHWLVLDNANMCNASVLDRLNSLLEPNGFLSINEHCGPGGEPRIVRPHPEFRIFLTTDPRYGELSRAMRNRSVEIFLEGMAPVQSSSLKLVTEVESSLTRYATITDVIDALGIQSATQETALEHLSNADLSILSRYRHAAKELALQPSAELPVLDNYVEFLQSSFGTAAVRSVAQFYGEQTAVSSDILIALPMNPLNDPAVASLLQPNEQARWLAVCLDFGQQLHATRSQLSGIHLRAQSGKLNTLTRLQRSMVSDRVVAVSKDSTVGLAKFISSMASTMEELLSTMSTTPGESLTRTLALRVAACYIARTVDMTNNAAFDEAEFQAHLALGFKLMQNHVSDETDSIAQRFGNAIMQMLDQFFAQNFKLSTGLSMEKLWVTFRPILVPEQQSMSRIVQILDLGRRFDKMRWKAASTLLNQSKAQSALEQSMVIARTDNAEVNELIAGLTDAIESLETQAIIDAPAHEPYLVRQFDAIRQLAVLRSARLQTKNEPAVQGLMEDIDRTVHTLSNLPSKSSLLFAGIQGPASRLQLLDLLTVTGTQVWDGKFAVSTWVKLQEMQSVSLGALALVEAELPVLGLQIARLSETIAEDPLLSLNEVLRELIIDTFTSFYPQVREGCAFASSAGLDHTEVLSKVLEEACHNIDAPDMRRVSQEHLLPALKAIESAQHSEDARAHFSALAWVHFSSGLVELFVPDKMFDPEIRPRMERDFHKHLLEGLEENMAYIGDFEKRFTGQTSNLRTTLLRQEVEAIGPLPAEVLPVYRPEHSELGNLQAEFSNILKIILGPSVASLLQQEPDSEPSLDELQLVKGNLERLLDRLGARFEAYQDVTQPASNLLRCMLIGLSMFEAKTEVQHPLSTPIYLAQVPFLRDASLKVEAADEKCKSIGNLYMMRATASIEGLDHISYEQRQAISECFHGFFMEWQQRLESDRKAEEAKTSLYRFRGSAEDEEEMDEHEFHELFPDYNEEDEKIPSLRREEVSDTSRRVADIHAKVFGERSPDPTAAIHDLIEDATERVCQAANSRGFIRHTWNQRLLAGVTTLLQEKSSSLTSAIGTREYNFYTDANLNEARQLVVLTHKIKNKFRELQHVDEIGHMQPLADVVTACDKLLELVHSEPLAKILTRVEQLHALVYEWQFGGWASKIHGAPLLYDALTETIVSWRRLELSTWAKLLDMELNKCQDDARNWYFIAYEVVIAVPLSLVESAPDLRQYAISLVENLQLYFSTSIIGQFNARLQLLGQLQRHLQLLARDHPSLNVITDAVTNFLSFYCRYETTVQEAIAKGRMPIERKMKDVLLMASWKDTNINALRESARKSHQKLFRHVRKFRAVLGQEMKDILEQGLPEIEPTTSMRSLVKPEEPNMPATAVRALRTYLPGWLEKHKRISNMPQTVSIMRRVKDSVMENSSIGHLMDDFVTNLRDAVAELRKETPSTLTEENKSLVKHLKTRKRKLFADTLKSMRQMGLQFNLGQDRLLEQDSAAKIFAVVPPVQLADDTSASAADYYFEKMVDLLPRVRDAAREHSEELTPAEVGRSVGFVEGILHLLLTQRKQLARAVRGLHALQSTVQHFVAVGELQDDNETLKLRDTSFDWQRRAAWLIHMLQYAITLVKTHETLGQDATNVTQLLQNHINAVQKGAEELAVSMQLPDSLTTQRTSRQEHALEETFLVVRQTLTKCLQQQPSLGYIVDALLPWTEVEVQAAEQSHEAASLQVFGDALSTLCDKVLVSTERAKKTCGRSPVQETDTEWLAKNNEAVISTISGLRMNTVQNEIASCLSMIPGAIQTSLPNSSGAVAATRLVAPILQQYADSCKSIIETLCETHRATAHMGSKLTSIFLQLSAQGFCSPQEKSDEESGADGKVESGTGLGDGDGAEDISKDIQEDEDLSELAQEANKEENGDVEDEKDAVDMADEDMEGEMGSVAGDEDEDDEKKDGDDQEEGEDDIDEEAGDVDDLDPTAVDEKMWDGKDEEEAEKDQQGDKASGQKKDDEQMASEEQQQKKDEAQQEPDAADAEDSQPEADEAEDVDDEKEEVKDAEMNRQEQTAEENDALALPEEMDLDLDEEASESEDDGMDDLSDVHEDKLDDAQRPAEDVEDDGEADEEVKQEQEEDDQVSEAGDEEDQADGKDDGQPTDDVKEEEEQPDHDDPLDEKNEQAPESADQGATDLDNAAPSDVRGSGEDQNAEAMEMDQQFQSNAAQQEEGKSGDAAADQAATAGKDGKMSRSDEPMERGEPETDDSQPGTNDPFKKLGDALEQWHRQRSDIQQADPEQDAQPKQDPDQSQEQARQEFQHLQNDDDAADTQAMGTAKEDEVQPIDETMGIDDDREDPTSRLLDDATAEEQTEKTVDAMDENDKAEAEDDVQVQKDAEDGRSGVQTRQGNYQRENTPSKEEAVIGEQEDQDETIEEASTQLSTTHITEEGRPLREYDEAAQQWSDFQNKTHALSLSLTSQLRLILTPSQTTKLSGSFRTGKRLNIKRIIPYIASSYKRDKIWMRRSIPTKRTYQILLCVDDSKSMGESSSGQLAMESLVMVSHSLAMLEAGQIGVLGFGGDVFPAHSLTEPFASDAGAKVLQNFTFSQDKTDVALLIRNTIDTFKEARQQTSGTGSDLWQLALILSDGLTPSSAHDSIRRLLREAIEERIMIVFIIMDDTDKKKGDSVLELKEAKFVSEGGESRVVIERYLDTFPFQYYLIVHNLEDLPGALAGLLRTWFAEVTA

SEQ ID NO: 2763 - protein, 462 aa, Unknown
  Kingdom: Fungi, Phylum: Ascomycota
MAITSKDPEVQEVLQRSPESSLDVTIVGAGLGGLGAAISILLAGHKVTVLEAAPQIGEVGAGIQVLPNAAKVLYSWGIKDRLEALATKPRRCNFIGWKGNHLGEMDYHGYAAATGGYSFLDFHRATLHRCLLDRAVELGAKLVTNAKVDRYHAAEDGSTTTIYLENGDVLQTDLLVGADGIASKLREQFLGRADPPELTGDLAYRLLLPTAEMLKDDDLRPLVEDPQVNYWVGPEKHAVNYVLKGGELFNMVLLVPDDIPLDQGNLLKGSVEEMRAHFKGWDPRISKILSLSKDESILKWRLMIRPGLDPSWSNKVGNFTMLGDAVHATLPYLASGAGMALEDGGVLGICLGRIKDKSSASKQQALKVYEACRRERTEKVVQRGTYNQWIYHLPDGQEQEERDARFQNYDVSDKEWLASKKPVLPRSGETGDDPFPWRYHGVGRWLLTYDMFEDVEEKWGKC

SEQ ID NO: 2764 - protein, 188 aa, Unknown
  Kingdom: Fungi, Phylum: Ascomycota
MATSLILSPAPYHIISYGTLLGASVWHSFVNGPVMFKSVDRHNFSAIQNNMFPIYFGLQSALPVVLALTFPGSPLLGVPSGVSGLFDVSSRLDSLLPLGAAFVTGVLNLAVLMPATMSIIKERRGQVKRDGKDWWAEGPQSDEMQVLNKRFGRLHGVSMLVNLGTIIATVAYGFTLGARMQSIVDRTA

SEQ ID NO: 2765 - protein, 892 aa, Unknown
  Kingdom: Fungi, Phylum: Ascomycota
MRISTLLTATLATGSSLVAAKHARPTSGGRGVVPGAYIIELENSEDTASISSEVESHGKVRMELDYKLFKGVSVILDDVEKADDTIMRIAESNSNVKNVWPVQVYSIPKPKVEWIGKPVVETSDLKKRQDDGNQTVGDFAPHVMTQIDKLHKKGITGKGIKIAVIDTGIDYTHPALGDGCFGEGCIVAMGYDFVGDDYTGYNVGVPDDDPMDCGGHGSHVAGIVAARENPYGFIGAAPEATLGAYRVFGCSGSAANDVLIAAYNRAFEDGADIITASIGGPSGWSEDPWAVAVSRIVDQGVPCPVSAGNEGDTGQFYASTASNGKGILSVASFDSTVTPSLLTVSAFTIDGGDSEEFGYTPAEPAAWADVELPLWSPSDDPADPAGGCDPFPADTPDLSDYIVLIRRGSCTFVQKAENAAAAGARYIMFWNNVPTGTLATDVSTVEGILAAGMVSAAQGLEWLEALNDGSEVVLAMVDPEDENAEVSLVQNPNNATGGALSTFTSWGPTFEGDNKPQLGSPGGNILSTYPVAKGSYAVLSGTSMACPLVAGSLALIAQVRGTFDPTELEDLLSGNANPQLFNDGTSFYDFLAPVQQQGGGLIQVYDAAYATVILSPSSLAFNDTDHAVEVLNFTLKNTGDEEMTFEITNVPTVSWYTFYEDEPYPIAGIPEPVEESATLKFSESKVSVGAGEEVTVEVIPTPPTGLDGIRLPVWSGYIAVNGSDGTSLSLPYQGIVGSLHDSDVLLGDDYTWVTKSTDENGTPVAENTTFTIPKPGDKVDPTDVLPAFGLDMALGTPFARVYVTPMTTCPPKGTKEHKGHKVLGEIQGSPFQYLPRALNVLPWNGLMANGEAAPAGKYRFVIDALHIFGDPSEEDDKWDVAKSPSFRIKYEE

SEQ ID NO: 2766 - protein, 458 aa, Unknown
  Kingdom: Fungi, Phylum: Ascomycota
MADEAKPQCGGGVETGAYDVPLHVGGLFIVMIASILGAAFPVVAKKVPSVKVPQKVFFACKHFGTGVLVATAFVHLLPESFGSLTDPCLPDVLIEDYPAMPGVIMMGAMFMLFTVEMWLHGKTGGHSHGNPNGDITAAPRRSMIMGVNGMPAAPPRPPRPDASFDYGDNERGTILDYEKAMAYQADMDKERYPYVTNPFDDPNNVVLPQSEMPAWFVVFYEQYVRQRLELMNMVAKSNAKNEKDHRRMMEHAREQVRALETSSDNSKLQVPTINVSAPAAKNFDFDLEEQQVDPEVLRKMSLNISLLEGGILFHSVFVGITVSLTIEGYLILVIAIVFHQMFEGLGLGSRIAEVPYPKSSMRPWILVLAFGTTAPLGMGLGIALNGTYDPDSAFGLILVGCFNAFSFGLLVWAALVDLLAEDFLSDEADRVMTPKSKKIAFCWVLLGAAAMAIIGAFA

SEQ ID NO: 2767 - protein, 375 aa, Unknown
  Kingdom: Fungi, Phylum: Ascomycota
MLRQFLEEGIHRLYASTASASIVEAFKDLVPTSEVLKLVCVALQEVISNGSTLSALEQTGTALELFRHQISSDFLRNQEELFMAGSWICTLHLIQGLPWTSTFYQFLDFCHIDNDLSQLRPNPRYHLGVRQQIETISVLDFPNFVLGRVSPSRGLWKRFRQLQNNWDDRYNGGIEPVTGLPRTLLDHLAPELEETEADTQQREQFLWHWIGQTSSSLWKGQLWDCYRYAGILAIRHQRSLLHRKALASSGLQPSPNTDIAEGPPTDIVLFRLLCSLNAVLNERYYSGSHASLQVQHLALYPLVYGSLQISALKATEHPWREDLKRMRGQVIALEPVAQKHTLLLFKILDEAWEAGFDGFDADEAARRHEAEITII

SEQ ID NO: 2768 - protein, 234 aa, Unknown
  Kingdom: Fungi, Phylum: Ascomycota
MVKAIFFDFMGTCLDWHSAVTSAFPAEVSQDEASKFALEWRRRYFIANSDRNKQGLPVEDIDVTLSRILELMLNELPTIQSHFDNDKKTNLIKAWHAQPAWPEVREAIRRIREELGLEVFVHANGTTRLQLDLTRSSGLSFNMLFSSQLLGVYKPNPEAYQKGLELVQLEPSEVVLVAAHAYDLRGAQACGMRTIYVHRWTDDIDEDMNEVKKEFDVFLENMERLPEAIQELSN

SEQ ID NO: 2769 - protein, 660 aa, Unknown
  Kingdom: Fungi, Phylum: Ascomycota
MPEGLDIDHEGKLNGVMTGYVEHVLVCTGQDDWPSRIEDDHSGDNLAADLKELFGRGGRYCDPFHNISVLNSSFPSSTPPRAEVQTTSAYLLPSFKHVPYLPRVSFDSVEALAKGYLLPEKLHSAHDGLSPIHRDRLTRSEAHQSLFPGVRDVEDVVVLICGHGGRDMRCGVMGPALRTEFEDKLDQSGYTVLKGPFQDAPGNIERIEGEAKKSKQTARVGLISHIGGHKFAGNVIIYLPPGLQADGKPHPLAGQGIWYGRVEPKHVEGIITETISGGKIIADMFRGGQAQFKRKRSTPRFLFAAVAVAVTLTGAAVYASTSNSLDAQLNETTFTPYTITAREAISPTSFVFTVSPNHSPNSLPYLSPDSPSWRYPLWSIEFKQPEVQIARHYTPLPPQDGDDTRDGALRFYVRAISDGEMSNYLSRLREGQNVFLRGPHQGFDVLGRLGTRRQLVVLTGGTGLVPGIQAVEAVLASRDDTTAHILWAVRKREEVQQGPPPARSSWWSGPEPTELQVGLKSPSPVARQLEMMKKKFGDRLQIHVAVDEEKSTFSQSFLASTLKATETTDVTELEEADCRLHSQSLHRAVSEFEPRAPSCDCAGLGKNLLLVSGPDGFITHYTGPKVWLGGLHTQGPVGGMVRQLQTQDSQFKRDWLVLKL

SEQ ID NO: 2770 - protein, 656 aa, Unknown
  Kingdom: Fungi, Phylum: Ascomycota
MCFRISSALIALGLLSSQGYGLPAHARQATVLERQSDVLEEYDFVIVGAGTAGLTVADRLSESGEYTVLVVEYGYLDRSHRIEALTVPDIASGPPDVYPTGTRMYNISSVPQTGLDNTPKRLAAGSVVGGSSAVNGMVFMRGSAEDYDAWVWAAGEEHEEEFAAEWGWDNLLPYFKKSVTFEPPSEEMVEKYNITYDVEAAYGGATPVWSSYRPFNWPATIAMWDAFKKIPGYRFPEEAAAGDASGIYWTPNSINPHTERRSFARTGHYDGEPESRDNFHLLPAHRVTQLLLTESSESDSWVAEGVRFTPRDGDMPDMPREVRAKREVIVAAGAAHTPQVLQRSGIGPRGVLEAAGAEVKVELPGVGENFQDHPNVAMSYRFAKTYTPNSGMLQTDPGFRAEALELWETDKTGPYTAYLNSVAFLPLNLISDRTEEIVQALLDQEPGEYLHEDVDPTVIAGYVQQKKTLAKQYQSDKSTILEVPFSGNPFFSTVLLKSISRGTLHISPDDDGIDPSGRGNMEPVLDFRTFSNPLDLDLVVEMIKGVRSFMSSEPMMEAFGATETSPGEDVTDDEELKAWIARMTSPSTAHPIGTAVLAPRELGGVVGPDLTVYGTSRLSIADNSIIPLIPSTHTSSTAYAIGEKAADLILRRAGES

SEQ ID NO: 2771 - protein, 232 aa, Unknown
  Kingdom: Fungi, Phylum: Ascomycota
MEAVKAFFAPPDPQAQVRKCNALLRQNMRKLDRDIVSVKQVEAKTKQLIQQADKRAQRDPSRRPQANKEVRDFARELVRARKASARLVTSKAQLASVQMQVNEAFAVRKIEGSIRASVGIMKEVNSLIRLPELHATMREVSMELMKAGIIEEMVDDVLPEDGEMDLEGEAEGEVDKVLGEILKRPEEKEVQPKLPAAPVPDPKKNEPEEEEEEEDAEEMMDQMRNRLEALRS

SEQ ID NO: 2772 - protein, 819 aa, Unknown
  Kingdom: Fungi, Phylum: Ascomycota
MATGLSLTKCLQDPELWYRDGNCLIHLYGKGHSKRGPSFKVPFSALIDAQCFPLIARFLSIDGPRPRTPREMRRLERLDPTQKIELYIAPGAMANKEQTLQYHLATRNFFAWIFGQPLVGVHLGQALVGLLNSMHEFRSGLGDNVADMMEYLEQAGYLTLTGSPDHALAVSHFAEHFQMRELYVRAMAHCVGMNERLHTSSEYLHVNQSSKKLVRFLRTEMEARLYRASDILKNFLDDELSDTYIGLPAGPRAHLERFRSFLMSFYTTQLGYYPPRIFDSNLFRMMREDFDALYELLVDNGYDSSKTMPVIAVGGICTLQLVQDFDEAHDHTSLEHPLPLLPHVAESQSSSRRTSWLPRSGRTKPDQKLLEHTALIKATNWKREFFSNELVCAYRRFEEDTILAPNKVDKQEKLSLIDARKVRWLLIYAIYQVLRTVTEEPAEVQDDLDATYHLAISTDLLPEWEQKHELGFLIRSQTDMVRASSLVGTPDALPEMRPEVRTDVRPEVQAERIEIKPDIDYFALTHKEDSAAGKAEWSPMTGSAPVTRSNSLSRALSLTKRRSVLFFKSAAGIPPIPSIPSSHSMHHEIVVPGYGNGTNEVQIDDLTLVPSGSWGSRSDSTASKTASTVDSVFDTATDGDESGSESPNSSVEPSSPDVTFADMGTEWDAMPAPLNVSQKRRDVVSMIMPSLPARRGSIPRPLSGVFDLNQTKEHEAATEPTSPDLSSPDLPRSSSFLQRTATKRLSELRRRSFVPSTTPRRISESCENLSTYITDEKAEWASMQSWLDGDQDRLEVSGRNGKGDAWGQFAELGGLTETK

SEQ ID NO: 2773 - protein, 1048 aa, Unknown
  Kingdom: Fungi, Phylum: Ascomycota
MSETNASVMSSPTGSGKPDYENLEVIERNRLPSRAYWLPPNSLLLNGTWDFQYALTPLEASEYPASDDTTCDKASWSTITVPGHWQLQGHGHPHYTNVQYPFPSCPPHIPTENPTGTYRRFFSVPSNWDGTSQLRLRFDGVDSAYHVWLNGTFVGYSQGSRNAAEFDVTAIARSGESEQNELVVRVYQWCEASYIEDQDQWWLSGIFRDVHLLAFPGRTRIEDYFVKTKLDEQYTDATLEVEVTLSACANEACHVNLSLKDGTNEIASAKKSFTTEDSVVQFQLPCSDPKKWTAETPNLYHLEISLQSPSGETTQTINQRVGFRAVELKNGLITVNGSPILLRGANRHDHHPKHGRAVPADFLRQDLLLMKTHNINALRTSHYPGQPLLYDLADELGLWVMDEADLECHGFYDVVTQPIDPPPYLDYEGSKEEFFPLAAQFTSDDPAWRDSYLDRMVQMVQRDKNHPCIFSWSLGNESFYGANHVAMVAYARGIDDRLIHYEGDIKAETADMYSYMYPDMERLTHEVEEIGVQDGKFDKPVILCEYAHAMGNGPGALQDYQDMFRKYPRLQGGFIWEWANHGLEHKNGYYAYGGDFGEDPHDHTFVMDGLCDSEHKPTPGLIELKRVFQPVKFEVEADRVMITNEYDFTGLEHLDAIYSLEAIGDKSTILRLGELRIPSVAPWQTVELPLPFSLSDYKGQKEEVFLKISLTLKNGTNWASASHEVAWFQHQLSTQSKTQHAAALTQTSQQSIAAVSVTTSRTAVTVAGDKWNITFDRVRGYITKWTGSQGDLLESDPKTRAAIFPNFWRAPTDNDKDGAVKAWRDYGVHRMTSQLRSFEVSQNEEAGSATITTQTYLAPPVLGWGFDTRTDYCVSSTGVLSIKVDMKPRGSTPTDIPRFGLDLRLPKDLGQASWFGRGPGESYPDKFTSQKIGVWSSSVDGLETPYDVPQENGNRMDTRWVRLQRPDGSGMRFSRQDENTFNWTGTRLSVATIENAKHPCDLVREDATLLNLSPLVAGVGSATCGPGVREDLKVKVERFTFEFVLEMF

SEQ ID NO: 2774 - protein, 1050 aa, Unknown
  Kingdom: Fungi, Phylum: Ascomycota
MASNPRFDDSEEEDDFNPAPADVSDGEPEEDADERPRKISRRDSPENDGSDDRRSSSPAPVRRHNDDEQDDEEDEDEPSSARRAKDDDNDDEGDEDEDEDDEDDVQQHRRKRRRAPGNAFIDIEAEVSEDDEGEDDENDDEEIGNFIDPSHPDDDGEAGRPDDDRRHRELDRQRELEANMDAEKLAENLRQRYGNRRAGKGFGESAVVPKRLLLPSVDDPSIWAVRCKEGKEREVVFSIQKRIEERLGTKDELAITAAFERGGPNSVMKGFIYVEAQRQTDILVALDNMLNVYPRTKMQLIEIKDMPELLRITKTPTLEPGAWVRLRRPVKHNGDLAQVMDVTENGLEAKVRFIPRLDYGMRDEAPSVTSDGKRKRAFGAAGPRPPQRLFSEVEARKRHPRYVQGNPTTNTWTYMGDEFENGFQVRDVKIQQLTVTDVNPTLEEVTRFASGAEDGTENLDLKALSASLKNTNSLVTYLPGDMIEVYAGEQKGVIGKATNVQGDIVTISVTEGDLAGQTIEVPTKGLRKRFSIGDHVKVIGTSKFEGEVGTVVDIAEDRVTLLTDNTHSQLTVFSKDLREASDTGGSGNLGQYELQDLVQLDPTTVGCIVKVDRESLVVLDQYGDSRQVLPSQIPNKLPKRKQAVAADRNGSEIRLDDVVKEFSGQQRQGKIIHIHRSYIFLHTYENTANAGVFVTKASLVNTIAAKGGRVSGAGGPDLNEMNPALKRHQNGAENSKPPPKQTFGRDKAIDQSVIIRKGAYKGLLGIVKDTTETHARVELHTKGKIVTVPKESLAYKDKVTGATIELNNRGRGPPGGLGRGGNDRPGWQASGSRTPMSSGGGDRVPAWGSRTPMAGARTPAWNKGPDHGGRTPAWASNDGSRTVNPYDGSRTAYGSGSRTPAWQAGGRTPAPGDAFGAGSRTPAYAGGGDSWGGSGSKTPAWGAPTPGASGAGDWGYTPGASGDAPTPGGPLGAPTPGALDAPTPGGAFSAPTPGAMNAPTPGGWGAPDSAPTPAAGAPTPGYYPSAPTPGAFGGAAETPAGSGPRYTDDD

SEQ ID NO: 2775 - protein, 611 aa, Unknown
  Kingdom: Fungi, Phylum: Ascomycota
MFYSADLLQKSGPLARVWMSANLERKLSKNHILQSSVADSVEAIITPGQAPMALRLSSQLLLGVVRIYQRKTRYLLDDCNEAMMKIKMAFRSSGNNDMSASMQVHNREALVLPDKITPYDNLDLPPPPDPSWLLSQVDEVSATPIGRKGRASNRDINLQEDYENSQFLYDDPLNDEGFRTMDGLDLGLDLGLDDMEIGRDAPAARGIGEDMISEFDIASLTKPGAGRDESVQLDFTDDGIQIADDEGDIIMDDNFNFNADDQSAMPTMGAGPDVRARISESPLSDIDDDFAQRFEHEQSRNQTDLYEPEDETEQPLVRRPTQRAKKQKVMAPDDEIALSSTHIKQQQADRSNILREPSFLPRNPYLLSLLEMQKSGGFVTNIIMDGRSSVWAPELQGMLGMDFRGAGDHKRKRDSGVADVESDPGAKSPRLELGEDTEIGIDGQLAGDQSVARDSTIIGLPDDDGLALPEDEGMDTLPAFEDTTMPLVHPSDSGPVSLGTKHAVHVLRDIFGSEAATNAEKRKKAVVFQDLVPEQRTTKAEATKMFFECLVLATKDAIKVEQGAGLGDPIKVRGKRGLWGAWAEREAGGEIQEQDEPEHVIAQAPAVAVGA

SEQ ID NO: 2776 - protein, 346 aa, Unknown
  Kingdom: Fungi, Phylum: Ascomycota
MAPPKTQEAEAFEKYYLDRRDKELPENPEHRALVETCVRDGYVVIPSVFTAAECEQAKAEIDRLHGERPMVGRSQFEGRKTNRMWALIGKSRVFDKFVLVPQVHALNEYFLTDEYLIYILSSIVIQAGEKAQFLHHDDAGTRMPRPRPPMSVGTMICLDAFTPTNGATRIVPGSHEWGDGRIAYDEQAIPAVAPQGSVIYFLGTTWHSGGANQDEQGKARYAITAQYCMPWLRPFEDLKTAVDPRRVLSGEIDERIVEMMGYRTVEPYWGVGKSTTSERVLRLLREFGWTSLTADVVDGMNPIKGAQRLVRWLQGPVETNQPGFAKEKGVTDKWFRERYSKESSKL

SEQ ID NO: 2777 - protein, 862 aa, Unknown
  Kingdom: Fungi, Phylum: Ascomycota
MEPSPKKRKLAPKITNPDPISPTAVNSTLHTNTTSYPSEPQQYPVQDAAAAAAAALASNPERHDFESFARHLQDAATLIEEQSKKQAEILACSKVSVLLLRWADDPTASADIDALESTFQSQYHFYTQRWLIPSDPNPTLKLLQHLAAFLDNAPRDHLLIIYYAGYGFMKSDEQLYWASNARNDAAKVKWDGIRCLLEDTVQDVLLLLDTCALPDAVASGRHGVKQGIAACTPEMINREEGRSFTSYLNDALRKLGNGRPFSVQRLLEEVQGQKQHRSKTESPTVANGDAHDAPLAGQPVFFTLAKGNGQSLTLTPSTSQPVSSPGVEAHEDSKPLVLPEYKSAEAEPLKKLRFEEARVLVCTTFVGDASPDMGFYKKWLQSPPASANNIIVEGMFLGPPTMLLISMPHSVWTVVQHDQVCCYLGFIQSHNMLHLYQRLISTGDAQPWLKGFEAGNGFLEGHEMPMGSPTRARANTGGSSSSTARNGLSSKDHRGFHAINSSPGSSFNAGGKVKNEVQDSAEMQEAAEQLKALSHVRTRSDEGAASTQPPSDRQRTTLPDSIPDVRGQERGRPLPDSAEIGGHLTEPQISPGPKAKAPRRALPKQESRCNHCTHAPFKDSTALRKHILAAHTRPFPCAFSFAGCSSTFGSKNEWKRHIASQHLCLTYYRCSSCSKTTVDGKGNEFNRKDLFTQHLRRMHAPHDIRRALQKGEAKSEAEWDARVRELQQSCLVTRRRPPQRSACPKEGCSMTFEGPSAWDDWTEHVGRHMEKGEAQRLGVDSLLTQWALEEGVIEPWGDGEYRLTAGSSVGGGPYTSSWPSERHAHARRRSSATGYSTDKSPTEATKPAKASSPTAMEVDTDV

SEQ ID NO: 2778 - protein, 337 aa, Unknown
  Kingdom: Fungi, Phylum: Ascomycota
MTWLTESICDQWSQLPILLGPGAAAGKTYIVTGANVGIGLETSKHLVKASASRVILAVRNVEAGERARVEIEKETDIRGVAEVWHLDLSSFASVKAFATKADRELERLDVLVNNAALAYDQFTLSEGLELSVKVNVASTFLLGALLFPKLSKSGRAHGFQPRLVFVISALAFAAKDDLYDLKNDDNVFDSLNQEKRAKMGTRYAATKLMQIHLVRQLAATFPVEQTGVIITMVDPGLCKTSLARDTNTLNRAIVSTLRVVMGRTGEEGSRTILHAIVSEDHGKFHTGCKVKEHWIQPWMTDETGQKLQAKIWMELKTLLEEIEAGCFSTDDALLGGT

SEQ ID NO: 2779 - protein, 664 aa, Unknown
  Kingdom: Fungi, Phylum: Ascomycota
MSASKLVREGFKLLGRADDEDISDPEEGDAGEKELFAAWALFILIMLLIAAFFTSYILQQKKITAVHETVISIFAGMIVGLILLITSGDSISNIVRFDYQIFFNLLLPPIILSSGYELHQANFFRNLGTILTFAFAGTFLSAVVIGLILWIFAQIPGSTEMTFVDAISVGATLSATDPVTIIAIFNTYKVDPKLYTIIFGESILNDAIAIVIFETAQKYKKTDATSYGLISFIEATGIFLLIFFGSLMIGVIVGVATALLLKFTYVRRFPKIESCLIVLIAYATYFFSHGVHMSGIVSLLFCGITLKHYAYFNMSRRTQLTTKYLFQVMSQLSENFIFIYLGLALFTDAQQFQPPLIIITIIAVVAARWVAVFPLSKALNWFFRYRARRRGIEPVADELPYNYQAMLFWAGLRGAVGVALAALLTGENSYALRATVLVVVVLTVIIFGGTTARMLEILEIRTGVVEEIDSDDEFDIESHNTGLQVKRSGAGIGYNPRRNGTVPLNNLDNAGGSAGMPGRSASYVSGHRSPNPTAPRGTSLSRKNSLRNPDDFERADLLGRRGDDDSDFGSDIDTSDLPPPARRSPMPRGGSHAGSGASTPFTAPAGESSSAAAGPTITATGAIRQLWQTEDPAGLFRQLDEDFIKPKLLLHGDGTGRPGGGEGR

SEQ ID NO: 2780 - protein, 649 aa, Unknown
  Kingdom: Fungi, Phylum: Ascomycota
MARGLQSIGRGYKLAAAAAATTVLGGGFYLSYSRKPHLKQPLVDLRRDDAGRIVTPTFPTIRSRAEQLAELRKHNGDEEYDLLVIGGGATGTGIALDAATRGLKVALVERDDFSSGTSSKSTKLVHGGVRYLEKAVMSLDYPQLQLVMEALRERRTFLDIAPHLSTSLPIILPLQGWLQAPYMFAGIKAYDILAGSRGLESSYIMSKDEALSKLPTLRKDNLVGALVYYDGQHNDSRMNVSLALTASLYGATVLNHVEVTNLEKDANGKIKGAVVKDLAAGLNGDDSGAKEFSVRAKGVINATGPFTDAIEKMDDGTRMNLVVPASGTHVMLSGDLCPAGMGMLDASTSDGRVVFVLPWQGYTLAGTTDNGCPVETNPIPPQEDVDFILKEVSKLMSPVNRSDVLASWTGIRPLIKDPKAKNTESLVRSHLVTVSPAGLLTCAGGKWTTYRQMAEDAVDEAIETFNLAPKAGIQFPDVSGYAQPGITSTGKCITRDVPLIGAHGFSPELAGHLMDVHKIEKDIASHLAANYGDRAWAVLRAAKTPANRLLPKLPFIEAEVRHAVHYEAAVTATDVIARRMRLSFLDVNESLKALKKVISIMAEELKWSEKRRRQEFNDSVQFLRSMGLSEAQASASLGLPAGGLLKSTE

SEQ ID NO: 2781 - protein, 264 aa, Unknown
  Kingdom: Fungi, Phylum: Ascomycota
MIVSNILPAAAAVLVFARSALAGKDYGGECKLTTCLSEPSFDDSNSYAEFDHNGEGARLAIIDRDIEIKWREQDKSHPVRLSWHWWSENDTDPQYEIDGVRQFASIKWDKNITGEDSSTTINFWKIIQEDFPNNYTNLTTWELLGRTQNNHSAMVLSIYQPESPKFKQLQDEWNTEADDPQLLDFTDEFHLSQYNGEYTMTERYFTAQYDRGRRQELEKWRMGVGIGVGIGVPILTTIAVFVGYAFGKKVGPSKSKPVSDAASS

SEQ ID NO: 2782 - protein, 1648 aa, Unknown
  Kingdom: Fungi, Phylum: Ascomycota
MAGNMQQQHMAGAGQMMGQQMRNKNAQSQQLANWVFQNILTNTQPADPSSWQFSVTPQERAGKTMNIISNFWLATGGPQVNAANWGCQFERDQFNKAASKESYDNAMGNKSMEFYHKRRANTPGMQAGLNANAQQMAMQANQMGMGRGQGPQQAFQQFPPNVQQQMMQQAQQQQQGQQMQNPSMQSQMSQQALQQQQQQAQQQQQQQVQQQQQQQQLGMGMGMGMGMNMNMGNGAGRGMTPAQLHAQQQQQRMAMVAAQSMQQQQPQQQQQQPQQQQQQQNPSDLSRMSGPDKARVMQLAQKLMENASEQAKAATRDQLQKNLTPAQLNEYQVQGKDPLVLVYQTQALNMIRQSAAALNRQQAGMGQNVNAPQAAMMQQQQSQQSMQQRQTMMNAAQQGAANSANNFSQFNPSMESIKDQQMNGLMAQQAGQMVVPQSARAAAAAQMNQGRGNPQGQNPMARQQQQAQVQQQQQAQQQMMKMNQAAQQSQAQLQAQQQARLQGQQNAMGPGMQTSQSPAMNTLNTPATGARPQNNAAPVAGQGMAQGGVQFGNERFNQGVQRPNTEAWGEMLREMSSEEQRQVQGLPADKAKEIMMKWQNSRHPEQLGKPAEAGPAQMQNRQVNQFTPTMPTQMTPGMQQQQQQQQPMQQQQQQAGPSMPQMNPQIQHMMDMMEIPPGIYQKFAGMLGPDKRRWTDLKKWLETNAMEPQLRQRLQSAQFQQFQHLWKQQRSQQGQQAQAGQQQLPQTPQGVGMAAVANMQTTPGQMPTPQQQQFQAQQQQQQNQQQQQPQMQAQAQLQQQQQQAQQAGMPGSMPVPPGSITVSPQEIAAYRAKQDTSNMTDDQVRLTIQQLKRTVWYKRAAAIAQRQGQGQGQVQGPGAIQNPMAMGQNPQQLQQIQQQQFQQQQQQQQQQQQQQQQQQQQQQQQQQQQQQQQQARQQQLHAQFQAQQQTAMNKSNAQQQAQQAGGQMSQAPQNSAAGQKQQAGNKQQAGNNRAQHPKPSPAQSSKGLKRPSVDQSADTGDQNQAVPNNANATVQIANNQASIQAQAQNGQLQQGRPGMLNQAQLTEMTPEQRARYEEHIKKFQSNNAKTTANVMDELRRLNEEARVEMSQQQRPTVSLTPQEFGDLVPKVKAALVSTNRFAKALSRWYNALKDESKARSFFKARLHLSEQFLDGDAATTPKSALTISHDEVDRYKLLIESMAREVSVAFGHMKGPGQQQQQGGQQAQNAQMTQQQLQQQQHQLQLRAQAQQTQQAQRAQQAQQATPSANAANPEKNNAPAADKKGGKQGGKGAKNSQPPAAPTTAQPPFSFGAASPHGNPNYIGRAKDMNLQLPPSRKKQKTQSGQTPGSSTASPQVGKGQSPELRRAQEPTAPAKPVFRCTEPHCDSPVGYPSEQALQQHVQEEHIRPREDPVKFVREELALALGLEPDGRVKKTARNPDGAPAMANSVSKQGLTPANPAATPKSQDMAMKRSASGMGKSQDRKPEVTPKTGEAKPNLETTVADPWADSPVDPQGLRNWVHGVGLGAGLGLSSVFVELALNRKGSISPKDTPDSLKDSGSSEPNSDIPEGGTLDIGLDWMNFDTGMFLNMDDATFEANGGLIEHNGQTVDILDLYEDKTKVIDWSDAEEALTKPFKFDSSKYHFRR

SEQ ID NO: 2783 - protein, 165 aa, Unknown
  Kingdom: Fungi, Phylum: Ascomycota
MNKIPSISQGSKIQKRPLNRRQQPASSKSHIVYISSRTPFMAAVQRVRKTLDKAHLSHQNNATGPGGKHASLATRIEGLKRSGQASGAGSESGEKEVEVLVTGTGRALEKVLGVAAWFEEQGDCLVEIKTGTVGTVDDVVDEDGDEEEESRVRRMSSLEVAVKLK

SEQ ID NO: 2784 - protein, 461 aa, Unknown
  Kingdom: Fungi, Phylum: Ascomycota
MASPDYIHETSEKVHAPGETQMMDDENLKPGSIKESGEVFQKPQYRALGWIPTAIILMKLCFATGVLAIPSAFSTVGYGPGIILLIFWGALTTYYAYIMYVFRMQYAGVHNIADAAGLMGGPIAREVAGAIFLLTWILAAGSGFIGLAQGFDVLSSKHVCSVVWTLVAALCTALIASVQTLGKLAVLTWIGFASIFTAVFIIVVGVTQVDRPAAAPQEGPIYMEVLAVGHPSFIPGFVAAVNLFAGYGSTPTFMPVIAEMKTPKSFKKSLFTSQGFLVACYVSFALVVYTYCGQYVASPSLGSAGGLLEKVAYGISIPGFIMTSTLWIHLAAKFLLVRILRNSVHLQTNTVTHWAVWLGSTIGLSTISFIIAGAVPFFSYLIGLIGSLCCAPTCLIIPAFMGLYMDWQHRSQSKAKLAICIFHMVVVVLGSFVTVTGTYTTIQSIVDAYNDGTVGSPFTCS

SEQ ID NO: 2785 - protein, 383 aa, Unknown
  Kingdom: Fungi, Phylum: Ascomycota
MDGKPQDLAQAHGGADTTLADVEKAPPAGEEPPLQSTSDGDATNKSAFKALGLLDRFLAVWILLAMIIGVLLGNFVPETGPALDKGKFVAVGLLVMMYPILCKVRYESLFEIVKHPGLWKQILFSVIVNWIVAPFLMLALAWAFLPDKTDLRTGLILVGLGRCIAMVLIWNGLAGGDAEYCAMLVAVNSILQIILFAPLAIFFIRVISHESTGDDISYSVVATSVAVFLGIPLAAAIVTRFGLRATAGPVWFERVFLRWAAPWSLIGLLYTIIVLFASKGHAVVHQIVSVVRVAAPLLVYFVVIFFATLAVTRKLGFGYELATTQSFTAASNNFELAIAVAVATYGQDSDQALAATVGPLIEVPVLLGLVYVARFAAKRWSWN

SEQ ID NO: 2786 - protein, 524 aa, Unknown
  Kingdom: Fungi, Phylum: Ascomycota
MDASHLSKAHDHARAAAVATRQSSSDPTSAITEHTHAAGEFANAAVSTSSVEALRTLRLLEQHHRRLAEILQLPPDTTSNISTVSQGSDATDISEKEGSEKAGGTVPGLKREGSSGVAAGRTGSKPTLAQQRREMSSSIVSNLASARGIRSKYRGTPLTPSVSSDQAPGSVDPHSRRDGPKTKMQNIIEHQSGKPTWVPPGPVANTKPAAPVKAVSSPRTEASTAVADDAGYGRFYNTFGSIINKISAPLAFAGLPLIQEESTTSEQQHEVVAPPMPKSPRRPTSSHTSSSAANPDLSKIYSKATMRALARDGHTSAPSDSFYVVPTSGHTMSYASILTYAEKEKRRLGASTHSGGPSDHGMDDGEDDFVDARESPVPLSPGAKRRTGKARSDRDLNNTIEELYTENKSLKDLLDKLTKRLHAFEASSQTSAMALAESYRVMRPGSPLAPGSGGGASSSGGNKEAEEQLAAAMKQMEKLEKDNRKMQKTLEKYREKWELLKKGAKARREAQGPSDSLEDAAAVE

SEQ ID NO: 2787 - protein, 334 aa, Unknown
  Kingdom: Fungi, Phylum: Ascomycota
MVSEAQALDIYKSSIHFDGLNIANWGPEIFQAWHDGGITGVSCTCGLWEGLRGSLANVVQWKEWFEEHSNLIVQAHNVKDIRKAKEDGRTAVLLSWQNTAGIEDQLSYLRVFRDLGVRKMQLTYNTQNYSGAGYTELNDSGLTGFGREVVSEMAKLGIVCDLSHVGPKTTEDVINFAPEGKPPCFSHVLPGGLKAHPRNKDDRLIKLLGEKGGFIGLSQFGPHMEKGNDSTIDDYVDALDYVISLIGEELVGIGSDASEGHGRPSDFMAWCNKDKGYARQLTPWGSQKVVKPLGKLADRAQLAAAMGRKGWEEQKIRNVLGENWLKYLEKIFGE

SEQ ID NO: 2788 - protein, 201 aa, Unknown
  Kingdom: Fungi, Phylum: Ascomycota
MSLTYGLGGIGSFILVVGAYMLFTGSGESFNVGAALESISPYAWASTGIALCIGLSVVGAAWGIFITGSSILGGGVKAPRIRTKNLISIIFCEVVAIYGVIMAIIFSAKVSALEGPEMFSADAYYTGFALFWAGITVGGCNLVCGITVGINGSGAALADAADPSLFVKILVIEIFSSVLGLFGLIIGLLTASKAHEFGQKN

SEQ ID NO: 2789 - protein, 644 aa, Unknown
  Kingdom: Fungi, Phylum: Ascomycota
MFRFWSSDSRGSERSDQLTEAHHSPIDLTQPQQPQTSLQELQQRPAVAPVDFSSTISSLSEVTSKRRRPSFDDSDDNLNMEEPAKRARTRDSACEVDSRSATPEMDIDICSPPSTLERARDVISHQIGLEVLLKHDELRLINQELAKCQVALEQLRRCHLIPYPTACPTPEQMLDISSGKGPALRSQHGEKVPQWAPPFGVADGPYARHYAKWLIPDPAFDGVEPEWQFTPEATRARHSFAEGRTTRNSFTEPGPASKGRPSRANAGAKLQALSQGYPQPKEKAGPCVLKRSDGKTVKLVCIDCHRDNFSSTQGFINHCRIAHKRDFKSHDEAAMQSGQPIDQESAVAVTQKNIPEKLPGSATGAPVTSSVIPAAVHPFARSDMSDQQACAALRSRIASSLELYNRGKLPGVTAIPVSKPLSGKPVVSGATADVPHLSRLLQSRKFNGSLGQLVRDAKTKISYEDITPDEDSDDADMSTNESSNERAPVVMRVPAKSAKSPAPSGPAKRPTSSKSRAHMTFVPPPQLPPNALKTSPKPPMSQDDIDMEANLSPNTLVSNIAPSLVSDDGEYDESDDASSVSGDSAVLDEDSETDVAEITLDDDHDHRNIGRGSGAVRLRKDDAKHVTFMSPVQTAAQARRKPKA

SEQ ID NO: 2790 - protein, 339 aa, Unknown
  Kingdom: Fungi, Phylum: Ascomycota
MTPKGTIAVEEAIITPSTTWLLKETQSILTPGDHSGKALEAHTAKLLDIHDKRLASMDAEGVEYMLLSLTAPGCQGITEPELAAQTAREANDWLAGEVSKRPDRFGGLAALSMHSAETAAQELERAVKELGFFGGLVNDYQSTEHGKEYFDTKKYDVFWKKVEDLDVPIYLHPRYLPKKDLEPGTLYGDRPHLMGAAVQFHLDLSLHIYAICASGIFDRYPGARIVAGHLGEGIPFNLWRACHWYNKPTKRATRPSKEDYEYYFERNVFITTSGNFSTPGLKFCIDAIGVDRCLYSIDTPYDSIEEGQAWWKTVRLDQEAKEKVGRTNAIKLFKLPLEV

SEQ ID NO: 2791 - protein, 475 aa, Unknown
  Kingdom: Fungi, Phylum: Ascomycota
MWDAAAQAMDEDFLEHQLHIIVYLERIGGSISLVAVFLIFIAYALVPRTRNVQNTFIVFASVSNIGASVASIIALDGLQAGKETALCQAQSFLFEMFMQSDPWWSLAMAINVFLVFFFRTSPDSFKRWWWVYCLVCYGGPFIIALSLLFVRKEGRGPVYGGATIWCWVDKEWDEIRIYTYYMLIWICIVGSLLFYSMVGYHVFHTRNQLRSLSTSKNRDGGNMVEVPKVALSPLPSDAFYGTAITEIQVTHSSIPLHYPTVSTPKRALGANVSHVSFEEDSSPPPNPSATRTYYSSVTSSAPPLSKKRSVTGQSPSSTIARYKRAVRKTLAKFVIDDPIKRAYLRTSFLFALSVLVTWIPSSLNRIHSWLQGKSPFEYHVATAAVLPLQGLWNAVIFFVTSGTALKAAWIGFWTDRRGEEEEDDSMDTNGQEYRRGPRRHGEFDSDLDDGDSGVAGSDVELRRMADAPGKRSESL

SEQ ID NO: 2792 - protein, 366 aa, Unknown
  Kingdom: Fungi, Phylum: Ascomycota
MEQQNYPVCGFVPSYILEAIVSSSNAPEESKLACKATLDHKHKCDTHLHDASSVPQMQTLQQSLLGVNGTSGLQRRIYDCRETDEFPTKPVRSEGGERPKDRQVNNCYDGFKITYDFFSTVFGRKSLDGKGMPLLGYVHFKPDEEAAGYNNAFWDGQKNRMVFGDGDHIFFDYLTDSLDVIAHELSHGFVQYSSPLEYYEQAGALNESCADVFGSMVEQWHMRQSVEDADWNLGQTLFPVAFTGSALRTLKAGKAYTGDPVFRTDRQPKHMKDYYGGEDDGRGVHINSGIPNHAFYLAAKALGGNSWDKAGQVWYKTMTSGLIPFKCDFKTFAEATVKIAGQAFDGAVEETIRDAWVKVGVLTAIE

SEQ ID NO: 2793 - protein, 557 aa, Unknown
  Kingdom: Fungi, Phylum: Ascomycota
MAEEGQPSAPKTRPTSPPEGQSGRPYVPTLAVTSPRNYGNIDAENESNLQILSSVESPKPAGTRLRESSVRRSRTNLRKRAYSSGENSMDEDSTHSDVASHRHRPVVHSEACPLFRLPPELIHEILEYLEPFQLALTSATCRFLREHAISEVHWQRLVQENVPGTVLTTPGPVASFRELYALHNRLWFLPKYRLWFSNLELTGRLIIARFDPARACIEAYQAVVAAQSKTYQAWESDSRVIIHSFEATAGLHTTRPVLQFLPEDADNHSEESSINKLHPWLDEIPIPLDDRSDGIHNSLSLTRPLNDEVIQESMAASFPYQQLWPPPIIPARDYIKSYPFDLPMESRPRRREEVSDQTFRIRRWMEMSGAIGVRLGEDVAAYATLNPELYTPTKTRPWRGIWVGDYSGHGFEFLLIHQPDAPPATDAELDLVRSEDENDEDWEQRRLEARIFRGRLEAIKLTGDPNVPRGEYTFVADDLGPDGYVGLVHDDVLMGDDPRGTRVVRSKGHVALTGFVEDMFIESQLMLISPNKLAQYWVEFGHISYFQRVDIDSLLTA

SEQ ID NO: 2794 - protein, 1582 aa, Unknown
  Kingdom: Fungi, Phylum: Ascomycota
MDLPPPAPTPPVNSAMSANGGGNGANGGGADGNRTASLLNLLKFSGGGGTGIAGNQRHVSQEGLPSGAVEHQQHQQLSPPQSQSYQHHQHSQSFGQQQAYQHQPSGLSQAQFPSAAQIHQPAPTSADPTGLLAALMRGASQDPEEPKPVPVAAPTAPAAPQPPSTFGQGSPPPDTTSYLLGLLNRSKPAQSEPQQQLPMLTETSRSNNDTPQSEDRLAEAERYIAQQQKQHQSRSSSYGMPQQYQQQERDYPYRPAPEVGNDVALYQQLVSNLSQGSPHSQSSHPASSQAPFQILNKDHASPAGSHHRESQHMGTEGSPFASPRFRNQVERSSSHHSHPSVKQTPPSSDHDRYSASGKTRDAMHDSLDFPTGQSDHDDRDSLLQAEQDGAHTEIADDINGMLQAKSESDFEHIAQAAAQVLKQELDRDVNEGVLEQTLPIEEAQAVRDIVEEAAQGVADSWESADQDEIVVIEDKEVAAVKVFNFPMKPWIAISLQDGSTEPRPEFRPEAIMDIARLKKDFDQIDRNLYTASQNYMTYGMSKQGGLRVIRQDDGKDAKVFTDTKDRIFNVAMSVTPSDIEAPHRESIIGTGISGTVYWVEIKDGSKDHIDDTHLEQYGFALPPINTTEGDAPGGALKTRARASTMHPEFFAVGRGKSINLIWPSYIMQNNLFKPGHDRVVDTDKLLSQCSLKINTGKAGKDFTFSQDDSVVVSLDKSGRVKFWDVRDLTAVKDGSDPRFPIPAQSSLEVKEPLMTLASTPEGEKAWPTSVLLLDKQRPYQKRCALRYMIVGMKQNHTLQLWDLALGKPVQEFNLPHSKESDAVCSVMYHAATGMIVIGHPTRNSVYFAHLSAPRYNLKSVSQADYIQRLMAQDSSIPQPESTAVISGVREYSFENRGVLRSLDILSNPAMTQDSDEPTLFELYAMHSKGVACLLIKQPELGWSKDNKVLEGVDAVAEGVVTVSKLRSPQPSEAPSAAPEVPQVRTINRGSSKDGQQAPPAQPESSHKPSENASHGKTKSDNKDVETPVQSSKENQPEKPERKPRKKKAAAQNSDTTTNGTSNAQSTKTEASRAPGISTDTLDSAIAQLEARLNTSLSESVKTSLKGLQSNLDEGSRARDESFNQHQLKLLDMVSEVLNDNTQKVLEALIHHQFTELVIPAIGDKAGKAVTDLLNNKLQPHVASTVQREIQNTLPHALSRSLRSNDFINSIADRVGSNVASGIQQEVVNTLVQRLTPTINNIAKQSAQSVAGEIHQQYRDQFDHMKSQHAADTQKIDQLLSYVTRLTDMVSTMAQSQSTLQAEFFKFRQQPVHELPGVSGGPGSQPGDTPRNLAQQVLQHGSMSGAQGPPSHQGSFGPGHAPSHNQSFMGSPQYMRGQQPMGSPQAPAPPSEQVGPASSVNAMPGAYASQMQKAEPEADQDLIHQIRVIEQLVQEGRLQDAVIRWIQSGREAEIFRRCLSRYPPSKFESIPHLLLLVVIATISKDLKPNPRLKEEVEWIEMAVKAFRESLPAYDWDQNGVREVMKSTSQTMQMLISRVRPLLASIGDGYPKDPFLMGLEPNKLEWIVRTADQILEGIGGGVHY

SEQ ID NO: 2795 - protein, 135 aa, Unknown
  Kingdom: Fungi, Phylum: Ascomycota
MAEVDDTHISVRFKHGVHTIYLFVDSLAPVSEVTKELLQLLQERYSEGLTTSLDPPKTTAVPDTTEVAYAVLNVPTDPTRGWKKLKIGEQGEFTPLKAGMKDNGIVAFAFVESLDDEPRFEVEWPREDEEAYDDA

SEQ ID NO: 2796 - protein, 251 aa, Unknown
  Kingdom: Fungi, Phylum: Ascomycota
MADQDQNSLASTFPDPPPFWKDFTPDRVAKIAELRAASAENNDGDGEVPVRIDGVPEDLLLLQPPAEPADGRWRIFGDQYMLDDKLPTLEDQGITNLPTTGPPESKESKHYDRAFELKRLAKSLLLNFLELTGTLSHSPSDSEAKIQDLRTLFINLHHILNEYRPHQARESAIELMQDHLDRTRTETVAIRTQVDKARRVLEGLGSLGIVDQGVDVGKSEVELKREVEEKEEALKLEREAEIWAATDAACS

SEQ ID NO: 2797 - protein, 2248 aa, Unknown
  Kingdom: Fungi, Phylum: Ascomycota
MPKDTVDSGGKRMTQIKDKSVGGGGPVIDKTKAASFNKAFREYLEGKRPVATLHEARIFFDAVQLQPSPSECLERIVGSKVGLKAVRHSVRVSLDKEFVRLKLFPFLFHFSDPEATALYDGTFLHQLIKEVVSPPTAWRNITKIYQEDTILHEEKESEVFAWLCLQIVRHPDPELSSLAKDVGSLLVETPLLNLPWNRTRVSAYLIKNALDAKTGIATALDDASRLGGPGGRHDNDFRDFRQTAIFPTSDELTSTLKPFFRTANEVAQTVSSLRPACHLDNQFRLYRADFLSEMRDDLAAIIRPGKGTRRQQVLSRLSYVGVSAGEFRRTHDCALKVSFGSGLTLPRKLNEEGRRDYLRDHPRILGHQSLGVLLDDDKVIEFAFVVRDTADLARAQPVISLRFLAAQSLSNAFQVLTSRPELRFAIVDSSWFAYEPVLERLKQITELPLQNELLMLTDVGGAAANPFKPTEQIRNFANRCRENAAQNKAISVAGRTYVLDEAQAGALTGALENALSVIQGPPGTGKSFLGALIVKLLLQTGSSKVLVMSYTNHSTDQMLDDLCEIGISRDSITRLGSKHKASLRTADLCLDAQIQNSEHRMGRAQWEQVDILRSDMQELSTDVSAALSRFDSKVSDSSVLDFLELDDCEQSHKFWAAFNEPTSDGSFHVAGKAGKKLKPEALLNQWHQGREPGSARSRMSQESQNIWALSPFARAQLMAKWRASIMQERVEAVTNLVSQIDEAQSKIDIILNESKCAFAATRRVIGCTTTAAAKNMALLKAFKPTCILVEEAGEILEPHVLAALCPSTEQLVLIGDHKQLRPKCNSYALSVEMGDGFDLNRSLFERLIIEGQRHVTLKKQHRMAPEISEIVRSLTYPDLQDGDKTIGRPRIRGLCSRVVFVNHDQPEESHVQIDDRGDAGSKGSKQNTFEAEMVLKIVKYLGQQGYKSENIVVLTPYLGQLRLLRDMLSRENDPILNDLDSAELLRANLLTNAAAKVDKAQIKLSSIDNYQGEESDIVVASLTRSNTRADIGFMKAPERLNVLVSRARDCLIMIGNMATFMKAPNGQETWHPFFKQLKEKVFLHDGIQVRCERHPDRVATLLVPDDFDEKCPEGGCSEICQVMLPCGVHSCQLKCHRLADHSKVICTALGKMECEKAHKYKVRCGQPSKACPVCLKEEADMRRRAKRHLDLEKARLAKQAQYRQELEMIQDEIAHLKRLDEIEAEEKAENKSLAEEQNKLAALKKAKEQSDTLKQASIDALEKQKASDLAGVSHAQDFQRSVKATTSPAQMEWNAMKNDELAQSQELDTLMGMIGLESVKGMFLDIKGQVDVTTKQGIGLGDDRFGCTLLGNPGTGKTTVARIYGRFLTSMGVLPGQFFEETTGSKLATMGSKGCQQLIDNVLDNGGGVIFIDEAYQLSSGNSPGGAAVLDFLLAEVENLRSQIVFVLAGYDKQMESFFTHNPGFPSRFPLTLKFDDYDDEELLDIFALQINTRFKGRMQVEDGSHGLYARVAMRRLGRGRGKQGFGNARAVENTLSKIYRNQARRLKAERHKAKKKADSSVPEPNVLQLTKEDIIGPRPSQALLQSKAWATLQELTGLDSIKESVQVLVDTLETNYDRELLEQPIIEYSLNRVFLGNPGTGKTTVAKLYGQLLAQVGALSIGEVVVKCPADFVGDVLGASEKTTKGILDSTVGKVLLIDEAYSFYGGGGGADIYKTAAIDTIVANVHSTPGDDRCILMLGYQEQMHDMLKNMNPGLLRRFPLQSAFVFEDFDPAQLATIFRFKLKKQGFKATPKAEEVALQMLERARSQPQFGNAGEVDILLDAAKSRHQKRLSAGKTKRKETLEALDFDEEYDRGSKADVAHLFEGTVGSEHIVSLLQGYQTTVRQVVALGMNPKESIPFNFLFRGPPGTGKTTTARKMGKVFYDAGILGSAEVVECSTSDLIGQYVGQTGPKVRDALDKALGKVMFIDEAYRFASGGGGFAQEALDEIVDACTKERYHKKLIIILAGYEKDINTLLTANPGLSSRFPEVVDFRPLSGSAIKASGSGVVDVTEDLISKEFETFIAEKESRASAEKFLGQTNTLSLPTLQAKPASNAYAPAISTATTTATSSAAKADPEDQPEEAEPSKKASSDTEVLHVKKRPVRDAGVSDEVWDQLRADTREQEKREEEYEEKLRAEKTANGNERERIVNELLEEEAKRKKEEEMRMKLKQRGVCPMGFDWIRQQSGWRCAGGSHFMSDEGAAQM

SEQ ID NO: 2798 - protein, 626 aa, Unknown
  Kingdom: Fungi, Phylum: Ascomycota
MSAPPPPPPPPHGGVPKGSGLPPGKYDIFVIPEHSAGSGFLYLPSLQPNVNSFAAGFASALILVALFQSMAPAFRAWWDQFQGMGNTGILLIIAGVGFGAWALGRTQQDGGKPPPPGGHSGHGEGAGFGTHTNGAAPGPDPNAAPPPPPPPHNESKPQPPPQPEKPKTSWQRQAPPQPGPSKAESAKGSWEKAREETRKREEERKAKEAEQKRREDAAKRLAELRAKEARERQEREAKRNKEAKEAQAKIDAEKRLAELKAAAEAKAAAELKAAEERKKKLEEEAAQSSRKGSSYAYSGVGEKTSMWPNGRPPVPSHSPSKTPASPNRRPPAPTAKTYLSTDEDQYSFRPYDQPKRPRHKPSVSSLSGSEASWAPSQTTAKTTPPGSFRGPYSTKDPDKIVISGVYLFASQFAKEPASQLLSGVGSVTDGLILRITTEGLFIDDDVRGVPQREWDVKAWTLKQVEVWCPPHCLTPSSSTPSLAQAKPTPNLLHKMAGSKGVARSQAGVPRVLTGEEADLYLVEMLRACKDCCRLELCDEHRLARNADIVLPPGQTGEWKAPGLHVLRATVKDQDGKRYLFVVEDVESWKLAVGLQRLKRGTQAKSLGVSGMSAKDAKGTLEMLGFH

SEQ ID NO: 2799 - protein, 178 aa, Unknown
  Kingdom: Fungi, Phylum: Ascomycota
MESLQLSQVLADLSNLGAAEPEAAAAIVSANTNVAIPKTDASQPTSSPSNLQVPQNQQRPSGLTRSWSTEPGQPKLDKYGRRILVNTPGSRSGSAATSTPGTPRHGVTTSDLDADLERASTLMALYDIRSKLKQQDNSSLLRAREKINALAARQQAQQTAKTEEMRRNRYSFPKSTKG

SEQ ID NO: 2800 - protein, 990 aa, Unknown
  Kingdom: Fungi, Phylum: Ascomycota
MFSISTAPAKQSVGETITTLSGRLSSATLLEDRRAAILGLRSFAKDFPASVASGALRSLIGSLSKDGEDVDTVKVVLETLLTLFSPNEESPEASDEIALWLADEFTQRQDNITLLLNFLDTNDFYSRLYSLQLLGAILSARTERTEECIFTAPLGISRLVLILDDPREAVRNEVITLLTYLTPSSVDIQKLVAFENAFEKLFSIIAADGSLAEGGRTVEDCLILLANLLRRNASNQSLFRESGCVSKLANLLSGLLQGQSETNLEVAGWAETQKNRNVYAFLAVVRLFLGRRFNGTAQNQAAFWKHGLSFHVLQLAFSHDAQAQIKAEALMTCADMIRGNATIQESFAQMMVTSPLQIADKAKDQANGLSQVYVIDGLLDLTLNTPDLSTFDVRFAACDCLQAYFAHHEDVRLHFLSRAIEGYQTHHDDAANVLSVILRSDTSSKVADPYRVWFAAVITFHLLHDNPTAKAKALALTEGDTENGEEVVTVVQTIAAHFISGVWRDDDVRVLIANLMLLCGWLFEDLDTVNDFLSEGSNIQSLIQITLQPNVAGGDLIQGLSALLLGIAYEFSTKDSPIPRATLRSILTSRLEKEKYADRLSKLRSHPLVRDFEVTPQRLDNSPPGELPDVFLDGTFVEFLKDNYSRISRALDRDPGLEISVVSNGVQKGISRELVDSLRGQVQEKEHALQDAQAALATIEGKLGQEQADHRRSKDNAAAEVTKAQSAAESLGRAHEAELRKLQSQLSAKDVESQKAIARVQAQLSTKDNDHQKELARLKSQFSTKENDHQKEIARLKSSFSTKEGDHEKQLAQLKKTMEQESEKTQRRTQAEMADLKATISRLEVDLMKANKAKTQELQALKDEHVTALAKEKKRADEAEKKIKSNETKLKEAEKKAKEQAKEHTTELENARQKVDEIQAKSADTTSALAEAKKAKESTQSELDDLLLVFGELEDKVAKYRKRLVALGETVSDAEDDDDDDESGSDEDVD

SEQ ID NO: 2801 - protein, 1112 aa, Unknown
  Kingdom: Fungi, Phylum: Ascomycota
MSLTRGQRPDIARVHTQVPVTALAFHGQHLLAAQDTSLCIYDIESGSLVAQRSPHAFASVNSGQPIHGINVHPVTGAILLWGASAVAYLPEGWKGKAEISGKATDWIYAGALSPHEAGDQSWQGLGVVVTAHNDLVPLIMDEASGRLVFGHAISPSRPILYSATLSFLTPNTLLVVGGTVFGEIIVWRCRLDSDADSSSGSELQAKVLYTLVGHEGSIFGVAISQPLDNGRRILASCSDDRTIRLWDITDHDLDTTASRNEPGAARETGFNTTSTTSSKPIATAMGHSSRIWGVRLVAAEDDPSSIVVYSFGEDATMQRWGVDLQAGTLSHENTFALNDGKHLWAHALLTRPNGSLLFATGGADSRISLIEEPAPTKTSGSSSLVTIDIKDILKDAPSIANAPKRAKEIITRYDFLSADELVAMTSSGRILRGTVGATATEWRIFPVENEQHAEDLSLCYALKAITPGVVALGTTSGNVYAYDMNKGLSLVTSLDGRIMDILLVEGSLDSTASTVDVYVQLQGNKAPCYLTVNTSNSTLLCKADLNELDDRFVAVSVLKARDYVFIGSRHGYLSILKPHNLEDGYTTYPVIYTLPPRAQDAISCIVEIPSDHTSSSTPPLYIMTTSRDGYYRIYHLHDSPSSAKVSLELLHETPAPFGPILTGAYFKTPDAPSASPELILHGFGGKDFLIYNETQRAELASIHCGGAHRMHCLWTDPSSANDPARLRFAFTRTSLISIYAQDTVSHRSLTPGTHGREIRALSSNEKYLATGSEDTTIRIWSIEEVDNKPHHLMTMKAHNTGIQQLRWLGPSHLLSSGGFEEFFIWRVRRLKDSLYNGVAVMREAKLEDTSGDTDGDLRIMDFDACWGTERAEEGEQKMIITMVLSDSTLKTYSYTPSGGFVLLGKGRYTGACMTQIRHLTPGTVEEIQLVTGSTDGHLCIWKSDATATYHISSSKKLHQNTIKAMDTLKYKDSSSGHSKNFLVLTGGDDNAIHLSHVTSSASSEDPKTTAYSIIKQASFPRAHAASINGITILPPSESAGASSGYTGVSTSNDQRVKLWDLGSGQKLSLVKDRYSGVADPGDLEVLHGERRTLITGGVGMEVWQVNGQNHEQ

SEQ ID NO: 2802 - protein, 108 aa, Unknown
  Kingdom: Fungi, Phylum: Ascomycota
MGVASMVILVLITILFPPLGVWMIAGCGMDLFINICLTVLGVLPGHLHAFYLMWVYYDRREQAREGRYAQRPAPGVYSSHVQTGGGHNYGTVNHPPANHPQANYGPAH

SEQ ID NO: 2803 - protein, 1864 aa, Unknown
  Kingdom: Fungi, Phylum: Ascomycota
MALDPGSGRRSVSPESSGRDSPIPPQWRTQLGGDQPNIKDKNYKRYAAGIDKVLTLFDTALEEWADYISFLNKLLKALQTRPTNITRIPASPTVAKRLSQCLDPSLPSGVHQKALEVYAYIFTAIGRDGLSRDLPTWLPGLSSTLSFASLSVRSPFLDILEEHLLHIDPRSLRPAMRSIILALLPGLEEETSEDFERTLKLVNRFKEAVRPHDGGLLTDDHSTGDQFFWQCFFLASITGQSRRAGALAYLVRYLPALAGTVGEKDDSNTFHEQLAAMVTSPEPGLLIRCFATGLADEQLLIQRGFLDLLVTHLPLNSTVLQDRVKAPDLQLLLKAAVGVVTRREMSLNRRLWAWFLGPETPAGDAEQVPESPATPSDPTQAILGSRTSFFEEYGLHPLTKALLAMIHDSGSGTASDRARPYRICLSLMDRWEIGGLVVPEVFLPVVDNVRQFKSQARSKAEFVEVLRSASVFFDGIESGLIYGEIVGLVAQAMGPGNAAMAERRDKLDLVLFILEHFNVREEEMITIHAPLCCLTALSMLEDHVARQTPETKNGEASASLQEKLLNVASALLELVPERAFAKQAKNCAANESKKSPVNAELLKKIRAFYVHDQGNIDVTPAPFGPVEIGEQLLDKSVRFIRGDLKGHCTMDLRSRIRFLLLVLLKTPEDYTLERQALLSFLRDRMVSQRQVSFSEYSSVVHLATQLHSLNRIRIDDLSTLVLPLVRHAWAFLAAAEPKYHVEAVRCLWYLQTSLSAASREVEAALCTLIVEAKSVTSGSADAVDIGRTFGILWSHTLQDNVSDRRGPRTPLVEHRTSPRLGGMEHFEVMLTQPLFLVLDSLLDERTQLFMTVKSWLNSMIGIDRLFLIFVSKLLGMRFLANVESESAEGIVYNPTPVQFSEDDDLELCLYYLRTLSNIMRCSSEVSWAVVATKHLSFDESVPHISTGNSEGDITLQDLFVRVCVRCVTGDAPTSASPDLIERISELQRFALSTLHIFFSGQFASSFSSLHLENMLIQRLSASITRSDPYVQVLLLEVVHDTLRLRDMTSPEPPTSPTERRPSAMDASRQSRTSLALSESQPAKLPPPPQLLKCLQAGLSSPQSRLVLDSWIKFLGQCLPFYSNTIFQVVIPLVETFCKQISLTFASLKDTFRTSRDNGASATGSPESTLIYLLNGLEQILAAAHDQLLSAEARAQLVKSPDQPQSIFGSMVSGVWQSDSPQSRSATANDRLTVHLAFQDAVRMCYSIWCWGQGDEASEQDPVSSASFSYTSLRMRNRARRLLEHLFHAESLECLETVIDLWNQPGSASSKSQVFNLLSALDASRPRHTIPALFNAIYSRTNPSALEPWRKSTLTITLEDSELVVFLVEYTRSLDDDAMDEIWTDCITFIKDILSNPFPHRQTLPRLLEFAAILGEKVDNTNFGEQRKMRRELGDLFLRLLTALFTTRPMTFTDSTNGSNEKNSRGTTNGDGDDQQDVVSILAAVVPELPKVLVDQDRVLSAAGTISAGAVAPAIRAKAFPDTLSVGTLRLFHELSRLQNNQKTWKKDVGDAFNDSKFFSMHTALVREHWLPLLRLWTRSDKERLPEIVGRINPPSTAGIVFGVGATSARLEADRKTQINLRRIATVVLSSAEDTFVTDLPLIVDKLVELLAATATSSPSSTTRADVYLVIRALVLKTSPIHMGTLWPVVNTEIHAAMSSVVAPDHSSASDMYNNSTVLQACKLLDLLICIAPDDFQLHEWLFITDTIDAIYRSHNYQPVSLVDELSEELAHATGVPPSTTTVDAGSVVAGSPRRRPLIGPGGISDEISLERRDELVAKILRPFFSQLSIFAFESTYAMVPLDRDLCLDLLLKDIFEEKTIVKTL

SEQ ID NO: 2804 - protein, 525 aa, Unknown
  Kingdom: Fungi, Phylum: Ascomycota
MLKQQVASSASAIYAKLSTKPFILYAPVIIPKMSTTESPMRPQKPRGIDHTDSGSEDEIVEQGKVNMPTNGRYFPLGYKDAAWQWWSSISPPLAENAVLSHMPYLKRSTDSFTTLPSEVAAEAVADPYGNRVWKRTLVKLSGQDRALNEISIERVGEETEETLVMLHGYGAGLGFFYKNLEPISRTKGLQLYALDMLGMGNSSRPAFKVHAKEKEDRVIEAESFFIDALEEWRKARKIERFTLLGHSLGGYLAVSYALKYPGHLNKLILASPVGIPEDPFAVNSALPEPEESTMTNEFTQSQEVTTESNTTGRSARAANSARRPMPGWLVWLWDQNVSPFSIVRLAGPLGPRFVSGWTSRRFSHLPPAEAQALHDYSFSIFKQKGSGEYALTYLLAPGAYARRPVIHRIQDVGRQVISKGEDGKPLKKEHGFPVVFMYGENDWMDADGGHDSAKKLNQASKQALTEASDEDKRLEKGSAKVIVVPKSGHHLYLDNPESFNKYMAKELKHTLTDLRQQRAESAKGN

SEQ ID NO: 2805 - protein, 201 aa, Unknown
  Kingdom: Fungi, Phylum: Ascomycota
MADTEQHDAPVESQSRHIVYCGVCTLPPEYCEYGGTVRKCQEWLETAHPDMYSRIWSAEALEAATASLSVEAQKRAAKDAQKKTAKAEAAEAKHADKMAKSVITIKRIERNKKKFVTAVIGLEAFDLELKKVAKDLGKKFATGASVTKVPSGGEEIVVQGDVSDEVEEFLVEKYKNIPEDNFEFVDDKKKKKAAAAAAGGS

SEQ ID NO: 2806 - protein, 292 aa, Unknown
  Kingdom: Fungi, Phylum: Ascomycota
MSTAAQEEFNDLVAKNTHRETLHPEDRHDPDNQNHDDATEEDHFRNAQIESAMRSNTQAPGAAPDIHLPPTSFDAGHSTGVKGVIADARSFENARRSKWKSRIQTARQSIFGVDSVSRPQRTGSANSSLSSSPSESGSAGTDEEAFLEEWRERRRKELESEAGRGARTRRTSPSARIYGRFDEVDAMGYLDAIEKVGRETKVLVFVYDHECEVSATVEAALVPLVKEHPTIHFVKVHYDEIEFDPAAVPSLLAYHNQGDLFANMTGLIEMLPDDDSFGTASLVKILQHNRVL

SEQ ID NO: 2807 - protein, 114 aa, Unknown
  Kingdom: Fungi, Phylum: Ascomycota
MAANSADQPQEEGWIATSFERKYYKRDGAFIKRSLRPGEFNVAFRGRHVPRLGKERLKNEAESLEYIRAHTDIPVPKVYCHFEDDQAYYLITEYVEGEGMSDRTEEQKAVVQLN

SEQ ID NO: 2808 - protein, 816 aa, Unknown
  Kingdom: Fungi, Phylum: Ascomycota
MALRELKPLHDYEAQQTAFESFLKDFKTSPEQTITTAMGNITIDEDDLSDDDYDFMDEENEQARADRRKEKESRRIPQPKYKLMLQQLADRSIDEMTVDLDDLAAWERIDNAEHKLVESIEMNTKHYVEIVARAVDKVMPTPSTDVTFKDDVLDVLMARRQARNREMEEVAERDATVEAEKFPAELTRRYTLVFKPRSLINGEPTKALAVRGVRGEHLGKLITMRAIATRVSDVKPIVQVSAYTCDRCGCEIFQPITDKQFGPLSMCPSADCEKNQTKGQLNPSSRASKFLPFQELKVQEMAEQVPIGQIPRSLTVHCYGSLVRQVNPGDVVDISGIFLPTPYTGFKAMKAGLLTDTYLEAHHILQHKKAYSEMIVDFSLVRRIEKYRQSGQVYELLAKSIAPEIYGHVDVKKALLLLLIGGVTKEVGDGMKIRGDINICLMGDPGVAKSQLLKYISKVAPRGVYTSGRGSSGVGLTAAVMRDPVTDEMVLEGGALVLADNGICAIDEFDKMDDNDRTAIHEVMEQQTISISKAGISTTLNARTSILAAANPIYGRYNPRISPVENINLPAALLSRFDIMFLLLDTPNRESDEQLAKHVAYVHMHNRHPDIGTDNVVFSPHEVRSYVAQARTYRPTVPENVSEYMIKTYVRLRDQQQRAEKKGKSFTHTTPRTLLGVVRLAQALARLRFSNEVTRDDVDEALRIIEASKESLNAEVGNGRRGLNASSRIYNLVKALADTGACRADDADDDEALGVELNMRKVKERVIAKGFTEDQWLNALEEYTTLDVWQTTGSGARLVFVTAGEDDRDDEDLMDF

SEQ ID NO: 2809 - protein, 562 aa, Unknown
  Kingdom: Fungi, Phylum: Ascomycota
MAEPQPNIQSILAALAAQRPATTPTQTPPGAPSQAYPPPGAQYQQGPPGAPAYNAPPPGLPAPASSGNVDLSAIRPINSGTVNFDDIVSKARALAGQKGATSYDRPIVYNSEPRASEPRGFRSRSRSPRGDYHHDNYRDDRRGGGGGGYGRDYGRDRSHSPPRGGRQSSPRGGGRDRSPIRGGDDSSEVIEIESSLVGLIIGRQGENLRRIEAESKCRVQFLASTDGGPFRQCKITGPRARRGEVKDAINQIIEDSGMGALNRGGDKSRASVPQDKGAGAGTLREGEDHVQIMVPDRTVGLIIGRGGETIRDLQERSGCHINIVGESKSVNGLRPVNLIGTREAATKAKDAIMEIVDSDSRGEATGSRAGPRPPPIGRDDNQPRGNAGGHFGGGGGGGDKITEAVYVPSDAVGMIIGKGGETIREMQNGTGCKINVQQGQPGETEREITLIGSRDSIAQAKQAIEEKVDAVRQKSGGGGGGGGGRGGRGGYQDNDRGGYSNQGPPSGANSQPPAASTDEADPYAQYGGYQNYVALWYQSLMYQQQQAGGQGAPSGAPASGAQ

SEQ ID NO: 2810 - protein, 291 aa, Unknown
  Kingdom: Fungi, Phylum: Ascomycota
MFSRRQDSSSKSFSTAHKSFSKSNKFSKSSSSFSKDNGVQKRRHESRHHRRPTTASTVATGSDDADMTSSTSPIVTLVVGTEQRLFAAHEDVLCGSPFFTHALRNTYSDTSTKRIALTDEEPEIFSSVLEYLYKGDYYPRLRHSKRRNSWELEPATTEEHGTVESTVYHRSVDGDLLKDTVIYCAAEKYGLEELKKLALRKQGLQSGIQCSTILTSARYAYANTPDNDSKLRAHYLALIIRSRSTFKRSGTMQLEMYNGGTQLFFDLFVALCNHTDDLSSAQGTPRSNRHF

SEQ ID NO: 2811 - protein, 290 aa, Unknown
  Kingdom: Fungi, Phylum: Ascomycota
MVEGQSTPESKPDDKPEDDAEATTQPASEKEAKDVANSADASSASKAQDRMARFKALQARAKNSSETNLKEATRESQRLATDPSQLTALHRKHAIASHKLLKADVEEAGEDFERKRAWDWTIDESEKWDKRLKKKSAHRDNNAFQDYAQESNKVYKRQLQNIDPDMDRYAKDKMAAIEKAAASGGLDIVETEDGELIAVDKDGSFYTTADSTSFTTNKPDKDAVDRLVADMRRAEEQTLKKRKERMAKNGDDGDVTHINEKNKQFNQKLARFYDKYTAEIRDSFERGTMI

SEQ ID NO: 2812 - protein, 625 aa, Unknown
  Kingdom: Fungi, Phylum: Ascomycota
MVEHEKNTAGESPKVEKIPHWRIVYDQAGITDSVRNHPYPGAGTQEDPYVVNWIPNDPRNPFNWSETKKWFITLTVALSTLAVALVSSAYTGGIREIMMKFSISQEVATLGVSLFVLGFAIGPLLWAPLSEVFGRQILFIVTYAGLTAFNAGAAGANNAATLIVCRFLAGAIGSSPLTNAGGVIADMFPAAQRGLAMSLFAAAPFLGPVLGPIIGGFLGEGPGWRWVLGFLAAFSGFFWIVGTLLVPETYAPVLLRKRAAKLSKMTGKVYKSKMEVDRGAISLGQTMKTALLRPWVLLFKEPIVLLLSIYMAIIYGTLYMLFAAFPIVYQQNRGWSSGIGGLSFLGIMVGMLFAVAYSIWDNKRYIRAEEANDGLAPPEARLPPALVGSAAIPIGLFWFAWTNYTSIHWMVSIAAGVPFGFGMVLVFLSIMNYLIDAYTIFAASVLAANSVLRSLFGAAFPLFTTQMYDRLGIHWASSIPAFLALACVPFPFLFYHYGEKVRSKCKFAAESLAFMRKMKDAERAREAQEDAEDDAESASDETATEAGADGERRPSTVREETQFEDIRPMSRRSTRRLSRATSSASRASRASHRFTMYEGNPYDIDRVNTNEEQFAMARTRSRPQA

SEQ ID NO: 2813 - protein, 237 aa, Unknown
  Kingdom: Fungi, Phylum: Ascomycota
MSINKHEENGRTVAASDLSERSTVATAPLRPMPASATALPIGAFATTLTTLSLSLMEWRGVTTVNVYVANFFFVAVFGLLISAQWELAAGNGFGYTVYSAFGLFYAGYAAILTPSFGIASAYGDDVTQFNNALGFFMILWSVFVFTFLIASLPTNIVFILIFTFVELGFLFVAASYFSIADGHVSAAKGLKQTGGAFCFIAGLVGWYLTIQLLIKDSIVELPLGDTSKYFKKTRKQE

SEQ ID NO: 2814 - protein, 476 aa, Unknown
  Kingdom: Fungi, Phylum: Ascomycota
MTAVMRPAGLAFCLAMLGHTAQAHDHHGGESNIPEGETISLEPLGTIMWIHIFVQMFAYGIIFPIGMVLGISKSRWHVPVQIFGTILAIVGFFLGHAHGGREFVGNNVHASFAWILQLLLAGQVVLGLYLKGHWEKGINGKIRKLIRPCHSIIGKAMPVLSWTQLIFGGITALGFCQGDHVGQCAAHFIMGSAFVAYGILLTIILLVGQVWLRRTGRSQEFYDSAVIAAWGCVNTFTEHRWGTDWVRNDWQHTTMGIIWWCAGLAGVWLSRDRDGNPKRNFIPGFVIFITGWAMSAHPQELHVSAATHSMFGYTLMAAGVTRIIEIAFILRDEQSLMADGRSWNSFQYLPIFLLYSAGFLFMGATEEQMLLVDQSSMDHVAYILILFSTAFMVFLFAHMLVHLYDRNANPQPHAKNFDNHEAENGRVRDAEEFELDGLMSDDEADEGRRMLRRSEDGLGSDSSPSTVGRNNQTRAQ

SEQ ID NO: 2815 - protein, 396 aa, Unknown
  Kingdom: Fungi, Phylum: Ascomycota
MRGGRFFCVALPLILCIAAIISLLYAVLAGVSHRRLNMFSVNVSNLTIDASDARDFISNLDVSNLADNLGDNIEDTIKENLPEGSDLEDLKSKLPDGTTLDDLKDKLPDGSSLDNIDINNIDIDSLLGNNNKARRALEARQDAVITASTLGLGDKYQVTLWGYCRIDSNGDRNCTDPEWDWASKHFNTSVLDTLAEQTGLNITLPKELHDALEVFKPVTKWTQIGFVISIVALAIDTRVISCLVWLWAGITTVIVIATAALATVTASVVVGAIESVGHKYNADASVNTSFLATIWIGAAFSIAAGLFWIFTICCCKPESRDDRKARKSYNDGEKLLPGSDRGGYGRLGDDNEMHGGMGRSPQPSPGFSPAYNYSGGPQYPQNARSDLAYEPYTSRA

SEQ ID NO: 2816 - protein, 240 aa, Unknown
  Kingdom: Fungi, Phylum: Ascomycota
MTPDVTTLYYRTINTFARTHLGARHSAPLYVFSAEFESMVQFATRGDWTSFAQAYLDPIQALITESSKPRVQGVVIGAILAHKVARQLEEALKSSGVPLLHVADFLASHVKSQMPQVKTLGLIGPKVTMLGAEDPDFFIGRLESPSNNLKILIPDSEESLNECNRGMMEEVAKGAANVTASTKEMFVMEAKALVERGAEAIILGSTDLGFVIGKEDVGDIPLLDAATIHAEGVAKWACGL

SEQ ID NO: 2817 - protein, 699 aa, Unknown
  Kingdom: Fungi, Phylum: Ascomycota
MGFLSKLQRKEPKEKAPASSSPNTSPLDPSSGLATSPSSPSTPSNQRVIEDPFTVGPRLPEDPRGHSASGSKSSNLTFTNTFVESRNGTASPNSSSSASASILSKEPVKPKPKERNCIQQFGHYVNSRVSIKSIWEILSPVEYFWPITLRRYACLALVGAICVGIYFSNVYTNWIHKSMAITRSFMLPILIIVLGLEPIMFVCILAASRMPPVNENLDAPTSGGPMQKTTLGDEEAVSISSDEEERYNTALVLPCHKSDTDTLRRVFESACRTAFRPKDIFVVDNAGQMRPNNLEFRDWVKAQHPDINYMWSPIGSKNAAQLVGSLAAKGYKYVLTTDDDVCLPDNYRHPFHLLTESTRAVAFPLTATDSKGDNPLFTVSWQDCEYRTSGLSKLAESNTCGVCFPHGAGWFIDREILIQIMETLHPTDFIAEDVNAGFCMMKIGKSIALDYNVVLATEVPMTLIGPGLNWFKQRVLSWEMGRHKMLFTLIRRVFSNNGQTTLTGVIAQKIFLLYNITTLVVDWVRVPVFVTMGYSGLFWIKVALFSLISIIPLMLYNYVKCWSRPTYRVRFVAALTYPIYKQLYILVSIMGFIRAVLFYMGGYKRAKPVYKMLKDGDEECFWLDPRFETNPAFLADEREDELIAEGLMPPRVAGALPNNLEFEAPVVQEKEKAKPKFIPSVTVKELARPLPALSRARSF

SEQ ID NO: 2818 - protein, 373 aa, Unknown
  Kingdom: Fungi, Phylum: Ascomycota
MVPPASVFLRAGAYRVTGRSPSQALSLSKQTVRRARSLATIAALRPVPDRIRTLRQSHSYLKQVRHSYATTTNPNPPLGKSNASNDQPSRIGLIGGRGYTGQAMVDLFEAHPYMDPRYVSSRELAGQNLEGYTKRKLVYEHLSPEEAAQLEESGEVDCWVMALPNGVGKRYVEAIDQVKKSDGKQSLIVDLSADYRLNDSWTYGLPELTSRSEVGSAKRISTPGCYATAAELGITPLLEHLGGEPVIFAVSGHSGAGTKPSPRNDVKLLEDNLIPYSLTGHTQEQEISHRLGTSISFIPHVASWFRGIHLTINIPLNKKISSRDIRQIYQDRYAGEKLVKVVGEAPHVKAVSSAHHCEIGGFAVDSSGKRVVV

SEQ ID NO: 2819 - protein, 2168 aa, Unknown
  Kingdom: Fungi, Phylum: Ascomycota
MDEQMSTQEQQLCQFLGELPQRFEYRFTDAARRELLNALFWSLAGGNKEFHKMLFPGAVPDSMKLSDAQGAVEGAEYTDAARGKRCGHIFKPGEASYMCRTCGTDDTCCLCSRCFDSTDHAGHMVRIQISVGNSGCCDCGDDEAWRTPLFCTIHSEMEAGSQKGKGKEAAGLPDNFVGSMQMTIGRVFDYICDVISCSPEQLRQTKTEESILKDEEQSRLSSQYYGSTAEECQDFCLVLWNDEKHTVREVQEQVARACRKTNSAAAKDAWDTDAIGRSILIYRDDVPALLQMSKIMEAIRITVTIRSARDTFREQMCGAMVEWLADVSGCAAAHDNHILRRTVCEELMKPWRKGSSATHTLGLIDDEEEDDQEHESRLAFRGVNARVLLALQAAVADGGVDFDDELEEEDDDEIEIEDADSLADVFGEENDMDGDDIMMVDARGEAADVTVDAAPDADAGDGDEIVDWPRPDDQALEEDEATMAGYPPPPPPPPVPPTRTAPRERDATPSDSDTAEPLIAPAIYAKANVEIPKTPGKTEKAIPKPARYWMEAPAVYTQRGEVPPAEDVFERVRLDWLLLFDLRMWKKVRNDLRSLYISTVVQVPEFKRVLALRFASLYTILAQLYLVGDREPDHSIINLSLQMLTTPSITAEVVERGNFMSSLLAILYTFLTTRQVGHPWDVSPDVVLAFESGSVTNRRMYHFYQDLKYLFGAPHVQERIRSEPRYLMQFLDLVKLHQCIGPNLRAVVEHVEYEADSWITASLVTRQINLQARGIAEAFRQCPPDEIHYLQRAIRFTAKTVILNSIGAERARFKASEIKEEVKFKTLTDFEFDTESDSHSVVKFVVEKDHISFHHALHYTLSWLIECARSLPASSIRTLLSFTTQELKAKPRLMGKLQFGRKEMTAEDHLMAAFDFPLRVCAWLAQIKANMWVRNGISLRHQASTYRGVGQRDVSHHRDIFLLQTALVICNPARVLASVVDRFGMEGWVKGLFELKSEAQDDAQHLDIVEDMIHLLIVLLSDRTSLIAPEDEPNSRVLAMRRDIIHVLCFKPLSFNEITHKLPEKYQEQEDFHRVLDEMATFKPPEGVSDVGSFELRPEFIEEIDPYIAHYNKNQREESEMAYRKKMAKKTGKAVEEIVYEPKVRPIPSGLFQDLGGFTGTGMFAQIIYYSLLYPLVAQKFTPSIPYTRLDTFLQVVLHLTLLAIAEDKTEENAMADESSQSFVDIALTRMGRSNFMSEPNTPRTIGALLNFMHTKEEFKSVHPKIGLVLRRLKQKRPHSFESAFTHLGVSIDRIDTASPANTSAEEERERKKKAALSRQAKVMAQFQQQQKSFMENQATIDWGSDIDEDEENEEPVEDRKHSWKYPTGTCILCQEDADDRKLYGTFALLNNSRILRQTDFQDADLVREASQTPCSLDRSAEDIRPFGIAHENRKMVEKLNSAGESFLAERQTIGKGFPSNLSRSGPVASGCGHMMHYRCFDLYYEATNRRHTHQIARHHPEDTRKNEFVCPLCKALGNAFLPIVWKGLEQSYPGKLQTNIPFDYFMETQMGASSLLGHSKAKEIDEFNAPDLTTPSFPGSLMETIVRPQPSVPAEGLWAGLREDSDSRSSTVSTPATSTPQSSAFSSTNTPEPALASAVAPPQGMVSEIVLAYRRLCLTMRVNGLETRYPVPKAELGDGIVGSDTLVQMVSYSIAATEIQQRGLDAQPGSTLLDKIPEQLLTQLRILAETASSYTLTATLPHVGDSRVVKELQEDSARQHCQLFMSRYMGRETAYAAQPLEAYPPLLSSDPFVFLVECAYGLMPTQKVDISHLLRVCYLAEIVKVVYHMGRNMPTEKWLGTFLNRQTQDPAMHNFADFALAIAQYDAEARASKQDTDDKAKAHLGFQQPGVDTLESWYMFVKKYALVFLRKSVIFMYIKCGVDFQSHISSEPEAEELERLTEALKLPTFDEMCASLTHLAATCGWPGSTGEMIEGWVKHQVLRPTKVPADSQDVLPPSAMVSHPGIFELVGLPKNYDTLIEEATRRRCPTTGKDLTDPTICLFCGELFCSQGTCCSKLDRAHGRREPTRIGGCQQHMRKCQRNIGAFLNVRKCSVVYLFRMSGSFAPAPYIDKYGETDPQLRHGRQLFLNQKRYDSMIRSTVLNHGVPSLISRKLEAEINNGGWDTL

SEQ ID NO: 2820 - protein, 495 aa, Unknown
  Kingdom: Fungi, Phylum: Ascomycota
MKPFRALAIALFAGHAHGSTAAALRACEELSSSLLTRVQMQWSQEYNEEVLSYWSTALQEVRPACIVFPISAKDVATAIKILNKHENVRFAVKSGGHSPTPNHSSVENGVLITTSAMVGAKYDKERQLAYLKPGGKWNDVIPMLEKDGVTMLGGRIGIVGIGGLLTQGGISFLSSQHGLAADNIVEWEIVMADGSIRQIKAKEEPELARALRGSGNQFGIVTQFTTKVYPIGKVWGGTRLYSADKASQIFYAYHNTFKAGEDPKAALILSTFWTPFNTKFFIIFYFYDGPLPPKTGGFAQLLNIPYTTSNTGTKSYSDLLRENGKLPDALNERISFHTTTVPWIPDQPQIYEDIRNKFGSLVHSEINLRLISECSISFEPIPATVGKQSEKHGGNALGLTANDPDRMMLAIECAWSSPRDDELFVGLSQELTDWIEEKIPEWANGRSFYLPYLMNDAGKGQNATGTYRDFNKFKALQAELDPNGLFRTRAGGFTY

SEQ ID NO: 2821 - protein, 725 aa, Unknown
  Kingdom: Fungi, Phylum: Ascomycota
MHSKLVLTGLGGACLVRAAALENRGNSQSCDLRLTVSGSINDPVGQISDGQARVGYGISTATFTLSGGSLVDSMGRGCWWTPPTYTLQCDEGQNPSTGFEIGCDGAVSYNGQSTFYECFAGVEGEYNLYLGPNGFECGKVTIMADNCYANCPKTSAAPPPPPPAKTTVYVAPPAKSSMAPPPPPPPATKTGSPPSGSCPTNLSGDYEFPHLIIPIDSSNPSSAPSSSLFGEVSGTVSSIFNFDIPSSDSGKTCSLVFLFPEQADLETSSYTFSGSGGVEFWELSSPAVEGETSYNSCPAKSQSLGSVTLAPGNSMQRTVAPTVTSIQRASSTFPAPSSAVITVATSSSILLPKLKGFYGGPSLGQSDNNLLGFARKVQEQAKRYTTEDGKKVYALPPPVKVRSARDAPMRSFSQSASLSPSQSSSSSVQSYSKSTVLPVIKPPKKKKQKTQVALSMTPKSYIPQSKKYVVIPSSSQTVPSRRPSSTKVRTPKTPIFPTPSKISKASRYGNPVVIDLTIPQTPQLTRSSAPVVTPCPPSKSQVASCRSSSLQLQMQGRVLDTAQDQIKPRQLHSEAQGKSQEGFAEPPRTPPASAIARKTNSLVPWQASMALHLHQQGDLGPFEIGDFLCTFEPGTGKCLKEARKMPGSNTDEALWTDLRTGDPYQSPAFNQGDSEVYGNPIRGPFDSFAGFEHLHSPPGGHLSTADEVDGEQLRSLRLADDPMLF

SEQ ID NO: 2822 - protein, 2933 aa, Unknown
  Kingdom: Fungi, Phylum: Ascomycota
MATISTSTAANRATFGPDADFTNNTQNGMPELSKTESHPGMSAFLDLDSDSSISSNQASPIEHPTPLQPPPKKKVNFTGINDHNTAAAAAAAQRLSTTSARDFFTAKITDDTNGHDDGSAMAMASPSLEVPPSVGDTVRAMLDISTDNSTESLSSPPGLIMSTSPSGSERNSSSISDQSRDSPDIFSSGPSNKQIETSLDFDDGLIVASSPESETGPREVHELFAPGSPVHQELESLLRSVSQCDKACVVRPGRGPFEAQLVALITCSRQGQQHTSSKSTDDDGGSENISLPTVDDDVEACASQIKKVRTAMKEWGGEHSQPDIWIPLQSVPEGDEGADLTRLRDWLETADGKTEDLIMSMQLEEPKPRPLESLMAAKRKPLPDPSRLSMLLMDNTVDKEESHNPILEQTSNLAKFPLSAIQQLFFRASTNRTKVGKTTADQRFSQSILLQVSSDVDPTDIAASIEALVGRHSMLRARFKVSNDSLAQVILPDASNAYRFGHRHAVNDDDTVKFIEQSQASIDILGGPVFAADHIHAADGRELLYLVAHHLVVDVLSWKIIIHDLEELLRHGRLLSEGSLSFPDWINYQLYEISHRLAKPVLPFEIAPLDLKYWGLQKQHNTYGETGRYMFSLPATLTKSIQTRCNRVFRTETADIFLTALLLSFNQTFSDRPAPTIWKQEHGRDNHNREFNIAETVGWFTSLCPITAAVDQSTDFIQLLKLMKDTRRAIPRHGVTYFNSEFSSAHTELSSLPVEIMFNCVEAIPQLHRTSGLLEPVSPPGYEVKSLISDIGPAVGRIALFEVSVVMDADGAHIEAVFTETKHQPRVQEWLGKFEETLLDSAERLQAMDPQLTLADTPLIKTSYSKLSKLGSELLEELGVDSVEDIETVLPINPMQEDILIAQTQDINSYHVRSVYELNTPNGDMIDQSRICDAWSTLVCKHIALRSIFIDSISEDGLFDQIILKKISPNMLFFDGANLEETLASLPAMKVSRGQPRHRLSVIRSARRTLVCLDASQAIVDSRSIVNLVSQLGKIYAGEDITVDCSLLTTYLYNLSTDSASHLQTITREFKDTKPCILPRLGDGSQQPDESPVFELEMTRKKLNDFCRFQEIEPNVVLQLAWALVLRVYVGTNEVAFGCEHPGRDEDALPGVTNSIGSFSAVFPCKVSLTPGRTIRQCLKTLGLFSASVTGRQDLTTSRVEHALKLKGQPLYNTCLSFQYSSAIPESNSRGFSSSLWSSSSSMDSTFGLHAAFLGDKLHIGISSRDISELQISNTIRSFEQALKTVVECPLQQISEVDLFTDRDYAHLAVQGWEAHGEPFQPQQCLHQVILQHARTRPNAMAVAAEDGGMTYHQMSKFVSSLAVYLVNMGVRPGVIVPVILEKSWWAPIIILGVLQAGGAFVCLDSQDKDAFESTIKQLDPHIIISGEAGWTGLSSITANVVVVNNSFFSALPPQLSIPAQAPTPEHAACVLYSPSTKKGTPRSIYYTHASLSLAFMAQAKALKLDETSRVLQHSAFGNDIALAEVLGTMFHGGCVCIPAPHERGHNLEKAIVRMNVTWTYMTSVLVRKLHPRHVPTLRTICFRTRKLEDDIRETWLGRVNVLLAYGAPDVCPLGISVSEVTGEHKTAIIPPPLMGKYWILNPENPKKLMPVGAIGELAIDSPELTPHKFTPGGPLVARTGFTPDASDKPRPRSLRTGHRVRYLDDGSIEFLSSIRDELVIAGETVPTAEVEARLRKCLSKNIDVALEAVVTSDQKQVLVAFLELRDESQRSANDFEKVSLNSDKRASLVKKLMESPSSSSSKSEASQTQTQKIMKTHVPSVFIPVKSFPLSSSLKINRRKLQKTVTSMTYKQLLDMSTTPNLSGVGAGLLSEKPLPLTRVEKKMRGIWADVLEIPAEEITNQDTFPGLGGDRCQATQLVKICRETDHPISLKDVIKGMALSQICQPFFDLMPTPEENPKPSDSTIRPRNQSTSSRVPMASGKAHTKVAGLPEIFVKEVLAPQLKEYRHNIADAAEASPHQVRDLEGHLYKVKANLRWLVLNFNGPVRHQKLEAACMALSNLHPILRTAFAVHERRVYQVRIDSFRPEFTRRTCGLSDINGEVKRIVDYDQAVGYKLREPITRFYFLDAVHQGSLVVRLSTAQVDDHSISHLVQDLTALFKNPSAPLRRWSFFDYVRTVKFSNHQEGLDFWKEQLDGAWMTQVVSHSKPPAPTNRIKRLDKTLKIESLAEFGLSFDTVLKTAWGIMLATLSGNNDVLFGEAIHGQNISRPKNVGINSMIGPVTNIIPVRIRFPAVHTSPLEIMQAVQEQRASSRPYETIGGLELVQKCTDWSYWTRFSTVVEHRPQALVDGLTTLNMGNTTFRYHVLEPDALDIPDLRAQTTMDGPEKVHLELTYSESRVPKSLADNVLMLLATNIEMLTRRDPIKQPLLKPAGQMALSAPRIPVPQRKPVARASFDSSQWVDDERRVELQTLIQAAWTEHINPLALGIAEAQVHKTKFYEIWGSLLPATLFADHLNRELPKMGIKGSEQNIHFTAEEMIDNPTMQMQYDLIISKMRDSGAVTEPVKKKTTTNPASVTTANTEVGPWATASPSAVDGPLAWRKSIRKFRNLETRPSVRDLSTKASGWMRHKVSASHDGSTMLGRGMIPEETNEDASAERRSLDSTPRNTSRLSLLSIRREQSASPSPSSRKAMNSETPLNTAPSSLSLRALTSQFAPSRSGSIRSQKAPKRTSTIAEHPPAPKRSSTILEHPPASISSTSLLRSNSLKSKPKPKRSVSPAPKPKALPLIPSISTAPSPLKIPNNPFPRQPPPPLSSTTTSRTTTPTTHRTISPSSLLLTSIDTPLTNNRTLEPIAEPIELGSREITRERYEQLRVDPTDGLIIGPDGMIIAELDTPLSPGAGVNRREDADIEGEIRIALEDAQSIQRRAEVEG

SEQ ID NO: 2823 - protein, 84 aa, Unknown
  Kingdom: Fungi, Phylum: Ascomycota
MADTHTYEFNVTMSCGGCSGAIDRVLKKLDGVESYEVSLEDQKAKVITGLPYETVLEKIAKTGKKINSATADGVEKSVAVPAAA

SEQ ID NO: 2824 - protein, 554 aa, Unknown
  Kingdom: Fungi, Phylum: Ascomycota
MSPTLQLSEREHADLGYRLSCELPYDAQSVPQTSLELEGPTAGDPPRLAQACNCEERLAALEAELLDLRCVVRDLGQRATTRAPNTPPHARNETVPVPNTSQSSQGKRRSVIAATSTDPPVAPVRVIRKMYTWINGEPDSPQDSVQLPELIRAQLASNGLSQRLIATSRKAIPRLHFTQETIDMALVGEYNLLSVTCLLAGIQTNPSISTELHTSLYTALQSGLARLVLESPLKLPSLYAMLLTCVLNLTLGYSDNFIDAWLLSSSLIHHLMLSLDFAVPQPAPTLYAEDVKSCILTWNSACLQHLKFTIGIGKLSAVRIDLAAHYIGIVKDSDDFKDVDKEVAAELELFIFLYRGIIEEEISANQLQTAFSHWRAANAKSPGSDGSLALSFAISTFNLLAHRWELCQLQQENVERGTESVVYDQHIEPILRQSHRIIEVIRDLTKQQSVLHTFDILMGSYAHITLVEFSDYLEDIETTFRLMEEVQNLQKGSYVLEPVSSWAADMMKKRFIDAARPEVHLQAEALPSRDVWRPPFEALSSRMESTSGLMYDLE

SEQ ID NO: 2825 - protein, 436 aa, Unknown
  Kingdom: Fungi, Phylum: Ascomycota
MSATDTSTRAAPSASSLHGKVIILTGAASGIGLSTAKLLASRGAHLSLADNNSALLSTAVKDILASNPNIQCFGTVVDVRSRTQVEAWIAATVEKYGEIDGCGNIAGVIGKHQGEQAIWQVTDEEYDFIMDVNVRGLMNCMRAQIPRVKKGGSIVNASSICGLVGLPQCSVYCASKHAVIGMTRAAAKELGSQGTRVNCINPGFVETPMLTASIGSMDKSITPDGVAMQRLGKPEEVASLIEWLLSDGSTYITGTYPISALWLMRGDSLEDHLATSSNGNFIRFCIQSSTQDGHLTNLLVIVVVLLVASPIMTSTEPLIRISICIHRRQGVSEDEFHEYWAHEHGPLAAEWLKRCGIVKYVQYHTSSKHRELARKMSEAVGRPVLDWDGIADFYVHKYEDFEAAFLDSEYLERIRPDEVKLIDMDTSIFEDSIVHE

SEQ ID NO: 2826 - protein, 522 aa, Unknown
  Kingdom: Fungi, Phylum: Ascomycota
MSATQDNKTATLTGAEVVASAGQSISSAPTVDGKKPYTSKETEKAPSSPSSAASENQKPGKNRWFQWHEPGTSTAEKRLIFKLDWFLLSISCLLFFIKQLDANNISNAYVSGMADDLGFGPGNELSWMNTYFSIGVILGGCCSNLLLTVIRPRYWLPGMLFAWSLLVLGLCKCNHAYQFYILRFFIGFFESSAWPGVMYVLGCWYRKSELARRSGLFVMSGVLGQMFSGYLQSALYTGMHGKGGLAAWRWLFIFDFLLAVPVVIYGVTCYPDTPETTQAWYLNEWERKRACERIAEEGRTPVGKLDWTVIRRIFLSWQVYAFTAAYSFWTLTCGSYIIQYFTLYLRADGRYSVPEINNIPTSIGAVNFVFMLSTGYISDKIGRRGPVCLAVGLLLTMVYSMLTGWSIPHQARMAAFVLVGCYGCYTPLLAGWANEACAADQQKRAFILAFMVSVGQAVVIPFQQLQLPSGQAPEFKQTHGWPSALAFVIALTLWTGVGIPLMERFYGTKKRSTALGEQEIDA

SEQ ID NO: 2827 - protein, 256 aa, Unknown
  Kingdom: Fungi, Phylum: Ascomycota
MAYAILPALVPDIEKVYDVYFAAFKGDKMGNMMVDLLFPKGTDSEEFRKKHTADTLAWWNSCGVQYTYKCVDTTTGEIVGMALGDILFHERTEEERKFYSIPWLEGKQRQRADAVIKPLHEAREKLFGAHPHIYVHVIAIHPDHQGRQAGALWCKWGMDLSDSLGLPLYFEASPSTYKLYEKMGYEILEEKIVHSAHLMGTEFPVEVPLMVKMPRAAGGISFRDWRAAGYPAFSRSQRIDKATERVVVTGIHDVKV

SEQ ID NO: 2828 - protein, 841 aa, Unknown
  Kingdom: Fungi, Phylum: Ascomycota
MDSLGGNNLPFGSEIKPIYAGIAFAAIGGACLFPYLVRSIKQNDDKPSVLRSFVLFFYSCFLKPHQGDAKGNQQDALESFYKKQAGAYDATRKVLLRGREDMLSLVAAQLEAKAAVSTAKGKPKRVWVDIGGGTGFNIEAMAKYVNVPEFFSSVYLVDFSPSLCEVATKRFERLGWKNVTVVCEDARKFRLEDYENGPPGSQTPMRSPALSYFTQRRPEHGGADLVTMSYSLSMIPDYYSVIDSVTSLLDRNGIYGVVDFYVQNKVDFSFRNFTGGLVDRHVNFFSRAFWRSWFDIDRVALEPGRRDYLEYKYGTILNANCRNRGLGYIPYYIWVGCQKKPFSASSLPHEIIERIDALATESPYLMPAKAGDALSRAIERSAPEIRSKAFLTAVQNLSANLPLPSFFYQNHHWRIYYDDQLQKHKQFNDEYIYAFTWEDARVDERILKLGPEDKVIAISSAGDNIMAYLTHSPARVHAVDLNPTQNHLLELKAASYTALPYEDFWLIFGEGKHPNFREILQTKLSPHLSSRAFQYWMKNTHVFQNNNGYGLYDTGGSRHAIRVFRWIARIFGLQSAVNQLLEARTLIEQREIWRNKIRPALLSKLVCNLVVAQESFLWAALGVPKNQLAMIEGDHAESDIVKGPKPQAKNTRSHAIWHYMVNTLDPVAEQTHIGTDNPYYYVCMAGQFSPKCHPYYLSPQSHARLSQPGALDGLRIHTDELEEVIARIMPGTLTVAVVMDSMDWFDPGAQAAAAQIIKLNRALAMGGRVMLRSSALSPWYVNVFESHGFSPKRHGARIDGACIDRVNMYASCWICTKVENLPPPTPEMDRMGGNDMPALTI

SEQ ID NO: 2829 - protein, 470 aa, Unknown
  Kingdom: Fungi, Phylum: Ascomycota
MASNEKSNHDGIMPAPSRNSSSSNDATKVENAEDAFEVFKRGEGNVDFRTVPWWHASMIFLKLIFATGVLTIPSAMFVLGALPGAINVLGWQALNTYAAIIQGNFRNTHAGCHSIADMAEKVGGAWLREVVGILFLVTFAIVAASGIFGSSVALNALSNHAICTNWFMLVATIAVFLLASLRKFEKIAWLTWAGFISVYVAVFVVVVGVTTRDRPAAAPQTGDYEFGYHVIGHPSFVAGITSVATIFCSGAGTSAFLPVISEMRRPRDYNKAVYLCMGIVTASYLTFSLVVYRYCGQWVASPSLGSAGDTVKKVAYGIGLIGLLVSACLYVHVAAKYLFVRILRNSDHLQKNSIVHWGTWFGCSLAVSVVGFLLASGIPIFNYLLALAGSLTFAPLALGLPGYLWVFDHQHFRTGTILQRIAYWMHWLMILLAAFLTIGGTYGVIQQIITAYANGEIASAFACDDNSNSS

SEQ ID NO: 2830 - protein, 508 aa, Unknown
  Kingdom: Fungi, Phylum: Ascomycota
MDDVDGNRGWVVQKFGGTSVGKFPHKIARDIVKASLTRNRVVVVCSARSTGKKAEGTTSRLLAVYGKLRAVGAITSNEEEQNELIQEAKTLIQDICNDHVFAAEATVSDPKLKSALAEQIRAECHELIEYIHAARRFNLEINSRSKDRVISFGEKLSCLFMTSLLKDIGVDAEYVDFGDVLHYDAAAQLDATFYAKAVEAFVNKIESCEGRVPVVTGFFGNVPGSLIDGDIGRGYTDLCAALCAVGLKAEELQIWKEVDGIFTADPSKVPTARLLSSITPSEAAELTFYGSEVIHHLTMDQVIRAEPPIPIRIKNVKNPRGNGTIVIPDPVLSAAHQLQRSRRDSATLAQYKQPKRPTAVTIKDHISVINVHSNKRSISHGFFARVFRILDTHSISVDLISTSEVHVSLAIHAGSTQVEAFARTKQELEECGDVSVLSDMAILSLVGAQMKDMVGVAGKMFSTLGEHNVNIEMISQGASEINISCVIDARDATRAMNVLHTHLFTFLE

SEQ ID NO: 2831 - protein, 373 aa, Unknown
  Kingdom: Fungi, Phylum: Ascomycota
MAEKRDHPEEKKEESNASTGEKHETEHESPDAKRAKTEKQSTIEESMGKSATKDGDSNDTVKENKTNEDKTEKEGAKSEEEDASKSSNDSAEKTGEEENVPSNILEKGIIYFFMRGRVDIDTPSSVDEVQRTYVILRPIHNDAKLGDGPIGDNGNSRLLALPKKVFPQSGKDRFMMFVEKSGASFEELKKEFLDSNDYQTKTVGPRHTPAATPVGEGVYALTSTGRESHLAYILTLPEKLDQVQEDLGLKDKGSFILSTKNPEYPGPANAQLPEGPGFSKKIIDDFRKRRWMPSEAEHLDYPNAQILLVGESSGIENAVEPQEKDKKDPEEVLEHLEEEDLERMKHLGGDDSAAIFKDLEVKAKDYPKLQTTF

SEQ ID NO: 2832 - protein, 613 aa, Unknown
  Kingdom: Fungi, Phylum: Ascomycota
MYVDKSPGSTQLRAKAPPSRADAGPWFKDPEVKLNQWKKVDTSEPGTSTTRSEPLETISSNGIASKMTSRARLTRLLRAPARPTSAPRICCASVQRQAPKAPTRWIATSSPKLLSQSPSRNAKLTSETYPEMKRDERFAKVTPEHVQHFKTLLGDSAVLDGVNAEAEADLEVFNEDWMHKYRGSSRLVLKPGSTEEVSKILKYCNENLLAVVPQGGNTGLVGGSVPVFDEIVINMSRMSTIHSFDEVSGTLVVDAGVVLETADHYLAERGYIFPLDLGAKGSCHIGGNVATNAGGLRLLRYGSLHGTVLGIEAVLPDGTIMNDLGTLRKNNTGYDLKQLFIGGEGTIGIITKVSIQCPQRSSAVNVAFFGLESFEKVQQAFREAKGQLSEILSAFELMDARSQKLVQEVKGDKRPLDDEHPFYCLIETSGSNGEHDYAKLEAFLEDVMTKEVIQDGVLAQDATQAKALWGWREGIPECLGHWGGVYKYDVSIPINEMYDLVEDTRTRMNEAGLAGDTPEHPAVAVVGYGHMGDSNLHLNIPVRRYDPAVEKVLEPFVYEWIAKRHGSISAEHGLGLAKKNYIGYSRDETMISLMKQIKQLYDPNGIMNPYKYL

SEQ ID NO: 2833 - protein, 349 aa, Unknown
  Kingdom: Fungi, Phylum: Ascomycota
MPTATTAGMLSLNNLGALTTTFSAPSSCATAPGFVASGVANLILDSNMVLPVDGCDGRVDFPEDCLPHGDKISELWESVDAIEAATILNYYSPGLHCPGDWATVGVYTAGQDSKNTTATGAGDLGIFSPTAFHNGRPGESTSFPYADFHANMFTSALGSSETAVICCPTGFSIDPYGGCYSHFPTSELAGETACYRLATGTDLVSDIRRLVTYEFWGDSTTGIARSFDFPTATDRYSSVTVTFDDEGMPQTYLPLIGGPGGDDDDDLEFKGIAVVAPLYLVQGDEDSDDSSGNGGGDEDEDGNDEDEGSDEEGSNEDDDDNAAGHLSPTTGVLAAGFSFAAGLGLLIAW

SEQ ID NO: 2834 - protein, 347 aa, Unknown
  Kingdom: Fungi, Phylum: Ascomycota
MVQNKTFVYKKVPTDFPVAGEHIVVEDRPIDLEAPLAPGGLLLELQYASYDPYLRGKMRDPNTKSYAPAFQLNDPIVNTCLGKVLKSKNDEYAEGDLVLGFVGIAEYAVVPDPKARMVRKVQNPHNLDLGHFLGALGMPGLTGWSGFHRIGQPKAGETLFVSSAAGAVGQVVGQIAKREGLRVIGSVGSDEKLEFITKELGFDAGFNYKKESPKEALPRLAPDGIDIYFENVGGEHLEAALNAMKVYGRIPVCGMIAEYNVPADKRKGVQGIQQVLTKQLKMEGFLVGMPEFGRAYFQEHQEKMQAWLKDGSVKANLDVTEGIDNAAQGFIGLLQGDNFGKAVLKIR

SEQ ID NO: 2835 - protein, 278 aa, Unknown
  Kingdom: Fungi, Phylum: Ascomycota
MLFHKSFFVLAMSLAPGVFASQEQRNYKRGLQPRAAVVTVTSILPTKSIVSPPDAECTVTYTTVLPSLGTNPSGVPTGVADYTYTMEYGCKGSSGSPCAIPSDPEQLPPGFTVTTKICATCADDPVTYTLTVPNIAAATEDPSSGPGSGNSHGSGESGHGSSGGGSSPLGGAGTPEAPASKSTKVPGNAPGNAPADESTDDISEGPASESEQPKGGDGDNSSSNENQGGNVVGTGSDADEESGSTETVGVSAASSTKFALGRAWEMLFMTALFMGMNM

SEQ ID NO: 2836 - protein, 825 aa, Unknown
  Kingdom: Fungi, Phylum: Ascomycota
MAPTCADPRQVVIALDPDQRKALWQLVKTACTQIKTSVQPTSDQKYGSVAPKDKLQEEKDKNARDGKDGNAKQAPRPQPQKTDDDEDEEDEEQIKEGMRICRAAVKHIEEWANEFLPRLKEILQVRDDQKIIAERKKRQEELRKRAVDTAEDGEDLMNFDGNIKISKSEDIHKLQELYKPFPTDLLKLPVADRKEAVGCILLLLLFTGKYSAHSRALALYLASSLELPMTFINNEEAEIAKSLIESGTADKDKKESMSAEAEAAKRKEENKVSRFWKVGLASVAGAAVIGVTGGLAAPLVAGALGGIMGGVGLGGVASFLGVFWMNGALVGTLFGAFGAKMTGEMMDQYAKEVEDFRFIPLQPSPGESESSPQDGSSSQDKPPPEQDRRLRVTVGINGWLNSEDDVTKPWLVLPHDTEVFALRYELAALLALGSAMGDLVSSLAWKTLKSEIIKRTVLASLWAALWPIKLVATASNVDNPFSRASNRSRKAGQLLADALINRVQGERPVVLVGYSLGAAAIHACLQSLAERRAFGLIDTVVLIGCPAPSTSSHWRTLRSVVSGRVFNVYSENDMMLGFVYRMHSLALGVAGLQPIKDVEGVVNIDLSDRVSGHLRYPELTGEILSHCGFIGVRAKGDIEKDDVIRMKEEHAGDQLIDFDEKTDARRPQNERTDTGASKHSDDLRELTISPPALASPGSAPPRDDDADETPPTLPRRPTQQNDDENEQRPALPMRPSQQKASESTAEEKQEEKPPSLPMRPSASREDASRRKPVEYKEELRRRPLTPETNASDDEEYRAISMVDNDSDDDSEDEPHGNNPKARFGH

SEQ ID NO: 2837 - protein, 338 aa, Unknown
  Kingdom: Fungi, Phylum: Ascomycota
MRATKGASLWLPSNNASPAERRTLLYFICGNPGLIEYYREFLTHLRHLLDTAHPSSTTYDIYGCNLPGFSDSDHEKPFSTKNPPWDLQGVVGKMYEDVKTRGKAYGEVTLMGHSVGTFIAVEMFHRYLQEGADGLRLRHGFLLFPTVTHLALSPAGKRFTFLMRWIPLLEKYAHIPARVILSLVPHMLLEAYISKVLGFTTSAAKTTAGWLKSRDGVYQTLHLASDEMKVIAGEERWGSEIWEVEDTPLTESGEGKGKAGLPRFFMFYGKKDHWVADDLRAEFVERMGRLRGEGRRVPRIEVDEKGMRHDFCTKEDSSFEVAEKVSGWVAEIEKAKTR

SEQ ID NO: 2838 - protein, 662 aa, Unknown
  Kingdom: Fungi, Phylum: Ascomycota
MPRQCDEQRPQCKSCQKLGHACNYGGQPLQFKSVFPASSSETSSSVSLAANGPLRSEPVSGNLDNATSGQPGASILDFSAAGLDELPPQSHSDNLASHISPPNQVSQFSDDLTLSSASLQAAAARINSDNSLYDIDDLLFSPFKHSTAQLDEPAEHNISDRIGRPVSPTSTSVLQNRSMPTSESVDTSSQQLIYQNSWKTLCAPALPPILKYVADLTSLPDVVSWSALALAASRLSRVQPQREVDSSNKLILRPSRTHWMASQQLYCSAIHEIASWKPTEKQQDVGTMIQAMLLLCCLESTTGNFDVFQLHSAGIQTLIMNGIEAILAVDRLGGIRLLQAWAQTKMHSWWRRCHFSTVRFLSHDVSFRIEPRLSVYLTPQDTRRTYILAILCESYHLSVSSYVHRLDEDDLLDVDLDRQTSSNHVNMRPSEALARTLDELDTQSQLLDAWAAHRANADFPVDAPGGANETVKFSSSSLDIKPFVFESHLAAMNYAYYTTARIIQAASDVKSLPYSTLQIDSSTSDETEYWSLLLLRITAGIQWKTCLEQNPFSIGLTGLLLVCSLRCSNPEISKWIQSWVELHCKDETAEEGCFPVWQIWQCLCLVNEERSKGYDVVVVFQPSEDEVRQGKHDSYQNQSLASVRILRRSRVGGNYELTRRDM

SEQ ID NO: 2839 - protein, 1451 aa, Unknown
  Kingdom: Fungi, Phylum: Ascomycota
MVFDNAFGPRLPGAFDFTILFEQSILSLLPTVIFIILAPWRILHICRRDSVVRTGLLLWSKLTSIAVFLSLQIALLALWSLDSTPRTRTSIPETVIGVIEGLVIAALSYTEHLKSDRPSPLLSTYLFLTIILDIALARTFFIRDGLQTIAIIFTTTVAVKCILLVLEETPKRRWTINEKEPVRETSVGVVNRSLFLWLNPLFWRGTKSILTIDHLGPLHGKLASKPLLDQLEATWDSDSKEGGFALMRVTLKSYRFQLIAGVLPRLLNSAFNFAQPFLIETVITTVGQPPEEHRGKTISGLIGATLLLYVGMAVSSVWYNHMTVQLATMYRGGLAGLVFKKTLRLDGDKTGEAAPVTLMSTDVEGVAQAIMSIHDIWASFVELPVGMFLLYRQVGVPSLFVLIPAFATSIGGAFIAADMGPARIKWSEAIQARIGATSSSLTQMKGVKMMGLSGFVQASIQELRSFELNMSTKYRWILTRMSILVAGLTDDFTPIIILVSAIYWTKADSGLTVATAFTSLALIGIVSGPVMLIIVSMMQLATALGCFTRLQTFLLQPERVEHRDLINTSAKSSLIAPMTAQTAGTGDDVELMNMSTTERRPASEGTNENQKAVSLRQASFTAGEDTHILHDLNLEVRRGSLNMFIGRVGCGKSSLLKAIIGELRLASGSITVNFHSMAYCDQIPWLQNISIRDNIFGLTPPDDAWLQTVLHACALDEDMSQLALGDRSIVGTGGVALSGGQKQRVALARAVFARKRLVLLDDVFSGLDSKTARAVFNRLLGPEGLLRKSGTTVILVTHNINFLPAADYITVLDEGRVQHNQVPYAALDPTVFRVLETEYRTTKDTKSSGDTSEDEDTKPASFEAASTPVVTDIPTEADLARRTGDIDCYKIYLRALGWKLILLFFGGLVAYTVMNKMPQIWLRLWTERQDDLRNGAFVGGYAAFAFASSFFAAAATIVIVIEGVPRAGQVLHTRLLTAVIRAPLRFFTTVDSGITLNRFSQDITLIDEGLPMTFFATCSLAMRMLAETGLIASGATYVAAIIPGCVAVLYFVQKYYLQTSRQMRLLDIETKSPLYTQFTETLAGLTTIRAFGWSSQLLQENHRRLDDSQKPYYGMHCIQRWLQVVLDLFVAGMAIVLVSFALSMTNTTSTAAIGLALVNLIGFNRTLTLLIDQWTQLETSLGAIARLKWFYNNTPDENKPEEKEEPPAAWPATGGVELRNVSASYSDELPLVLKDLNLSIKPGQKVGVCGRSGSGKSSLVLTLLRLLELREGQITIDGVDISTLSRATVRTKLTTLPQDPLTVPGTIRQNLDPASLIQSDSPLITALTKVSLWETISSRGGLDAILLDLGLSSGQLQLLCLARAMLSRGSVVILDEATSNVDHRTEEEIRRVIKEEMSERTVIEVAHRLDVIRGCDVVVVMSEGRIEEVGEPEELLSSDSAFKVLWNSQGL

SEQ ID NO: 2840 - protein, 426 aa, Unknown
  Kingdom: Fungi, Phylum: Ascomycota
MVTFNVLGLNCGTSIDAIDVAHCVISTTPSSGDVKIELRSFTEVPVTASLRSQVLRLCRPNQKEASTCMAEVCDLNFALGREFSRAILESDVDLDSIDLVASHGQTLWHQPLGAERSTLQMAEAAVISQATKKTVVSGFRVAELAAGRQGAPLSGFFENALLSDDKLTRISQNIGGIGNASVLPATSISDQMSQQGAGYLAFDTGPGNVFIDAAMRILSIGEKHYDHDGVMGAKGEPEINDKFVLEYLQSEPYFQAKPPKTTGRELFSDDVARRLVTSLQAEKLSPEGIIATITRITAESIAQAYENYVLPGLGGAGIDEVYICGGGAYNPNILRHLRSRFPGVKIARFDESPAHIDPSAKEAVLFALLGFLCVLGRRVPLPADAESLDPAVLGVITPGNNYVEVMRKALSDMDVGDQVVLGRVIM

SEQ ID NO: 2841 - protein, 874 aa, Unknown
  Kingdom: Fungi, Phylum: Ascomycota
MSASLAPECNEVKERYDTCFLKWYSEKYLRGAEKDTKECAPLFDEYRKCLGVALKSRGIDKLLDEAREDNKENDARLTTPKRSAEALMHPFSVLTLGIFVAGYITARWDLVTRLYELAIFAWENGVVTRAAKGFVALSGLFLTVFVPVVLLARKETYLLVMVEHDGLMRVFWPTDVPKSDSPGVVVGWRNSVLDVFVVAILDHVDPRDVEYHLKAGTFFRSAPHPPARIYELCGHSGMHVLGVANSPDPSSADPSWVRAVTQPRLRSPKISCAKASSVQLIMYDRPRPKGMQYISLNPIALALGDKGSTLEDTKVDGDEDEEERYERKMRAERTKLVEKLKQHTVVKRIPSARDKALPKIVNQVNWSWELDQTLQKHVGRLGPRPKRSLSVSERMVESATTMRNVVASQALDIFTVYLFPIIRRAFIILLMGHRMLAEMLLVFLEFRAKPGYAALKDISATAQQIEIRLQQFCYWPMQYLTLRQRKRNWASVTTSHPDYIRFYNSLWLVANDVIIGIAVGSYIIEHADWVALQISTLLRTYTVEALQRSISWLMGWPAGLKLNGELAAFLGDLFLWVIEYWSNCIDTFNPALPRVVWFIGFSSFAGASMPIAMFSDLLSALTIHIYSFYLASARIYHWQLTIIQSLFHLFRGKKHNVLRNRIDSCDYDLDQLLVGTILFTLLFFLLPTVMVFYLNFAIARMVIISAKAGFDTLLSCLNHFPLFALMLRFKDPSRLPGGIRFELKDTLDRSSPSSGISDDLPTSTIYLKSIPLNFRAMFHQYFQMAHRIRKHYLAPRVALCLVSGQFVPPINRKNLYSLQYSMLPARRATVWEMWVALTAEDTDQTKGKNPAFQMPYIPPLANGGPRRYGNGRVR

SEQ ID NO: 2842 - protein, 212 aa, Unknown
  Kingdom: Fungi, Phylum: Ascomycota
MSVIAKKESTNRDMKLDPKFLVVSIGNPLPKYESLHSAGHFALNGLAKVLRHPPFRETSIGGQQYCVSQGPKYTLVQSPTLMNVSGSFVSRVWKQMHKQHDAASLSLVVVHDELEKGLGVVNLVSWERSPRGHNGMKSVKNSISQKAYPVSPLARIAIGIGRPAERDPESVARYVLAQIPSASRNILENEATFGVVKRLAELEDEWRKEVEP

SEQ ID NO: 2843 - protein, 293 aa, Unknown
  Kingdom: Fungi, Phylum: Ascomycota
MAQSRQVQTTWPSPLKGYENEPPLLNEKNEDGKSYVNAPREGLSESYSSFEAPIDNGIRGGFDVHIYYFQSNEEQVKYAHELWERIRREFPELRIYKLWDGPIGPHPVAQFEVNLLTPAQFGAFVPWLTVWRGPLSVLVHRNSLPVEGETTAERVNDSNKMGSVTELPDSHDHKATNRKLTPIKDEDNEPCLREYPTVSPVRDPDVPIPSIEKDDDDDDDDDESPIADVKKEASSPYSEISTNPNSRAATPKPVDHEGDIFMPDASPLPPPLGTASNPALTTTPDKDTHMRDN

SEQ ID NO: 2844 - protein, 262 aa, Unknown
  Kingdom: Fungi, Phylum: Ascomycota
MATSSPQPLPAASGSHPNTTSENPESYEAANVHSIYSTIAPHFSATRHKPWPNIARFLRSLPPGSVGLDVGCGNGKYLPVNRDLHILASDRSPELLTLAKEPPVPIPEAGKEEEREAGKFTPAQLAVADTLNLPYRASAVDFIICIAVIHHLSTRERRIAAIAEMLRCLRPSPSGQCLIYAWALEQSATSRRAWNKDSKQDTLVPWVLRQKGVPQSEQTTYQRYYHLFREGELEEDVVSAGGKIVEKGYDQDNWWVICSKAD

SEQ ID NO: 2845 - protein, 841 aa, Unknown
  Kingdom: Fungi, Phylum: Ascomycota
  misc_feature (561)..(561): Xaa can be any naturally occurring amino acid
MEARSLSSLNFLAANPPQYPVKPNEEKADSLCLYILRVPGTRDIFLSPFKPQVKSVTAEDIASSLYYVHFRDPAEEEHDSPTADQTPDRSSVQPPSIARKPLPPTARPRTSYSPPKEPQAPAVSVFRQNETPNPLQGPLSSHPTRLPPSEQAMNPSQSLGPDRASIPARKPLGPRAMDNGPSTRLEPPQTSTGAPDNANFPLTRPRTQSASAPRFSTDHANMPLPRSEPSVKSGAFSLDLIRRDRSSGGQWNVGRISCQGTEVRGFDGGSDMRRSPSPSKQAPRPAIDLSIENSGYAKFRNIPLPSVVEAGPAAIISALAERDSGRSSGQSSNMSLPLQGDGLHAGTDQYNGTYFSRQVTMGYTKSWTTNVKEKLQKLETEARARTGHRRGDSTNSWDSAEQKDLAAEPNAGMTPRGYLFSSPWNGRCEFRTGNGGRTLRLTHVLDNGGSNDSQSCDAAMVSELRFNLPTSEVLPGATQPRDSRLLENFGKALRSRARSDPYRYRNEFDDEERPSQLDLSLGKERAGGGRRGNRAKMGKLIITNEGLKMLDLVVAANIGVXCNHHQKAVDHIKAPPIRPPPTCNRAPASLTNPLTLDIRASRTSSSTNRFPMAPALQASAIAMLARRQLLTSGASRATLLAAMNNTTTKAVSQRGYATPMGPPPQGFRTSKPIEWAGDKDSTLDRLGKYFLMTEMARGMYVLLEQFFRPAYTIYYPFEKGPISPRFRGEHALRRYPSGEERCIACKLCEAICPAQAITIEAEERADGSRRTTRYDIDMTKCIYCGFCQESCPVDAIVESPNAEYATETREELLYNKEKLLSNGDKWEPELAAVIRADSPYR

SEQ ID NO: 2846 - protein, 292 aa, Unknown
  Kingdom: Fungi, Phylum: Ascomycota
MGKTPVAVYAAPRRSYVIIVGCAVFAVLSVPHVLQATWLQILLTHIALYAFILNGVLVFVALRHLQLIANRRIFEWPQIGDRASQPANYFLFVMGSGGHTREMLMMMDDGTCDFAGFHRRYLISSGDTMSLDHVQEHEREIRELCSQKGLDPGTYDTRIVTRARRVHQPLWTTPFTGILSIIDIFPALLIPPEQGSSSWPQRIYSNGPATGFFVAVVAHFLRMFFLAPEESMRFLYIESWARTSTLSLTGKLLHYTGLADVFVVQHKEVGERYGIKCVGQIVFNSRRTETSL

SEQ ID NO: 2847 - protein, 464 aa, Unknown
  Kingdom: Fungi, Phylum: Ascomycota
MDKTDGVHHQDDVATKSAEPSLEGGQESIDAEAEKKLVRKIDLLILPCMWIMYLLSYMDRTNIGNARIAGMDVDLDLDSSRYSIVLVVFFVSYVVFEVPSNMILTRVRPSLYLPGIMICWGCVTIGMGFTPNYKSLIAFRFIMGMFEAGFAPGILMLLSSWYKKEEQSKRFAVYISAAILSGAFGGLLAGSITSGLDGAHGVAGWRWLFLVEGAATVGFGFIAMWWLPDFPATTSRKKFTDAEKDLAIRRLQAGSQSVRTEGEARMSPMQALKGSLTNWRTWILVVGYMAIVGSSTLSYFYPTLNLGLGYKGTSAQYMTIPIFAVAFVSTALTGIFADKHPKWRGVILGGWMTVAMVCAIIICGVYNFKARYALLVIMASGLWASNGLALSYASVTFSAMPDEIRAVSLAFVNAMGNLAQIYGAYLFPTEDGPKYLMGFGVISGMCFTGVVSYLSLYFLLKRKA

SEQ ID NO: 2848 - protein, 183 aa, Unknown
  Kingdom: Fungi, Phylum: Ascomycota
MADKNSGGRRRRSSSILQVYHEPPETLEQINDQASLPNLNANWTNAKGAWTIHIVLIACLKLFFDVIPGVSQETSWTLTNMTYMFGSYLMFHYVRGVPFEFNGGAFDNLNMWEQIDDGAQYTPTKKFLLSVPIVLFLLSTHYTHYDGTYFVINFLAVLAVIIPKLPFSHRMRFGLFNGPPDDE

SEQ ID NO: 2849 - protein, 303 aa, Unknown
  Kingdom: Fungi, Phylum: Ascomycota
MPQRLVAEPTEDTWPAPSPLNGFDPHFDLDQEFEDDLEAVDYHCSDESRPESPGPDQPPRLPSPSNESSLSQQSQDPRELPVIEDETMAVASQLETIAPVDRHALAQRLARIARQLATTPEEDLPLDQLALTEQVNQLELTLLGISLPKDGDGPETTSPQAPTHNDTTLAIRTRPSAKSQRDAPSYEAVTETAAQLSQDLETLHGNLRARHEEATHIHVLLLSRLELAAQRILFLQRRAEDLESQLRESDDELGHLRVLLKALEIQVPEHPDEDMRRCLVRVRQEFWAVRKRREALHRKNTED

SEQ ID NO: 2850 - protein, 681 aa, Unknown
  Kingdom: Fungi, Phylum: Ascomycota
MSPPHPLLPLTVDETNLARDIVREANPRAVLKFRVIYLEEPSKALLAPFLDLEQAGQVLSTTPRPPRQARVHFDTARAGQPALSQEAIIDLVTKKIHTIETIRADAQASFTLEELDDVRVICRDSPVFKERVSKFNLPQDFEVIVEPWPYGGLDAADDPSRRHMQALIYATDSTKPDCNFWAYPLPIIPVIDAVTREVIRIHEVSTGGGNDPLAVPEGELVNVSIDHMSPADYVPELIPGGLRKDLKELNVVQPTGPSFSIEDSNVINWQKWSMRVTFNPREGAVLHNVRFDGRNVLYRLSISDMTVPYADPRAPFHRKQAFDFGDGTLGDACNNLQLGCDCLGVIKYFDGVLVDHSGTARKTENVICLHEQDNGINWKHTNWRNGRAVVTRRRELVVQFIITLANYEYIFNYIFDQAGAVTVQARATGIVSTVNIDDGKTAPWGNVVSPGVLAQNHQHIFCVRIDPAIDGHENTVVQTESLPMRMDSRSNPNGNAYQVVTTPITTSGGFHASPMTDRVFKVQNLDKLNPISGQPIGYKILPPVTQLLLADPNSTQAKRAKFAQRHLWVTRHKDNEFYAGGRYTLQSASEIEGVSDAAERNDDVLQKDVVVWSVFGLTHNPRVEDWPVMPVEILDLHIKPADFFTGNPAQDVPGRKNFTSQLAAAAPADGKDSCCTSKPRL

SEQ ID NO: 2851 - protein, 638 aa, Unknown
  Kingdom: Fungi, Phylum: Ascomycota
MVFPGLLTSADRASSSRSKSSAEIDFQSDFISDEAQLPCVPPERPDLRELNNSLDALAAVFPDIRIEVFRELLSHFDGESRLALVADALLKNHVGWVQGRWKSLDAHGPDVPRGDAFRSKEYKEAVSTLAWREFKGLQRSTINAVLAETNYYYLEARSTLVGLSAQSWRFNLSSLLLRRKPVATGEAENHPLVIWRSTGRGSIVPTIRTTGHAELDRELFDALVRPLKERERQEREAKDRVLAVVLNNEEAEAADATHECTCCFTTGPFEEFTHCNREGHMVCFRCVQQSLKEALFGQAWQSSINHEVGALRCIAVEGDSCIGYIPYEHIRRAMMEEGHGPGILHKLDQRLAEHTVVASGLPLIRCPFCSYAEIDDIYTPPRQAPLRVKADSIYQLCFILICVGTIPFFFSTVMVSSLICLLLSTRQTFGDYMRAQWRQALSRHHRRRRGLRFSCQNPDCLRSSCLSCHKSWSDIHVCNESSLVALRTQVEQAMSMAVKRVCPKCNMSFVKNAGCNKLTCPCGYKMCYVCRADLTEEGYRHYCDHFRPDGDPRPCTECDRCNLWESEDTEEVLRLARIDAEKKWRDAEQRDLSAGERAFLQTGFATQGADYSIERLVVRGRIPSLEEVLDVVVETIFV

SEQ ID NO: 2852 - protein, 443 aa, Unknown
  Kingdom: Fungi, Phylum: Ascomycota
MRLSGFQAAAAALFAAGAVDAQVLINELSFGHSGRMNPSGGSNIPNFVVSGDPQQPQVLSNKLVLTPIAPGNQRGSLWSDSLLTQVLWTADVEFRATGPERGGGNLNIWLARNGDREVGSSSIYTARKFDGLALVIDTHGGSGGMIRGFLNDGNIDYSQHHSVDELAFGHCLYSYRNLGRPTQIKMRQTRDNFRVEVDNKLCFETDSFSLPPGNKFGITAATPEDNPDSFEIFKLTVLSEGSGSYTGGSNTDNSNSNNNDNYDSARADAGRAKQRAEPVADKELFEDPIPDEDADVFSTSKTQFRDLHNRMQATNHQISALFRTISKFQNAEAKNHESLVDLVNSLNDRLASLDKLGDLSQRVTDIEKEMRSMRNDLGRKIQANERNFKGMLGDHHATLSQTLIDSMPGHKRLFAVVVGTQVLVAVAYVLYKRRKANMPKKYL

SEQ ID NO: 2853 - protein, 609 aa, Unknown
  Kingdom: Fungi, Phylum: Ascomycota
MTFAQHGSTAYERVFAHLDVEKMLTVPFNGLDRCRFEHPARNQPQTNRFGALGGGNGSARGNSAQLDKYKLDFDNIEKDLTSEVPQWILSAYAPGRDTPQQLFGGYPREQSFEEMRLHFLEGKAAGNEQAALNQAQEIYQDAQKQMQNAVRNLNDAVNFIVSAENEHPNRHDVCREGTQGAPFGEFLVEKRRGGFGSNSPAAANPFSSNSTPAAPSAFGGGAAQTSAFGQPSTMGAKPNPFASSSSSSTFGQPAQASGGGAFGQPAQTQGSAFGQPSSMGAKPNPFGTPAFGQAASATPGGVFGQPSQPQGSAFGQPSQPQGSAFGQPSQMGAKPNPFASNTSTPNANPFSTGSAPASAPAAANTFGSQTQPKPNPFAASSNTTPASNPFAQASPAQGNAFGQPSQMGAKPNPFATPSQSTPAAANPFASGTTQNNAFAQAAQSGGDTMQDAAPSINTNVNSPFASAAQSSGNAFGQPSAAANPFAVGSTPNTATPVSAVQGAGPYPPDSSKKHPDGYMTRDGFGNLSAFKGQRVIQKDGKPGMNIGGKFVKIWFPDGPPVYNKDTAPPVEAYDQKTLEMWKAFEATGEFKDKVIPDLPPPREATTWDF

SEQ ID NO: 2854 - protein, 487 aa, Unknown
  Kingdom: Fungi, Phylum: Ascomycota
MGVSGILSRPALIAASSKPVPSTLVSSHRHASTLTPSSSSSQKTKKEKVVVLGSGWAGYAAARSLDKSKFTRSIISPRSHFVFTPLLASTAVGTLEFRAAIEPVRRLQLDEFHQAWASSIDLKRKTIRLEANLNPDAGGRTDVPLTKGPEFEVEYDKLVLAVGCYSQTFGIEGVKEHACFLRDVGDARKIRLNILQAFERAALPTTTDEERRKLLHFAVVGGGPTGIEFAAELHDLVHEDIQKLYPGMGEFVSITIYDIAPKVLPMFDQNLASYATDMFSRQGIKVRTEHHIQRIRRDGDILLLDIKEEEKEVGAGIVVWSTGLMQNPLISGLTETPIEGIGKLVKDSKTGSLVTDGHMRLQVKDSSGATNVLPDVYAIGDCAKIGGTSLPATAQVASQQASYLAKRLNKGDIADGPDFKFRNLGSMAYLGSWRAIHQSSADELKGWPAWILWRTAYLTKSMSIRNKILIPVYWFITWVFGRDISRF

SEQ ID NO: 2855 - protein, 94 aa, Unknown
  Kingdom: Fungi, Phylum: Ascomycota
MTASKRVFFTAHGGQVQGVGFRYFTQKKAKEYGVTGWCRNTPDNKVEGEAQGDDDAISKFLKAVDDGPAQAKVVQLTKEERDVVDGESSFDIKH

SEQ ID NO: 2856 - protein, 574 aa, Unknown
  Kingdom: Fungi, Phylum: Ascomycota
MRPISKFPFALYVSVVLGQLLSSDTSTDISTDISTDTSTVIPTDPLTEPSIGTSTTTDELVDGDSSTVSSSFSTTDPEDLIVSETSSDSPSISTETPTVTTDDLSTPSPTDSLQAASTIPGDLYLADADAEPDIKAKEPSPDEVVDLAAYEVDTYAQRLAAGQQSVPEVPDPEAQVVLPVCPDVSASTKILEKRQNSLPVFGCSPERLSVRVHFVHVAPGFYLSDKPLEDVKQRAITNFAFLRDVMARLGIDLFFGSYTSDINPAFSDNQFGDSQANIRYRTKTRKGDSDSLTVWIVDNITDPADPTNGNPAGYSSFPNDGGSGPTAYDGLVVQQVALSPLNQKSLADAVYTIEAKKQCTLTGEKDLLKIQGSTLIHEFGHWMGLIHTHEGGCSGTGDRVADTNQVADSTTRSCCYQATCNKVASFRVKNWMSRRQCSAPKKRDTGSLPTSPGQAAALRKRDEQGAIVMADLLLNNCSVAIQDVFEPDSIPLDQKVLESYSSQASSLQANPTSLPPGVERPPTLTGATAQPTETGEGDSTGEEDDDSGAMAGVSFSNRGSMMYCIAWMAWLLFG

SEQ ID NO: 2857 - protein, 532 aa, Unknown
  Kingdom: Fungi, Phylum: Ascomycota
MGQNDIEARPASLANEARDLKEPIEVGRENLHSALPPHETYEGNHRFDPEASWSVEEEKKVIRTTDIRLMTWLCIMFFGLQLGRGNLSNTLADSILDDLGLTTDHYNNGVTIQLLAFMTAEFPVQFITKRYGFQRVLPTLMVCWGFVSCFQAFMSNMWSFYLTRALIGLFEGGFIPGAILMATYFYTTKELSIRLAAFWCTLNVARVISALLAAGLLEMRGIGGHPGWFWLFLLEGTLTIILGLISYIWLPSSPVGTKTLLWQKPWYTPREETIMVNRILRDDPAKGLTALKEPATFADIKEAWSDKSMWGLYFVGLVAYIPATPVQAYLTLTLKRVGEFKTLQSNLLTAPSAALQILTMFALAYSSEYFNEKSFHCLFGVFWSLPMLTAMVTLPDGGREWGRFTLVTLIAGYPYFHPIVSSWISQNSFSVKKRAITAATYNVIVQIGSLIGSQIYRSWDAPYFKNGNKVCLAILSLSLVVFITQRQYLVHLNKKKSKVWDRMTAEEKLAYQNDKEAREKDGNKRLDFRYSH

SEQ ID NO: 2858 - protein, 622 aa, Unknown
  Kingdom: Fungi, Phylum: Ascomycota
MPPINWMLAVGEAHSVTSLRIRASLHLCRSAEAKRSRQAATILHTGEPMRTVSNRLLPVVFLRVVSALIQWIWQLIVAVEYLQRIVPALGAIPSARNTAVRRQRRHRIPANTTAVSLLRLTHFTATDMKPGLLPTLALASSLPAIDAISLHKRQDGPAKVMHFDVARRSVQDPISHDRRRLRRRGDTLNLGLNNDQTLYFLTASLGTPGQEVQLYIDTGSSDLWVNNPSSRLCTSRGNPCSDTGSYDPDKSSTVKLVSQDFNISYADGSGASGDYVTDTLRLKGQTVDDMQFGIGLDSSTPTNILGIGYESNEAQSANEGEGTYKNLPAMLVSNNVISSNAYSLWLNDLSASTGSLLFGGVDKDKYEGDLVTMPVQQIASGFYEFFVTLTGVQLGSDDLGKNMALAVLLDSGSTLTYLPDDIVSDIYNKIDVAYDRSSGTGYVPCDVANQDTNMKLSFSSPSSITIPMNELVIDLGENNMEFSDGTSACLFGIAPAQGSTSVLGDTFLRSAYVVYDLDNNEISMAQTKYNVSTSNIVEIGDGKNSVPSAADAKNDVPAESGLPDQQEQGRAGDIDSSGGLSLPTGSLDGGDDDDAAGSLSPPVYMATMMASLSLIVFGGLMV

SEQ ID NO: 2859 - protein, 526 aa, Unknown
  Kingdom: Fungi, Phylum: Ascomycota
MATQTETVLASRESTDHHAATIPLEVLETTLTVRSRMSQHYAPTYAPLQKLAVVLQLSGVNLCSSAINGLVVVGLPIITADLALPESLAFWPTSATSLGTAATLLLAGSIADAFGARTVDLVGCFITSVFMIGAAASKTGNQLVAMRAIQGVGVALHFSSSVALVTQAFPKGRGRNLAFACLGLSQPLGFSFGLVIGGVLIDAAGWRPAWYLYSGICICLFFVGLWALPHSPDRLSFRDRLVMCRTKIDWVGALLASAFMAILCYLLAVLSANTARIKQGDTIALLCISVLLVPCFVYWMHRQNKLERPTLIPNSLWRNPAFSSICGITALSFSAVNAMELFCNLFFQEVQQLSALQSSIRIVPSLIVGVILGFGCGLLVDRFRAMWLIGISSAITALSPLLMALISPSWSYWKGAFEAQLLCPIAANILFTVGLSIISEVFPEDTQALAGAVFNTSSQFGTALGLAVLQMISSSVTKMNSQEEERGALLEGYRASFWALFGFMISCVVISLAGLRHAGRVGVKQE

SEQ ID NO: 2860 - protein, 466 aa, Unknown
  Kingdom: Fungi, Phylum: Ascomycota
MSAVPGPVYGLEVPPGEILIPAGMEIPASFRITMAAVDPTQEPEADEDGNVPSVPRSTLRLIKRAFPELDEDDEDDEIDEEYMKALMGESDSEDDEEEEANGGPSDPAKTKKSKQEAALKKLLEAAAAEEEESDDEDMEDAKPNGVKKGKGKAALDDDEDEDDEEDSDDDSDGGDLENFVICTLDTERNYQQPLDITVNHGEKVFFVVTGSHTVYLTGNYIMDDDEEDSDEDDDDYDLSPDELDYAMGEGMSDDESDELDGLEDPRVTEVDSEDEAPKLVEAKKGKNKRAAEDAEALDDLIAKDDSKLSKKQQKKLKNNKGEPVAAEEDAKKSDKKVQFAKNLEQGPTGSTQKGSVGVKVVQGVTVDDRTIGKGRTVKNGDTVGVRYIGKLQNGNQFDSNKKGKPFSFKVGKGQVIKGWDVGVVGMSIGGERRLTIPAHLAYGSKALPGIPGNSQLTFDVKLLEIK

SEQ ID NO: 2861 - protein, 656 aa, Unknown
  Kingdom: Fungi, Phylum: Ascomycota
MAVGMISKGPAAVDEEARAEVDVLNSRLEKTTQLTKKIQASLSRLDASGQSVREVAGPLSGETKRLQVLGNNVDAVLIAIERLRQPADSKNDEEQIIRAGVDKAGLSNYLASIKRLNKSFSAMQASNIRANQATMEDLGRLIKSGNNQLENHFDRLLRGETPRSVEPLHFITKDQPFPVLSQDKIARLGLVYSYVASTQQSGANSSVARIYADVRGPYISSSLANLAAASINTAKKKNPGAIYRAGTNGIGTYTQAMEGMFLAEYDNICSIFSREDWGAVFQSTCQSGLTELARTLRELNAHIKSHLNTDCYLAYEITEIISSISGKMDTRTGELKASLAAALKPVRETAKLSLAELLDETKRKIGEMQTISPNGAPSPIVAETMTRLQAMVEFLRPISSIMVSLGDGGWKSASASQSRSTDAIPSLASFDIGADGREIFAHYCEDTIEVLLTSLDYKARLALKSKSAQGVFLANSVVIIQRMIRDSDLAPLLQSRLEMLEQWRKKATANYTDVCKDLSIHLFDTIHTNRTQRPTSGPADSAHVVKGLSSKDKDKIKEKFTQFNNAFDDMVSRHKSYSMEREVRAMFGEDIRQKLQPLYDRFWDRYHEIDKGKDLTYPPSTQFAKSLLGLMSLLVNTVCAPPNTMRQLLQIVSSAI

SEQ ID NO: 2862 - protein, 1384 aa, Unknown
  Kingdom: Fungi, Phylum: Ascomycota
MSTDTHGAPSETENALHIEAQQHPQPSHPIAPDSDLPSDGKKDVASMGDEKTNSAPPFLHSPPESNNAPKSDASDSELSDLEDEPMVDGTSLPNLQPTAEETSPDALPQPEEIEDIGEVTPDHWSGAVPVFKPTMHQFKDFQRFMGKVDSYGMKSGIIKIIPPEEWKAAQPPLDDLVKQVRVREPIKQDIMGSNGTYRQVNILHGRSYNVPQWRQLCEKSEHQPPARRGERRAHAEVPKATRPKTTVSKASEPSTPKKRGRGRPAKGKGKNAKVKDEERPMTPVSPKAEPADHKDEVLTSVEKETNEGTSATETKPAPRRMGGVKPQQAKTQSVSARRKFSKREGSAMIDEEAFKDFDYQLDTMEYTPERCEELERSYWKTLTYAQPLYGADMMGTLFDERTEIWNLNKLPNILDVLGSKVPGVNTAYLYLGMWKATFAWHLEDVDLYSINYLHFGAPKQWYSISQADAKRFEGAMKNIWPADAKACPQFLRHKGFLISPQHLLQNYNIKVNKVVSYPGEFVVTYPYGYHSGYNLGYNCAEAVNFALEPWLEMGKIAKKCECAQAQDSVWIDVHAIERKLRGEETEYEETEDEEDEDEEDEEMSGLPTPPASHGVQFKEARKRKGGPAREGQRAKKKIKLRLKAKTEPPCCLCPNDYAGIELLPTEDGRKAHRTCALYIPETYIEAEGGIETIYGVTRVHKDRLELKCLFCRSKRGACFQCSQKKCARAYHATCAAAAGVFVEEEEVPVFGEDGTEYKEQAFEFSCRFHRTKRDKKLDSVALEEDSRIRKAAAALSTGEMCQMQLYRGEIFAGVVVENRSDEQILLLDTVPNSQLMEVEWKWLLLPDPADYHLPKASAKAIPMPASQKAKDRLNTKRADDKPRKDDVFGPGFTWAEYNFEAVSNRAQAKIDFEKSDQIWHYLGKTSTEARAQYTEDPSRPRFNPKGNFLDTLPKPPPKPRPVPTSHLEYRPQQGTVPYQNGGQFHQGGSAQNLAFAMQGKPYNYKPKANSMAPTQFATQRLAPTGLAPSLSTPGPQTAHPVNGHLGHQQEMTTKWRVPLTGPSPTAESQPQSLLAPQQPRSQAKPSWQVHSSIYQKYPFFNANSNRDSSKYRTPYSPTGGFTNGWEGSYSAYATSSQTQPERNNSSSVPHHGTGGSHRSSHAEVHSGSQLQSFHQNGTHASFGTFASTSQTGRVPAQNARPMSSNASKPPPPLKQAVLGLANAGLPTVRTPKVAPPPPSKQSPVPLPPNIMAAMRTSSGSSPPAVAAPRVSQSSPVEGGSLQAPLVAKQESPPQAANPSKTSVSRVPIPSFSVITPHQHAAQVAASRATERTQPAAKGAPESRASSGRSSDAGIQAFPDVPAGSTEFVERLMGNLRRVSQHNRG

SEQ ID NO: 2863 - protein, 301 aa, Unknown
  Kingdom: Fungi, Phylum: Ascomycota
MAFSTAPSAFLRALCILASLFCLVTARGKLPTDFQVDLIFPQPNKTYAPTPWFPVVFGIQNAQKLWPLPFSLTTRVVDVSKPRNESQDWQVVENSFGESEISAAIQNTTGDLYFHIITINTTNASTSTWYLEWFYDFANRCLDKNVTKEQEIAKEMTDAVPAWATLDEEIWIANTYHHWIRHPINFYIASDGEIPDVEAAAKQCQNYENMSTEAVRITDVITRRGICPFFETDVPGTNCNYRPIAKEVAANVSALLLGAMGCKEGDWRNITAPCNHATSSSAQNMALGVLVPVALAFMLVW

SEQ ID NO: 2864 - protein, 1467 aa, Unknown
  Kingdom: Fungi, Phylum: Ascomycota
MNVMAHKERIGQTHVGFDDVFPEALIAGLLTLPLENAATDDDEQLDNRSRKRRKLDTNSPAVCVCEGRVSFSRRAALGPTLSERRQDAEQNVQLAYSTTSKTWRIYGPLFGKRSFFLSMKEDNMPSNWRILGETASLNGPTKPGDVWAERSVELSRDSKATTITFHVRVYWDPVSSPFDPVGTKTQRNLRSFLLEHAYPDPSPEHGATHWSPMDFYDAVHVPPKVDVGSDTIQIPQLDATLYPFQKRAVQWALRREGVEWSPDALRVVGLASKPAPTTSSLFRQVSDIHGQDFFVSDVLRLATRDPAPFAQAEAAVSGGILAEEMGLGKTLEIISMILLHQRKNSPRTSAEQPNSSAKSGATLIVTPASLRQQWLTELAKHAPSLRVHDYKGCKNLGQHEYDNAVEELAACDVVITTYAVLTAEIHFAIAPPQRPRRHERKYERKESPLVKIGWWRLCLDEAQMFENGFSQAAQVARAIPRVISWAITGTPVKDSVQDLFGLLIFLRYEPLCSHPQFRQALISGKKKPFQTLFSSIALRHTKALVRDQLRLPPQKRYVISIPFTPVEEQLYQSLYKEMAEACGLDDEGGPLLNDWTPENHVEEMRSWLNRLRQTALHPEVGAQNRRALGSNKARPLRTVDEVLDAMLDQSDAAMKADERAYLSSKLTRGQLFENSPRVREALEIWLEVRDEVRALVLDAREGLRLAVQESKVAGREAAESLESEDDEISEEDSDDVESRGHVLECRRRLRFSLEMLHKAVFFCANAHFQIRDNAEMTDPESEEHTRLKALEDEGYEEAKVLRREILKQSHRRATRLMIGLAEKASNQSFAEIPELIARPEKGIESTRIVDDLEVLYERLNDQANIIDEWREHLIQLLLKPLLDEEDEAEFTGEELADSTKLQDELMVYVTALRAAIADRGDAISGQSNELIKHETMTSIRFAKDGEGPAPEKLLELLELRARMSPRTEGFSMRSALTQFRTLTVMYNREAGGATQRTVAEHRIASMHLESTQALMKKQNKAALALESEIEDFRAAMNARVEFYRQLQAVSDSVLPYDGPTGEMTALTMQRTEKDLIKKLAQARAKHRYLLNLKGAGAKSSETRMCVICQSAFTTGVLTVCGHQFCKECMMMWFKHRHNCPTCKRHLSTNDLHDITMQPRELRVHSEGGSNARSANDQSPPVSPQKVRADVVRKTGIYSEFNADKLAEIKNIELNGPSFTTKVDMLVQHLLWLREADPGAKTIMFSQYKDFLIVLRTALSHYRIGFASIDDTNGITRFTTDPSVEVFLLHARAHSSGLNLVNANHVFLCEPLLNTALELQAIARVDRIGQQHETTVWLYLVSGTVEESIHDLSVQRRMQHMQRDTNNAQNGKNKGRSKETTPELLDAKIEQANTLEMEHALLSKLMSKDKFAGEMVEKGDLWECLFGHVARGKQAAKSDTRLQEQAVIGYLAAEAAEERRTEQEQQQD

SEQ ID NO: 2865 - protein, 557 aa, Unknown
  Kingdom: Fungi, Phylum: Ascomycota
MGAQAGFLDLMKKQFAPSKLLFHFLFWTFHWSIFAYGWWKQAADARLAGLNTLEFSVWISRGAGLVLSVDGMLILLPVCRTIMRVVRPKLRFLPLDENLWMHRQLAYSMLFFTVLHTAAHYVNFYNVEKTQIRPVSALQIHYAQPGGITGHVMLLCMLLMYTTAHARIRQQSFETFWYTHHLFIPFLLGLYTHTVGCFVRDTADAYSPFAGELYWRHCIGYLGWRWELVTGGMYLLERLWREVRARRNTKITRVVRHPYDVVEIQFNKPSFRYKAGQWLFLQVPSVSRYQWHPFTITSCPFDPYVSVHVRQVGDFTRALGDALGAGAAQAKLYDGVDPMGMYEVALQNGQQMPGLRIDGPYGAPAEDVFENEIAVLIGAGIGVTPWAAILKNIWHLRNSPNPPTRLRRVEFIWICKDTGSFEWFQTLMSSLEAQSNEAARIPGSDGVEFLKIHTYLTQKLDMDTTQNIVLNSVGAEMDPLTELQSRTNFGRPDFKRLFNTMREGIIDRTYLNGLEGSMRTTVGVYFCGPSVAAREIKAAAKAADGQEVQFRFWKEHF

SEQ ID NO: 2866 - protein, 355 aa, Unknown
  Kingdom: Fungi, Phylum: Ascomycota
MLDSRFNIPLVRSFPQSPDPRLILLPAEEASLQEALKNPDAKPPGRPLTSHYASLDQKIHFMDTHGIDVSVVSLANPWLDFLSAEEAGPMAKTVNEDFASMCSKHPGRLFFFGTLPLSASLETIKSSVDHLKDLKYCRGVILGTTGLGQGLDDPNLLPVLRALAAARLTIFLHPHYGLPNEVYGPRANAEYGHVLPLALGFPMETTIAVVRMFLAGIFDKVPDLRMILAHSGGTLPFLAGRIESCIVHDGQLVKEGKVGKGRRTVWDVLKEQVYLDAVIYSEVGLKAAVEASGSDRLMFGTDHPFFPPLESDEQGEWESVSWNVKAVSRAVGEGSSNSQGIMGGNAVKALRLDEP

SEQ ID NO: 2867 - protein, 444 aa, Unknown
  Kingdom: Fungi, Phylum: Ascomycota
MANTLAKTRKQIAKKRGTNNLVLHEKSRNTLRLHKAHVRDQKLGKLASARNKKEQPIADRATYFQVNVKENGAEPADVATVQELIEGYIAFAEEEFAEAKKERRPGRPASAKEDLMKLRLATLQKEHEQGFSLPDVTTTAGVAALMLWEGEWSYLSNIPYTAAVAADLKMTFFDWLTFYRLHAVRLNVELCSVANIDACWQDTCPSSSCIGFSTYSIKLHVLKDGFLFAKGRPNDSKTVFPGQFPNMQDASGRRQFIWDLARFADPTLTNQMLKNIHGYATLCTYKWAASMGWIAITDGVLQALVDLTIWAIRFPHIVVLWQGLIETGDLHVVGSSQKYQQWLDLHPSSICAPWDRNSADPCNAANHLLVNKVALQGSRGFSAIDFPRHSICGIPRGKIQVDLINYTFQMYESILKPAPEDRMIEDVSHEPTKDTNMSKAPQKP

SEQ ID NO: 2868 - protein, 931 aa, Unknown
  Kingdom: Fungi, Phylum: Ascomycota
MSRLPPPSAPGLSELTDSQHNARNYGSSIAVPASSLKSLKRTVPPPAVQSEAKRSTLADRAGEYPARASASTSSHVAHGSIRAQSITNISQLKQPSALQPPRHTSTASSSFAKSFGPGRHAPTERPPTRTGRPVHTRSKSQAPRPRTAHGHRLEEPVDAPDDNGTTKSSSSSDTSHSHPLHIKQLKSQHNAPLLPTIRTSSLINQFKNMSLNEQGLQKKGLPVNTQFSQSTSQLPRFPIMSLHKIEERDQPSGYSDTGCQIHRQFDKLADTIGTIRSSSPTKFKSPRKAFLTRDSELTDFEAFDVDGRVGDMESQFKELKEMVNSTLTERKGQEQAMDLVKTRVSELEGDRKRLEARNDSLLTELDAARDESRHLRHEMEKQKWEYQRQLDDLNKKHKEVVEDLSRQHREAVDDLSRELDHLKDEEARDHEQKMEGLTRHYQQELQDEREKRDREIQDLRMRMGNDRQDTDLAFQRKDREIDEMKSRNRHLEEDLERERSLKSSLQANIAELAASNTTLDAKINSLKSHVEFLESDSKAQSDSFSNMEARLQEALRVAEEAREKLIKEETERRVLFNKYQELKGNIRVMCRVRPVLDETEGDQAKMAFPDEKTSAEIVMAGPEEKSSLGVVSRKSYPFEFDRVFVPGTQNEEIFGEISQMVQSALDGYNVCIFCYGQTGSGKTFTMSSPDGMIPRATHMIYDTITKLKEKSWTYSMEGSFIEVYNEDLNDLLTRSEEKSKKLEIRHDENRKQTHIMNCRSVRLDSPSKVETMLEEAQKNRSVAATKANERSSRSHSVFILKLVGENSATGERCEGTLNLVDLAGSERLKHSQAEGDRMKETQSINKSLSCLGDVIEALGKGSGHVPYRNSKLTHLLQYSLGGNSKTLMFVMVSPLETHLKETLTSLRFATKVHNTHIGTAKATKKIRSSDS

SEQ ID NO: 2869 - protein, 355 aa, Unknown
  Kingdom: Fungi, Phylum: Ascomycota
MRALGKDMHLYDTRTVSGPNRRSRLSIEYTITRDRWQPNLPGDLTASSPRDYAIAPVTGEVNLDHAELLMHCFKEDDIFVLSDRVGDYQGSLKLAFDIAHQFPYLLHELLAFSACHLATRYPHIPKYHSLASDLQTRAVALFNASGQDITPDNCVAVLLFSTIVGQHLFADSLRPRDFAGLPAFIQRFTHCLAVQRGIFTIYQAASPVLLASPLEKFLTAGIESQRVEPVGSDCAELTAMIYESPRLTPTDKEACIRASVILQLGFDAVALAPEEPTHLCFKWVIGVRPALKALLEAMQPDALVILAYYGLLLHMNRGAWPVGTAGAYIIGMVTDFLGRDCPWLAYPRRRMAEIN

SEQ ID NO: 2870 - protein, 330 aa, Unknown
  Kingdom: Fungi, Phylum: Ascomycota
MAPNRGSFWAQALPLAAVILLLAGLAEASVGDKLPEFKQCLDVCKAENCGAGEDHTPIPILHRLLFWNCGSECDYACQHIITTSRVENGLPVVQFHGKWPFYRFLGMQEPLSVLWSLGNLYAHWDGLRQIRARMPETYTMRPFYEWLARIGMTAWTFSAIFHTRDVQLTEELDYFAAGATVLYGLYYTPVRIFRLDRRTPQSKSVLRIWTILCVAMYICHIGYLKLVRWDYTYNMAANVTAGVIQHVLWSWFSYDRYRKSRQGWAMWPGFVVAWVMIAMSMELFDFPPWLGSVDAHSLWHMMTIAPSMLWYQFLLKDAKDDIAGTARHKA

SEQ ID NO: 2871 - protein, 472 aa, Unknown
  Kingdom: Fungi, Phylum: Ascomycota
MAPNNGLKHRGNKLHHFVVGDAAEEEFQTALVTQDDGAAQNDGVAADGGLEPSRQELAENLRLPMPQPRHVARHLRERSLASQQSSRSPVRSRHASPRPAPSHTETADDVNGLFAPSILGEDFMRSETSTPHPEFDQDENTVTGRRPEAHTKKPSSRWSSGRLDMLEESPKFVTNDEGFMQVVKAGRKYTPTALRDGFTRDDYYQREAAEHYDEAREQHRPIADGQIGLPIRTEPRRLTKAKEERILYSARAASPVYEPEPRAQGRDRGSRRSPERYVQSARQPPPETDDNIIRTTARTQRFGTETGVGTLNAEEPTQYTMRDGSRLRKRHRENPDYDDQVLSSMSYKELRNEAFDFDPTKAALSGVTNDGTHDLPTKLEQRRHRGEEEQRQFFASMPMKEWEESGDWFVDQFAELMKKMRNARREKRRVIQEFEDEAERREEVVRTRSEAIDRKLGKMRQDGLKVVGDASS

SEQ ID NO: 2872 - protein, 1449 aa, Unknown
  Kingdom: Fungi, Phylum: Ascomycota
MTGPAPVSTTPPPSSPGDPAVAANANETTNSTMPETAQQEQGGAHFDGPQVESSYLDGATMEPSRVPDESVSEDAVREHFKDVESSFLPTLSPIPTGPDTTEGGIDDTYLFDSPTKRDPPARRPREDEYAQSADQSHTTSSLENLDSSPTAAAAARTISRAVSMASTAIHHPTGASANDDEGDDEGDDDDGQEPHSHSITTESTDQESSLSRSQSLSERQDAGNTPGFAMRSRRPKYLRSRHASQRSSTSSFATNPESHDGSDVTVGLGADYALQSGVAVPALGMPRALSSTLTRSISMGSVASGFGDEYYDHPANQLETLPEVDSPERGRNSDMMKTPKPSKQNLKSAPTDTVIARHVSNVHVPESLAKEYRFKSGLETPMRPSTFSTTAGTTGRTGKNLTLKEQSSTIERLSKENFDLKLKVMFLSDRLDKLSEEGIKEMISENVDLKTNLAVMQRDNKVLRRRVKELEKQRKEEDERPSTARSGASSTDQTARLYDEEAQEREEELFYLRERVEEYATEIERLRGESLNRESEKRKLSDIVRSLGERTGENVGRQEEADVWKDLLEQETARREQADEDNRRLRDENFRMKQEMANAQGGMHHTTNIYNITKKQQREREAMSQGRPVSGLSGDVEGSAASLSAATTLAEDLRRESEQLRHENAELRREVGAQTSMLTSRNREKERLYQEIEDLKMAQRRGGPALSTVDSILDRSASRAGGHERSQSRGSARTRRTSADEEAEREELENKLAEVRDRMSEVKLQNQELQRELENCMLDFETAINGKRDAEEAALTLREELDNATNDLVALQAERDEALREQGDMEVEFESLRREAQDEIDALEYEADQRNEEIQRLQDELADRSENFDALQEEMRKMSEAVIRLEDEQDNKLRKIQELEQELELSNKELEELESKLVEANDKNQRLSIQQESSQGEIAFLREEQETDKIRIGDLEAALANAEQGLREEKDRAKEIDSRLQQERHQREVVANQEKEEVQQFVNELNREASTAKDEVRRLRKNLSSREVEATEWKERLMELENNLREALGDLNGTRSSLLKSIAKMQRELENTIRELDSSRASLNEKDRIIKQRDELLESHALESRKLAELIEKERVAHRNTKSQFEGFQKNHQHLTRTASTQDVRIQELESTRGQDRRRISLLEQTARDQLTERNQLLLVLWQKLSAICGREWTNNNALIDRQVLPSLEVIANRLPGFSRNLLAAVKAIEGIIGGFQGKIKAVERDLSRDYQNLENNLDVRTKKLDRLETMVRNTVATGPMSIQDKSNREMKLEEYCRQLKVEIATLRTANDVRSRSSYSTAEALIPGDPGSPSPSVPRGPGERDRVRTSYGTKSSRPSAAVSRTNTATGAPGSSSGLDVALSDETTSAHNNDNRWLFRLRDMEYKLKMEREGRNQDRQAARQRLSGLETENRGLRDRARRVAESEDMD

SEQ ID NO: 2873 - protein, 761 aa, Unknown
  Kingdom: Fungi, Phylum: Ascomycota
MGSSDIVDHSPHQPEPAASVPTAQNLVLIDNYDSFTWNIYQYLVLEGATVHVFRNDKITIEELIKTNPTQLIVSPGPGHPKTDSGVSRDAIRHFAGKIPILGVCMGLQCIFDVYGGDVSSAGEWLHGKTSPLTHDSKGVFSGLSQGIPVTRYHSLAGTHVTLPEDLEVTSWIAKPDGSPGVIQGVRHKTLAIEGVQFHPESILTQSGRGMIRNFLLMQGGTWKENSNLQPAQKANGVTAGASQKSNNILQRIYASRKAAVEAQRQIPSQRMADLQAAYDLNAAPPQIPFIQRLRQTPFDLSLMAEIKRGSPSKGIFALDINAPVQAKKYALAGASVISVLTEPEWFKGSIDDLRAVRQVLNGMPNRPAILRKEFIFDEYQILEGRLAGADTVLLIVKMLDDELLKRLYDYSLSLGMEPLVEVQNAEEMTRAVALGSKAIGVNNRNLESFEVDLGTTGRLRSMVPDGTIICALSGINSHEDVLSSKQDGVNAVLVGESIMRAPDATKFISQLCSGHDPIEPSNTKGKLGVKICGTRSAEAATQAVKSGADFVGICLVPGAKRCISDETALSISEAVHSFSRSTAADITDNSISLEGATDYFRAASARLRSSRPQVVGIFQNQPLSEVLELQRRYNLDLVQLHGDEPIEWASLIPVPVIRCFKPGQIGVGLRAYHTIPLLDSGSGSGKLLDFSKVAEVLRKDPELHVFLAGGLNPDNVAEAVKALGPLGDRVLGVDVSSGVEEHGKQSLAKIDAFVRNAKAIR

SEQ ID NO: 2874 - protein, 584 aa, Unknown
  Kingdom: Fungi, Phylum: Ascomycota
MPTLHQYDYILAIGTIFAFLDAWNIGANDVANSWTTSVSSRSISYLQAMILGSILEFAGAVGVGARVADTIRTKVVDVTLFEDNPAILMVGMMSAILGSALWLTFCTKIGLTVSTTHSIMGGVIGMGVATVGVDNITWVNFKSGDISGGVTSVFLAWVIAPGVSAAFAVTIFLVTKYAVLLRSNPVMKGLMLVPVYFGITASLLTMLIVWKGGSIDVESFSTGTIVGIIIGVGVAWGSVIGIFLVPWLYRIVAKDDWQLRWWHIPQGPLLLRRPEPPAQPEGSAGGIRDFYAGHMTTEELNALRNRNSSGSDVETTTENNTKEEKRVDSDNGADENGTVIAREVHMPEEKKLVGPKPEGKWYDTKVIFWTFKWLFLRGVDQDIVNMQSKRTRLTGDLAATHAHVKHYDNKTEYLYTFVQVMTACTASFTHGANDVANAIAPYATIYQIWKEGGLEGSKAPVPTWILCMGGAGIALGIWTYGYNIMKVLGNRLTLHSPARGFAMELGAACAVILATRLKLPVSTTQCITGATVGVGLCSGTWRSINWRMVAWIYMGWIVTLPVAGIISGCICGIIINAPRWGFEG

SEQ ID NO: 2875 - protein, 399 aa, Unknown
  Kingdom: Fungi, Phylum: Ascomycota
MPKATTPTSAFPALDGTALFSSFQLGHIKLEHRVIQAPLTRMRSDKESAGVHVPGPRVVQYYGDRANKGGLQLTEATDICLNASAYPGVPGVFTKSQLSGWRKVTDAVHAKGGFIYSQLWHTGRASSTGMRGGEKCVSASDLPMAGTYLDGGKCEDDPPRALTVDEIRGLTEEWAAAAKRAVNEAGFDGVEIHSANGYLLEQFLHDNINTRTDQYGGSVENRCRFTLEVISAVTKAIGADRVGIRLSPYNFFQGTRDSDPNAHWSYLCEQIANLPKDQRPAYVHMVEPRFDEELDEEAKLASLPNSAKKQKNSLNIFRDILRPAGVAFLAAGNFNRDNAPVKVKSGEADGIIFGRHFIANPDLPKRLREGLELNKYDRTTFYGADPPEKGYNDYPFYAV

SEQ ID NO: 2876 - protein, 152 aa, Unknown
  Kingdom: Fungi, Phylum: Ascomycota
MKVSFVAIAALLGVASAQKAVVTNQCDTTIYVQSYPYGGGKAGPLTAVKPGKSFQEDLRSTGSTVKIAKTKTLDKPLFFGYSFGKNNNYAYYELSTEWGNPFASSRNTLSPGSGCQAFNCAPNDAKCYSTPSMKKVYGCPEPVTLAATICKK

SEQ ID NO: 2877 - protein, 1228 aa, Unknown
  Kingdom: Fungi, Phylum: Ascomycota
MLTATDTPFPVKGWPKPLPRGPRGFQQRESHSPAYPTALAENWRSWPELTVRIHELPPDVTTAMIHEQFHHYGEIVYMEVYESKRSYNFSARVRFSPPPNVAFWETDQFIFQHFDTHSHPNGVPVNVKPDTRPPTDWVSSNIDQRRSYAGRIIVKLSAVRIGSRTGPDEVTIAESWDHKTPQPDFCLQINAYDKQLSARFQVEIKTLQGPRLRSYKMQIKVAQIRRAYRTTNGGDQETIVVPLEFPPEYWWKRDDVATTISNERVWGESDTWHRASYMADRMDSPLKYPVSVSCNVTEQGYVDLGRWTTCQFAIAPDQAQNLAPLREVLDDLNVRIEDADDLKVIVRGQADLWKQLDHSSPPGSNATAMLQMWSDQVHLPFEVRYQLEACISRGKLHEHNITREFLDKLASEDPMEVQTRLELIADRARPTFDPISYFDSLDTSEPVARRRIPEYCYLVRKATITPTTMYLNVPSYETSNRVIRKYSHIADRFLKVQFVEEGEAGRLRAAGGLDNDEIWKRVWRTLDKGVRIGDRVFEFLAFGNSQLRECGAYFFCPTDHVSCDDIRQWAGDFNHIKVIAKYAARLGQCFSTTRVLQGIPNPDITTIPDIERNRHCFTDGVGKISKFLADFIAAEMPGNEGERPTAFQFRIGGSKGVLVVSHDVKGNEVHIRPSQEKFKAQFNGLEIVRCARPATAALNRQTITILSDLNVPDAAFITLLEQQLRQYDAATRDNAVAIELLTKFVDQNHTSLAIAELIHSGFRSHDVQEPFVLNVFSLWRSWSLKLLKEKARIHVEQSAFVIGCVDETGILRGHSTASEGTTTKDVKRLPQIFLQTINSTTGKSFVLEGVCIVGRNPSLHNGDIRVVEAIDCPQLRHLKDVVVFPSTGDRPVPSMLSGGDLDGDDFFVIWDKALIPEIWNWRPMDFSPTKPREVERDVDSQDLRQFFVQYMMNDVLPLIAISHLAWADEQKPRSIICRRLAELHSHAVDYAKTGEPVDWDKKDMWPKRWPHFMEKDERKTYDSVQVLGRLYDNVTKDKIAFEPDWSHAFDKRVLERYDPDDDLLDEARHIKAEYDRSVRRILAQLNLGTEFELWTGFAMSKPTIGTDYKRQEVLGQEFETLKLRFRGLCEEAAGGNSPEDIDPFVAAMYKVTEEETTRALQTEDDSSDEDHDHVIDDSFDTTRRAVGPNVPLITFPWLFPEVMVRIAQGEQWVRNRPWYSPSGRLAKP

SEQ ID NO: 2878 - protein, 598 aa, Unknown
  Kingdom: Fungi, Phylum: Ascomycota
MGSDPEKHSANGASPGRGEAVEDEHTITTTSSSDSPVLEPIATRHSRRSMAIYEDDDLASNLSRAMSNEIETEAERAARDPITHTRTGTSVNSTASRPPDFEIIFEENDPENPKNWPLWYRIWCLVTVSYSTWLVVLYSTSYTSATPGLIEEFDSNVTYVTLGMTTYLLGLAVGCLVLAPLSELYGRRPVYLVCQSLWMILIIPGGVATSLQTIIVMRFFCALFGAAMISNGPGTLVDITKPEVLALVMSLWSIAPLNGPVTGPLIGGFVYADLGWRWEAWIALILAGTSVAMLLTVKETYPPMILRMKAARMRKEMDDPRWWCRYDQRVDTLQLLKVNLSRPFVLFFTEPILWFLNIWISVLYGVLYLCFVAYPIVFSKERGWAPGISGLAFIGIGIGTLCAIASEPLCRRLIYFQKRDPETGKVQPEATALIMAIGSSLTAFGQLVFSWTCLPASIHWAIPIAFGIPFGAGNTLSFIYGSHYLAGAYGIFAASALAGNAVVRSIFGAVLPLAGPKMYEKLTPQWAGTLLGLLEVALIPIPFVFWRYGGKIRAKSPVIRQLREDQERVDAKRARYLARVERREMREKADGLSSHDEV

SEQ ID NO: 2879 - protein, 142 aa, Unknown
  Kingdom: Fungi, Phylum: Ascomycota
MPTVPFRGGPGGGGKGKSRIGVAGKTFKRNTARNRKILRDNIHGITKPDIRRLARRGGVKRISATIYEDARQALKAFLEKILRDCAAFVDYRRAKTVTVTDVIYSLRRNGRTLYGFDNDGIGKGRNPKRIVVRHDLEQYDSN

SEQ ID NO: 2880 - protein, 169 aa, Unknown
  Kingdom: Fungi, Phylum: Ascomycota
MASIARQSLLAPARCFAARGVAARPMMGVAGFHASSRRCDILPAGPQRIKGGVNDPAPIPTPSAAHGSYHWTFERLIAAGLVPLSVAPFAAGSLNPTMDAILCGTILLHSHIGFQAVVIDYVPKYRFPGLHKAVMWLLNGATLLVGVGLYEFETNDVGVTEAVKRMWKA

SEQ ID NO: 2881 - protein, 487 aa, Unknown
  Kingdom: Fungi, Phylum: Ascomycota
MEVAVHKKTKKVEAQDGDDYSIKPTAVTPSIDTSNWPLLLKNYDKLLVRTGHFTPIPNGSSPLKRDLKSYISSGVINLDKPSNPSSHEVVAWVKRILRCEKTGHSGTLDPKVTGCLIVCIDRATRLVKSQQGAGKEYVCVIRLHDKIPGGQPEFARALETLTGALFQRPPLISAVKRQLRIRTIHESKLIEFDNDRHLGVFWVSCEAGTYIRTLCVHLGLLLGVGAHMQELRRVRSGAMDEKKQLVTLHDVLDAQWTMDNTRDESYLRKVISPLETLLTTYKRLVVKDSAVNAVCYGAKLMLPGLLRYESEIEHHEEVVLMTTKGEAIALGIAQMSTVEMSTCDHGVVAKVKRCIMERDLYPRRWGLGPVALEKKKMKADGKLDKFGRPNDATPAKWTSEYKDFSMPDASAAAAAAAPADKVEETTVETTVVAPATPGDDGDKKKRKKHDGETPDEKAERKRRKAEKKAAKAAKKASKGEDSDEDSD

SEQ ID NO: 2882 - protein, 368 aa, Unknown
  Kingdom: Fungi, Phylum: Ascomycota
MTGGFPFRAEWLGAAASASRPNWAGPAHLSRDILPLNSSLRSPPYHPAKVAMTRRDEANSATQRKRSHDDNNPSSSGSSSSDEPSRKKHRKSKKHGSSSKNGEVAMPVNGAGALKNRRNSMVGKAARDPRDEPPKKRNASTGGEVTRKSSASPSPVIDFDGLSRPSRGTRERREENAEQAEARLQKMRGAVRTLLECVGEDPDREGLLDTPSRYAKALLSFTQGYQNSVEDIVNGAVFREGHNEMVIVKDIELFSLCEHHLVPFNGKMHIGYIPKDNVIGLSKLPRIADMFSRRLQIQERLTSEVAHAIMETLNPQGVAVVMEASHLCMCMRGVQKTTATTMTSCMLGCFERKSKTRYEFLSLIGVNR

SEQ ID NO: 2883 - protein, 353 aa, Unknown
  Kingdom: Fungi, Phylum: Ascomycota
MSSSLSPEQSVGAGSNSSPGNASNLGPLLQNLSDKRSNRENPPKRRGPKPDSKPALTRRQELNRQAQRTHRERKEQYVKSLEDELLRVKDLYSKVSRDKDTLLEETRHLKNLLMLNGIPFNTQPGMAPSSNYGSEDFATASSAFSPAPSQFSNPSQGHMSGPGPSSVGSQGSGMVDPEQAGIDFVLKLERPCMVHRQIIDGMVNTSGGPPCGHAMMASCAPPEQNQDTPFNTKWTAGEAEIQTWDLSKGDLARLLDLSSKLELDGEITPVMAWKMVTMDPRVARLNQADFDAVATRLMERVRCYGFGAVMEAWEVRDAMENDGQGLCQAPPGWEMGKALVEYLIAVLVLGIID

SEQ ID NO: 2884 - protein, 145 aa, Unknown
  Kingdom: Fungi, Phylum: Ascomycota
MHPYLVLVFLGLVAAQDVNYPDPSIPCGSSSDSNSGDNLCPSPDLYCKPDDTECADLTRCSGRCAFKNMFVRCGGFRLPGPEPCEYDETCADDPRNPESCGMACDAPGVCISERMVECMDDDGCPEGQWCYEDVKGQTGFSKVCM

SEQ ID NO: 2885 - protein, 707 aa, Unknown
  Kingdom: Fungi, Phylum: Ascomycota
MVQATNSTTDWDADTIAFDRCYDSNAPMPYHQDSGKAGLARDRRHKLRSLSATMTWSRPKSSLAWSAEAGHAGYTNEAIIEDESDHEGQSAGASGHAQPVSGFKSMVRRASKSIKSMVHRRPSAQADEALGSRSGFARPTTSHSLWTGRTRQRNQSVQHSQSFYGLDYTQEPQYIPDIQAEGVQVPRPGTSLGPPIIPEHTGAAAKASAALQNEYMARTLQHKWLSPLSDEGTDCESGVGISVSGIDDDIEIIDSIESQQDISRVDFISQLPVELAIHVLACLDSLALSRASSVSRNWNKVCGNQHVWRESCLREMTITYATSGSVRPNAGQGIPRNLPSSDWKEIYRAKNELNQRWKSGKAKPIYLNGHKDSIYCVQFDEYKLITGSRDKTIRVWDLHTFQCRLIIGPEEVLTREMLFNGDGGLVHNATGADSRVLCEGVPRMVSFPMHHNASILCLQYDEEILVTGSSDSTCILYDIKAGYRPIRRLEHHTAAVLDLAFDDKHIVTCSKDISICVWDRATGALLKQLKGHTGPVNAVQMRGNTIVSCSGDYRVKLWNIDTGKNIREFAGHTKGLACSQFSEDGRLIASAGNDHTIRIWDANTGELVRKIDAHEGLVRSLHVDSVSGRLVSASYDTDIKVWDMETGRQLLDFPHWHASWVLSAKCDYRRIVSTGQDPKILVMDFGAGVGGIDLLESEDQDERQAFV

SEQ ID NO: 2886 - protein, 208 aa, Unknown
  Kingdom: Fungi, Phylum: Ascomycota
MISQSIRQVISITPFVKSPEDLSKRSSTSQDMPADIDDGSDSMINLMLVVLGIVFFALILVSILFVFRRVRRNRQLQGHTLPSYYDAAGSVKNPRGLTIETTHPNGRSSVLVIGRDGQPMLPNPNSPPHSPDNVPEIRITFPDEQDAQGRHQSGRVLVVRVGENATVGLEPVQEEQLPAYEKDAKAGFYSVDMDQIGGLKEKDRNLFQ

SEQ ID NO: 2887 - protein, 651 aa, Unknown
  Kingdom: Fungi, Phylum: Ascomycota
MASSEQYIVALLRSDHIKDHLFPHLTTEDLISLRASSSAFCNLLTKGLFTRIHVSFTSSTFTRPSRVAALSRIGHHVEHLTFSFPHSEATFLPPLIHPLTGHEINFRYTPHTSMGSALTRPKYANSELQQLLTDQYPPMFHAATNVPSFIHALKMVPNMRHMTIRCPGQDPSERYRRDIVDYALISVRIALERAPLTNLNKLSLSSVHPGAFNYLRHVNGIGAVPSAGRRWRQIKKLHISVEAWDFYGSSPGLDHLKVIDDYIRTFSPTLEKFAFTWVGRKGPCPVALCADPLFSPPRSSRKLFAEVTSPMSPLPSLPSRAPMHFPKLRYLQIRNATMNAPQLKGLISSHSKTVKEFDFENVVLLNNGDWEDALAPLDHDDSWSRSSLTAASECSFATMSSAESLPSPSAAVAAASRELLDLDLGGFGFSDEDREVIEGLSEDIMAAREASMSFTTKLKKKRRRRRRHHRDEEEAPAPLPSPASSHRRKPSKPQSKSSFEILRPSTPTPLPSIITPPLTPDHQPVLLQPTVYKAASQHAPSSSTLADVPNVQRNFQQEETHRLMAEDPAARTSALQKAKEAVLSRLGREFSTTGKKCKVTAEAVAACRLMTSREFLGGGIGGGFCAADIVLEDRRGLQTGSVMVPLMYARA

SEQ ID NO: 2888 - protein, 580 aa, Unknown
  Kingdom: Fungi, Phylum: Ascomycota
MPSQSVLMLGAGFVTKPTLDILTESGIPVTVACRTLESAKALSAGIKGATPISLDVSDDKALDAEVGKHDLVISLIPYTFHATVIKSAIRQKKHVVTTSYVSPAMMELDQAAKDAGITVMNEIGMDPGIDHLYAVKTIEEVHKEGGKITSFLSYCGGLPAPEASGNPLGYKFSWSPRGVLLALRNAASFYQDGKVQNVAGPDLMDFAKPYHIFPGFALVAYPNRDSTPYKERYNIPEAQTIIRGSMRYAGFPEFVMVLVKMGFLVEEEQDFWKTAIPWKEATQKLLGASGSDEKSLVAAIDAKASFKNAEERERILAGLRWIGIFSDEKITPRKNPLDTLCAALEAKMQYAEGERDMVLLQHKFGIELADGTKQVRTSTLCEYGSTEPNGYQAMAKLVGVPCAVAVKQVLNGTLSEKGIVAPMSSKINDPLIKELHEDFFYVCPVHLKDKSFCIPKIDEAAVAAKKREQELNEEKERLIKEYEEKQRKKKEKETEKDGKDKDKDKDDKKEKNKDNGEDKKDEDEKKSEEPEEEARIFELKSTFYNARLQKRRQAEAAKRDRERVKQPGYFPDVPSDPPSK

SEQ ID NO: 2889 - protein, 849 aa, Unknown
  Kingdom: Fungi, Phylum: Ascomycota
MLKPNRSEECDGQKIYEQNANRNEKDLEVQLVLAFVLGVLALLTFCALRPRWPSLYAARKRRLAPAVDLPELTDSFFGWMPRLWRVTEEQVLAAAGLDAFVFLAFFKMSIRIFSILAFFAITILLPINQTYDKSFDFPWRRNGTGNDTEMSAHFAHFTLSDDLDASKGGKRDKSTDKDHAYLWAHVIFTYLFVALTIYYINRETFRVIRYRQDYLGSQSTVTDRTFRLTGIPHELRSVEGVKHLIEKLEIGQVDAVTICRNWGEIDDLVEQRDVTLRRLETAWAKYREDQAADHKNGRSRRSNDSSNSAQGEQDEEAGENGQLLQENHDNADTERPHVKLRHGFLGLRHRKVDAIDYYEERLRRTDEKITEARKKHFTATDMALVTMDSVAACQMVTQARIDPRPGRLLTKPTPAPSDVVWKNTYSPRGLRRLKSWSVTIIVTFITLLFFFPTAGLAGLLSICTIESVSPSFAEWLEHHETIYSLVRNGGPTLVISLMNVAVPYLYDWLSNHQGMISQGDVELSVISKNFFFIFFNTFLVFSTSKTLLEFWSTVRDFIGDTSLIPKAIAEGVRRMWVFYASFVILQGVGLMPFRLLEAGTVFLTPFYRAISKTPRDYAELATPPIFQYGFYLPTALLVFNLCLIYSVLSFGFVILIFGVLYFALGYSTFKYMVLYAMDQPQHATGGAWRIICYRLLVGVLVFEIVMIGHIASELAIFTSLAIVPLLPLTVWYSYYFKRRFEPLTKYIALRSIRADEDPDDAAALDEDFEAESGNRPSQGLLRRGSTIDEHKEKGLVFVNPSMVVTLQQPWIYDEPPPSVPREETETDDDGPRLILPGLGEDNVWSDRGS

SEQ ID NO: 2890 - protein, 311 aa, Unknown
  Kingdom: Fungi, Phylum: Ascomycota
MTVAAVAGGSGKLGRAIVDGIVAAGKFEVVILARQADDAKSKEIGARIIAVDYTDPKAITSVLDKNNIEVVVSALSSHSPPEAELNLIQAASEASVTKRYIPSLWGIRYDEAAAAFFPPAAAKLSFIKALKKTSLEWTYVSNGYFLDYYGAPKVKTYMPPLSCVVDVANDFAGIPGSGDVPITFTHTFDVGKFAAALLTKTKWEDEESIIIGDKVTFNEFVRLAEEIKKTKFTVKYDSVEKLKTGQITELPSHPANYPYFPKEMLQGMFSAIGILFDQGYFNLKTDHTLNSEFPEIKPKTVKEIITEAYAA

SEQ ID NO: 2891 - protein, 196 aa, Unknown
  Kingdom: Fungi, Phylum: Ascomycota
MMRSSQSEAPPLRRPLIYPVYRVGTFVNATEPQRPASPTQDTFGPFIRPHHPTHKIRNESNFTTMSSSMFMRRAAFGARAFSTSTPRSIARISIIGNLSDSPELVATSTGREIVRYSVASNTGPRDNRQTSWFRVTSFTEGPQRDYLLGLPKGSTVFVEGNASISTYQDAEGKTRNGLNVTQRSIEVLKRTQVPGQ

SEQ ID NO: 2892 - protein, 784 aa, Unknown
  Kingdom: Fungi, Phylum: Ascomycota
MARYLNPAKIGLLVLLELYAEEAVPSDAILPVLSFISSHIIDSHHRSTPCDQNARWNRAESTVNLVVSIKDFEKLLGSYPFLMGMPGRRLWDQFLDKTWAINSLHELHNFFDGLQLLIAKTREELKRETGLSSPEPEEGMKLARNSPLGAFIRRSQIEFQRLRFHDSAELWKDFVRYRQPTSLQRKRKTPRMAFDNVLLEGEQQEEWDAASTSALASVVYGDMLTGGQTNTLPVSTDDIDALLEFQIEQMQKFGNRVPMEIRHQFHDLLHDSFVVPSTTHYLSYLDSWRSGDYPSAFDYLHRYFDYTGHNKDRVYYQYGLLNLAVLQADFGCYQEAVAAMLETVSTARENRDMTCLNFALNWLFNFGRSHPSMIKDLETNSLLGSAKESLAFLRVKAKETGMFTLWSSVLLTEAKTGLESGDSVATSFEHMTRSSQLIVEKNMKTMFGPQMSLSTATWDRLGLAQTAVMTAEVFLRCHSRHAMFEDELRLTCKLGLHKADRGKYDEALQALESIDENSLRSRKPGQYWFKYRGIVKLLRDLRHGYLDGAQKLLDQLLQSKTDELEPGLAFMIDSLHIDYLTRRGDLQAAFETVERLLSESRDGAGDVDYRIRLLLLKARLLDKCGRPQRGFSIAMRAASLAWRARLMTSLWSSIGALCSILVSMNEFASAAELLCAVLPRAIECDSYDLTARLYACLADANMGLAGTMPAKSPRKTEYMTRALGAVEKAFDYYSGIEDAEKQCEMMAKKAVIMKVSGDMVLAADYAAAYVALRKSAASLSLGGQ

SEQ ID NO: 2893 - protein, 715 aa, Unknown
  Kingdom: Fungi, Phylum: Ascomycota
MDSVQQPRPKLPTAKWGAACAACATAKAKCIRSNPDPESKCDSRTTQLETKLNGLVNYLKVSGEWEKASSDLDVDPSYGTGSSDAGAHTSHTSPCLSVPESFQTSSSAWYIPPTYNANAPPSCICRADSEEAPPPPDTDDNLLDLFRSDFTAIHPFVVIPPETTAAELNATRPFLMSAIRMVTSVQSLKSMRAQMYRIMVHVSDHMLIRSERSMDLLLGLIVVIGWYQYHCFMHAQLNNLVALACTLCAELALNRDPAHHERTLLMMARPAPIRQRTNEDRRAFAGVWFLSSAMSIGFARIESLRFTYYLQDCVQQLKECGEYATDERLVLMVRIQHLTERIARLSSRDKTLDEVTNIPSAPMSAYVSSFQLELDNIDKSIPIHLKNDYVILTYLNTARLRLHEPPAVDKDLIESLAESLKVAHPGNGSPLDRVYQSANALRIWFDHWLTVPVKQYHLHTTSVGSQIVYALVMLSRWAKLATPRTMYGGDTPMPVDPSQRDDRFSFEQEGTPASSATTTGSSNPSEGLDPCRYGLVCSKGVSDPSLPAAVAVLRSRLRRQPGLKIDIPQILSSIYTRFEQANDALQMMSVEEGKVEHNIWSMSAVKMKITQAKLEKWSEMVAAKTDSMSLSDYEYPISTAVGREGPSSYDHGEVYGNGFTNMTPAEDIVMHPGLGEGDQWMAEVMGGVDPSVWFDGYVDWGQMVVSSTGELQGSI

SEQ ID NO: 2894 - protein, 1393 aa, Unknown
  Kingdom: Fungi, Phylum: Ascomycota
MASSNAVEGGGPATATRSRRRQRPKTSDSPTQQPKAKRQRLPLTEQTFVNPDVPPEMTEAKETKVAKLNARPNGTDTLSRQQHNQIQFAVRRESSGRPKKPKHGDRAMNKGDGSLLLTSTSAYNVSRLPALPDKIGSDWTAHQHADISSFGYALSLTQTHALVWPYASTSPSPETFTFTLPSTAKPNDPLPVGSLVSPPAASSEPGLVVVMAGSGKVVYWETISSAATFAFINKDRSGVEGVVSGMSTGEKVIVITNAESAGFVLTFNTGRLAFLTVRDSHGRPAISVQFLQAGLAASSSGIFGSIRHALSHLSIRGDVTAVRADRSSRVGERNVVALTKKGRLQAWRLHRSGHYESLGDTDAREDIIEAIHEYDQASKEFPTESFEALDLTYVPQGLESKYLDLTRLSSAISKDDPYIQHVLMLASFTRRTTARYVLVELVLESGKCHVGMIRPLTSYATPAPVPSDPQAGRPRIYLPRPALVAYAVFDRAAVVASIAVPPESPESQLQSDSHILPPAFEDVVDFREDGHDVLGSGIEELPALTANHEENRTQRQRSKNPAVILLVRGAGTVRVITTDVDKLASEQPPKVSAKSKMEQAVFFGMKADNPLIFDARTETKFSREETAAAALEVSHEILSSTSPHLGALPPSMEDNLRARSKAMERLMNHLEAIDASLDRRTRWSLLHNAEKMHVAVLMWRLHEDLTAARPSNDKTDIIKFIVDSINEEQKSNPSAQIGEVDPIRHWFINDVHTIQYLVAWAYELIKTFWKEKSLKDKFLDEAKLTVMMHEAVQINIRAHTGALTFRKNNLAFYGLESERLQNGILVEGYEGLEEPWTGCHFVANNVKRLVDLSTGWCETHPHTGKQKTPTEPDPKIMAKIFDELPALIEVMLSTAQEYARWGQAQPESQTKERAASFAKLYSEARYTLTTGLAGLEKWEDAARLAERHDSLDALAVILLDHIGVLEAARNEPNVSSVQIQTLKTTRSAKMTKLEDCFAEYGEDFAFPAYAHLLESHGVDAVLGFELDREGYKTKFLRSRPELARISWIHDVQQEHDVDHAAQTLLDLALNKEQQVWNKKVELSLGKLALLAEQGAQSNGDFRVNADEARKEQKLKEVDQELVAIKIQQSLYNAVSRCTYAAVDEKAAFEFVMDTHGKEIPNRQKAVNHIFSDGVKRLLNHEALDAMTLIDLLTLLRLDDSSSELIFNQFWLALKVADSICHTDEVKEAKRLIWRRAFLRDDWAKVNNTQNKSDRDIVEAVADTEVFGLLVACIERRKSTHPIHVSPDKFAHNTAEDRNSPFVPMQPQEALGAFSEAPDRRFRDFSDDSFKNKYLENMRWEDKQLQAHMDKRRLGSWLQATFEEAKTQVRLDADEATWEGAQEAEANGDLTNGA

SEQ ID NO: 2895 - protein, 230 aa, Unknown
  Kingdom: Fungi, Phylum: Ascomycota
MTERIVLILGAGPNIGHSVGKAFKDKGYRVAVTSRSADPNASSSGELVIQADLSRQEAVSEVFEKVKSTWGAPHVVVYNAYVHTDNDPKDAFEVPAEVFTKSTFVNLISAYAAARETVQEWKAMSKSETNLTFIYTGNCANTIPLTPLLDLSVGKAGSANFVAIAAEAYKENDNFRFYYADQRTDDGTPMWDGPSGEGHAKLYMDLAESDERRPWLQTFVADQGYKRFAA

SEQ ID NO: 2896 - protein, 538 aa, Unknown
  Kingdom: Fungi, Phylum: Ascomycota
MGVMARILRSIVRNDAMRSDPDEIYGWRVFALVCCACFGGMLFGWDIGAIGGVLNMPSTQEQYGYLDASKHHKTLQDQNIVSTLQAGCFAACFFTGWAADKWGRRACLMGTGVITTIGVVFQAASAAKGDLAVMYVGRFVAGLGVGAASTLTPLYVSECAPRAIRGGLTAFYQLFITFGIMFSFWVNYGCLQHVAPPAQFVVPLALQALPAILLFFGMMVSPESPRWCARQDDWEKATRILVHLRGMPADSEYVSHEVQDMAEQLDHERRLTGDASAKTLFREMWFIPGNRKRAIISVLLMICQQMTGTNAVNYYAPQIFKNLGMTGTSPQLFATGVYGVVKTAGCAIFLIFAADSLGRRRSLIWTSIAMCIVMYIIGIYGRVQPPVEGAPVSDFGYVAITCIFLYAAFFQFGWGPACWIIVSEIPTARLRALNVALAAGTQWLFNFIIARTVLTMQETMGTAGYGMFFMFGTFSIIMGTFVYFFIPETKGLSLESMDELFGVTELAPKQIDGDMERGKTPSLREHENVGATQKSAAA

SEQ ID NO: 2897 - protein, 277 aa, Unknown
  Kingdom: Fungi, Phylum: Ascomycota
MGFVTGFTGGVTLTLSAAYLSVLAHQRTREHQSALLRAQALDIQELVDPRKEQPLPPTRSELAAAERAHSVEAVKDRWNQEVENAAKWVQHTDWDDVRATAEASVAKLWSKAFSEAGTEIEKAQEKIKPLEKKAEAKAVKAEHNVAEAAKGAVEQAKWSTREAENAAILAASKAKRKAEAEAVKVEAAAENKATEAKGWLSSALDKGREMVGVATVPSGLADVEIIPDSLKPLTPVQKALRERYMRPEAKHNKTVEQALQERYTPMDKRDNTVLRGI

SEQ ID NO: 2898 - protein, 304 aa, Unknown
  Kingdom: Fungi, Phylum: Ascomycota
MSDIEDSTDGELPVLDPYETLDLERSATADEVKSAYRKAALKNHPDKVPDDQKDQAKEKFQQIAFAYAILSDPARRRRYDTTGSTSESIVDADGFNWSDFYREQYKDAVSEDAIEKFAAKYKGSEEEKDDLLVAYEQCEGDMDQVYETVILSDVLVDDERFRKIIDEAIESRDVPAFKDYVNESTKKRIARAKRARAEATEAEDYAKELGVADKLFGKSSTNKSGKKGSKDSSEDALAALIQKRQQDRRQDAENFLDGVAERWGATTSAGKGKKGKKRAMEEEPSEEAFQAAAAKLGKGKKSRN

SEQ ID NO: 2899 - protein, 372 aa, Unknown
  Kingdom: Fungi, Phylum: Ascomycota
MAIMAPTERCIRAMSYVYGDFDTLSENDCKTWTPAPGPTGSHGGRRLWTDAFGVINFTSLFLETADKRYLWLAERLAQTVHDVLGRSRDGLHRLPGASDKRPLLGGLRSGRAVEKEDGQVHRELTMWMFALDRLGRASRDDTWQNLAVELGEAVHPRFTVHKLSGGMRLVGKISGDMEDVVEVKSGELDAVLGWAVYRLTRRGAGGGKVLLREVDDYELIMGSEAGVVAGEEDLEWLGLGLWVSGLWKGENWSEEMGRLGMERVGEVFKGVKEVLGTDDEVEDRAVRELGACLGVRCWIDGKTKKREEEELLEASERVVGVWEKRIESAGMLKADVRGLVSVMVGAVVLSRAFQQHGVEDGNQGSGDVIVEE

SEQ ID NO: 2900 - protein, 898 aa, Unknown
  Kingdom: Fungi, Phylum: Ascomycota
MASGITYDGVASTEGGNIFQDKSFWVAQRVPTRNDILSKIRNNGGVVVPLEKNADFLIADHARKDSPAGSYSWRFITESIQHGALQVEDRYRIGPDPNQPRSVGGAGLTRAGRVPFTHADKAALAKWVLSRPDLSRQGNELYQQWEKINPRHTWQSWRNHWVKALQPLDHHDLKMLAATAPDEELPQGPPPEQRGAAAVTPKPENAVVRSARPAAAEESAPVPPSGGGRKEFTKDDDAIIATWAVDHSMVLTTNHFKELEEEQPHRSWESWRNRWNKRIRKYSVAVIEEMAATISGSTPGSNAQTTRRSSTTNGTPKAESVAQKAVESNTVDSRQATVKSQHTPKSTASSATKGRATTTQVKQAGRTDRSVAEQRPDTSMTKVANGESVSAEQPKPSRSADDIPVESETLEAEVMTTETGQSLNTEREAAVDDNEDEVEGEVSQRDRFFLDLINFNGTADITDFEFPTLKGPAEDYEIDLYELARAYDAQCTAPEDIDWDEVARALGWATQDEDWLGPALQKCFEEQLMNFLEAMHNLHADNDPTDLETRNTTMPSSPPVRQGSPKRRREPGYIASTASVRKRRRLQNVEVPSTPDEQMGITRELRQEHGASVSPSLRRVSAQPSEQLPLLQKTPIRSRQGAPSSVRPLDSNGEVGGATGRKDQDTSSEEDIPSLLDLLRRRGKLKSGKTPRRSLPASFARPLPRAEPSRRTSAGQQMPSPRTNTTLSIDESLKETVSDWVDRHLRTGYPEHILDQALHHTSRVPGPSADHIVDSLANDNGIPADLPGVWLPHEDRTVKQLMATDFSAQASSAEELTEQKCLREEQRRLIERHTWEGLSKRKKYLREHMENIGEAPGKKKEVVKRPAPIKPPTLTQDEKKRREMELRRMMEDSDAEED

SEQ ID NO: 2901 - protein, 318 aa, Unknown
  Kingdom: Fungi, Phylum: Ascomycota
MPVPITRTFPITFTNSGDVVYPDWAYPYRGWTIPSWLSGLISIGLPIFVYFLAIPRIKSAWDLGAAIMGTIWSVLLGTLFQVTIKQLIGGFRPTFLDTCRPDLKKLLSNTTKPNPLNGSGYQNIFYTIDVCTQTDKWQLKHAMTSFPSGHSTAAFAGFGFLFLWLNAKLKVWADHRPAFWKLTVSLLPLLGALLIACSLTIDAAHNWYDIVAGSAIGILTSLAAYRASYAAIWDWRYNHLALQGREAFLYSADPEDDELYKGQTFTRAVGWGGRREWLGESSGVYSSTTGLRSGRRDTSTREGDSSSPTTPESGRETV

SEQ ID NO: 2902 - protein, 2030 aa, Unknown
  Kingdom: Fungi, Phylum: Ascomycota
MAAAEVDVGFVAGNLGLDLPAVQAITTNPTAELVATLLQAVQKKLHEYDELYSSKLQVDIEYEAVVRSAETRSQTSKSTVEKALKDTEEARKKLKEEEDKRQAVENELRTVKAKEAEHEAEVKSLHDKIETLETSSRTSLSIIDSHNKRDESLTEELTKQHQRNVELSRELTASQQAEQNAKGQLTSARYRMESLQQQLEHKTRNEEWLEQELKTKSEEALKTRKEKGAKIAELQRQNEDAKTAVDAAKRTEDQLRTRVNTAQAKADEYMVKLQTQEGQFASTVESYKAELESQRRLVDMSDQLSKKHQERVRDLDAEKERLRDNYDSELHRVRSELEQEREASKASEEKIRELESQIEQLQSRSEEMPPPGSAPQTPRANGSFAARAASPFGTPGSVRSKSSISATQAIEQLHQTKIQLANEKRRTRQLSEELDGMMSALEAKAPEIQELRNESVTLQTEIARMSELSQQSFEERDTAKRSARKAEAALNTAQSEGKILRSQLRDLGTQIQMLVFNIYALEKGTEKLTDEEAFRLQQLEKGEITEEALQDMSDTHQFITRKLVVFKNIQSLQAKNEELLRITRELAEQLESDEALAAKHQAKEDHDQVEKLQQELMHMTDEARSIKNTMESYKTERDMFRRLLSQRGVGGDESMMRMSLDGRLPLASIESGEQTEALNEALRKVQGEFDGFREAQDGVRKDMRDQIDRLTTDKNSLQTENIKLQGEVRLESERREMLHTNYVALQSENAELQKRSQALSESAARQDIKTQQIAEELIEAKGLLQSVSNENSNLKAEKKLWKDIQDRQSKDNESLIEEKNRLNNLVATQQALENERNLSDAEARRKAQARIETLEQELTDVQRKLSAEVEETKKLQLRKEYEAKESQKRIDDLMTSLSQIREDHVGAKTARDHLQARVDELTVELRNSEERVGRLQPRPTPRPGTTDNAQQQQLETEIAELNEEVIELKRELDMANTHLESAKQQAEQYKELSQGNEEALEDLRAAQEQYRQEMEGLIEEKDAKIRQLTQSMEDMSSELTRSNTELSTLRDSQGEVARKYEDEKTILEEEVNRLKEDSARHLEAARYHQQDLRAQAEIASKAQQDYEQELVKHAEAAKLLQQLRAEHNEVKSEIATLRAEAESAKVALAQGEGSWEDRRQQLEQEVTELKTRREDVNAQNKLLHQQLEGLSAQVTALQQSRNTHDENQDEAMSPVAFGDASDGLRELNNYLRREKEILEVQHDLKTQEAKRLQQQLEYTQAQLDDARLKLDQERSQSSESSKGSMTHQDLMEKLNELNLYRESSMTLRNENSHLKDQIAESNKKVEEMQSRVQPLEAEIDNLKTQKSFLEDEMKQIQEDRDRWQKRTESILTKYGRVDPAEMEDLKKKVTDLEAERDTLKQEEGPLKEKITELESTLESERNNWLASRQKIIEQAKERSRKQTVEKGQLQDQLTSVTGELETARTTSEASAKQVSELEAQVQTFRKQVEELSQQAPVANPEPAAVASAPSGEAGVSAEIVSQLEQQLADVRKELEAVNAQKLGAEQQVANLRTEMEAAIAERDSQIQQLQANEATANSGQAAEQQPGTEASASVQAPTLTDEAKAALEAKIAAAEEKAAEFEKKAAEIEENMAATLKQRSDKMKALMNQKLKDGKDELAEEKLKFEQEKAIWNAENGSNKNGAAPPAKDQAPPATPNTPAKREDAVVPATPGAAGLPDLAQFDDATIRQLLASNQTVKNIMSTNIKKRVDTESAKLKTEWETKVAAARDQAQQLEAKKSALRINMSEAKIRGANAKLGVVETAAKETPEKPVGEVWEIAKKTTPPPAATSNAAGPGAKSAAATPVKPSAAPPAAATPAQQSVTPAQQNAPATPAANGTTPLPQAAAVSQTPTTGTPAAQPNPFAASTNATPADGANPFAVAKTEGSSLPAKPQQPQQAQQQGQQPRSGIPMPRGGGGGGRGRGGHYVAPGQRAASGSQEGAPASTRGGRGGARGGRGGLNPGVQDFQPGAKRPRGDSEVGGGAKRARGAH

SEQ ID NO: 2903 - protein, 413 aa, Unknown
  Kingdom: Fungi, Phylum: Ascomycota
MVIASVVTEEHVALQLLPEREQIVLPHAETSNGRAKPIQHKAGSKVDFGAEIYGIDLNNFTDADFDFISDALHKHKLLVFKEQPEMLKPQQQYRLTACFDPDEKTGGFAHGKDPFLVHHDGTDFYGLPKRPALPVQPQVHILGRGPLPDGHFGFPPGFEVQGIDHEEFHLPPHIPAEEREAGASRFYQWHFDGALYAIPPPRVGCLLAVRTPKGPDVTVRWDDGTNQEMKMAPGATGMVAGSRALELLDEETRNLVMYSNIEYAPHAFLWMSEAHSTRLGHLIETEGLEKPLDQLPPWKPENVCIYPMVWTNPKTGEKSLQVHGQGAFKLHLKDSPEGNVTVIDDLAEVRKFMDKIMKPVLQPENIYAHPHAEQDVILWYNRALWHSITEFPKSYGPRVMHQCNIAASDHPGA

SEQ ID NO: 2904 - protein, 254 aa, Unknown
  Kingdom: Fungi, Phylum: Ascomycota
MSFNTNTTGGKGTGAGEVDMETINNVITATSKTVFGDGSDKKEPVSGAVGDVSKGEPYDAGNLDPEDQKRFETLPTPTPGMENKNPMQVKDDPVAAATTSDEPEPKGDTSAGQTDPKPKPTDTTDHPEEATGADGDALKGPGPKPVAVLAREHGGDAGAAGKEEVKEEKKEDGKEKTDDSQEQGTGEQVVHANGLAADGGDFDASNPGAGREADRLMGEKGIDHGEKDGGKSGSGSTPGKKSLKDRLKAKFHKS

SEQ ID NO: 2905 - protein, 573 aa, Unknown
  Kingdom: Fungi, Phylum: Ascomycota
MRAVTKTGRLQSTALRRSAPALPSRPARSLHSKSHHLSSAEAVPVARDAQYERPPKPSIIEEIALRRVKAGKLVAGVAAASNSDMFKGDTSGLPKAKRWDSHLTRESLERQPCTLKLAAKYLKKPGLISLGGGLPSSQTFPFASLGMTVPVPPNFSEEDTKKSGQQVTIGKYDVRDRPTDDKTTYDLSIALNYGQATGSAQMMRFLTEHTEIVTKPPYADWGVCQTIGSTGALEQALRMFCDKDRGDAVLTEDFSFSTALETIAPLGVKAFGCKIDDEGLIPEAMDEMLSNWDAKSRGSRKPHVLYTVPSGQNPTGATQGTERRKAIYRVAQKHDLFILEDEPYYFLQMEPYTGRAATSEPQQQDVSDFLESLIPSLLSMDVDGRVMRMDSFSKVLVPGSRLGWITASQQIVERYQRHAEVASQGPSGISQIILHKLLDDTWGHEGYLRWLMNLKVEYTNKRNALLAACEEHLPQDIVKWTPPAAGMFMWLTIDHKKHPHAATKSITDIEAEIFSSCIDNGVLVARGSWFLTEKDKPLPGLHFRTTFATASEEQMNTAIERFGEAVKKSFGMK

SEQ ID NO: 2906 - protein, 471 aa, Unknown
  Kingdom: Fungi, Phylum: Ascomycota
MAPKQSTRLVAIGTFVHSQTRQELEFLHDTVICVNEHGKIAKIEKAAEGEDVQVKAQAVIDELGWKREEVDWHVCEVGQYFFPGFIDTHIHASQYPNAGIFGKSTLLDWLEKYTFPMEASLASLPKARKVYNACVKRTLAHGTTTAAYYATIDVAATNLLADLCLSLGQRAFVGRVCMDDEGLNPDYYRDESAEASVEKSREVVEYIEKIDPGFDIVAPILTPRFAPSCSSEAMKGLAKLQKEKKLAAQTHISENKGEIELVAKLFPGSTSYADVYDQCGLLNSRMVLAHAVHITDTEADLIASRNTKISHCPCSNSSITSGAARVRWLWSRGIDIGLGTDVSGGYSPSILEAARQAVLVSRHVAMGVTEGAEKEGTKLTVEEVLYLATRGGAKCLDLQDRVGGFEVGKEWDAQMIGLATVNEDGERDGEGNVDMFGWEDWEERMAKWLYNGDDRNTKKVWVRGRLVHERK

SEQ ID NO: 2907 - protein, 397 aa, Unknown
  Kingdom: Fungi, Phylum: Ascomycota
MSDGRPPPPPDDLDLSATPGYRGDTQIVLNAILIAFSTIFVGLRLYARCFMVKRPGLDDIIAVIALGTLVALSVMEIKLVEFGSGTKIEYVGMGRLANFFNALATQSLLYFWCVCLMRLHIAAFLPHLHNDKRYLRSVYAVAALTLISTLIFFFIKIGSCKPVSALWLPPYETMGQCMSEDTTDIMMNIHSALGIVIDISLVALPIWVIHTKMMFSGRKFRVILIFAVGIFVIITGLVRFILIRITPFNVDATYSMSTIGLWTDLEGHIGLWCGCFPAFQPILRAVFSSMGLSRLISSYKGSQANHYGQSKPTSGSRGWNRSNAIPLSSRPQGTNAASDDASSQKGIFHSNPELSGGDGTMSPNGIVKNTQVEVFYEQRDSSTEDAKGPEWGQDRIK

SEQ ID NO: 2908 - protein, 559 aa, Unknown
  Kingdom: Fungi, Phylum: Ascomycota
MAVTTPAAPAPLPQFSQAVKYNGMVYCSGNIGAIPDTNFEMASGTVKDRTRQALKNISAILEASGSSLSNVVKMNIFLTNMADFAEMNKGYDEFFTWDLKPSDMDLDLEKQAGISAFQFPKRNASPPQPQRPLPRSLPSPEGILRAAINPRKIPSSYGSAGASGELGNYLDIGPCIVNPDANSTTRRQHSWTDRANVIFIDQPSGVGFSHVDNRDDIPVTLYEGSQDLHTFLSTFTSQIFSELANRALHITGESMAGHYVTAYTKHIISRQRESRYGSGLAPLNIKSAVIVDGYIDGSAQASGYYDFFCTDWRGDGRKSPLMNETVCAEMEAAVPHCERLGSQCRATYDGDVCQLAFNWCEEHVGKFFHADVKPGGWNPYDNREDCIEPPLCFDLDHGVTERFLNEEWVQNSLGFSNVSFNLIDFDVGERWMASGKLFLPVTRELSWLLDETDLGVLVINGNNDIIVNTPGQIRLLDTLPWSGQASYRAAPLHNWYYMDANIIQDTEQGELASSAATLGGTSKGDGRLKLVTVDEAGHFVPLHQPEAVLAVLKNWLEDH

SEQ ID NO: 2909 - protein, 435 aa, Unknown
  Kingdom: Fungi, Phylum: Ascomycota
MVVSVFAQEDSSASPYPACALKCIKGAFTEGLCAPTNATCICSNPEFQGTVTACVTESCTIPEALSTKNTSLATCGVQPRDRSGNYAALSNSLVIITALFIITRFVYKIFFAKIDLGKDDWFVLATMISATPSAIITVHGMTANGLGRDIWTLTATQITHVLRYFYIMAWLYFTQVMLVKLSIITFYMRIFPAKGVQRVLWATFIFTVLWGVAFILTAIFQCKPIHYFWNKWDGLHEGTCLSTNAISWSNAAINIALDLWILAVPLWQLRELHLHWKKKIGVAFMFCIGTFVTVVSVLRLQSLVHLAQANNPTWDFYDVSVWSTVEICVGIMCACLPIIRLVLVRLFPILGGSSARSRGNQYYEYGISGNTNPGRGPGVSGRGTVGMVTADRRGSDPESAASGIVFEKTYDVQFSDDEAKLVQMNTLDAKGRTVQ

SEQ ID NO: 2910 - protein, 205 aa, Unknown
  Kingdom: Fungi, Phylum: Ascomycota
MDSRLVPLNQEPKIGPSIATPDNGHGVFTVSCSTLINAPPQKCLEIVLDGPKYPDWNTFCTKVTIDHVPASTESKWDVPPELKHLMTQEGALFPDVEFQFDCVMKVGDAPRKTALRVNRLEAITQNGRKGYRVVWIMPGGNRWILRAERVQEFVVAEDGQDRTEYSCYETFGGVLAYPTRAFVGGQVADGFGRWMDGLKKKAEEH

SEQ ID NO: 2911 - protein, 543 aa, Unknown
  Kingdom: Fungi, Phylum: Ascomycota
MSEPQRTPSKGHTRNKSSIKATRPRSSTKGPLDVDDDPLISSPAPSTPSQLTPGTLNAPRRSTSSARSPPPPASTSSPTPRLGEFRPKDFSFLLRPEIYHPLTPLNVPAAFRNSGKQLNPEASVNELIVKGHFRAAAIAAVQELTGTGHRGQVIPQDAPRIFSLLYTRLACLTLIDATSLAAQEVKALEDLNARTYIDDATGEHLVPWELRVLNVRLQALGFGDSRRAVMSYHELAREAREHISKAMARHDNSARELWKARLHDLGIKVAGALIEMDDLAGASHHLASLPHRGDSKLALSKALLLLQLGDADRARECAKETLGGTEEAENAEVLITALCDMADGEYEASLANWERLQGLDDEMIATNTAVCLLYLGRMPEGRTILEKQIDSGRTSHTLLFNLSTMYELCTEKNRALKMKLAEKVAGMDERPSGWEKSNSDFKLCRSYGWHTLHTAQVEDRQIMNGIWFARLGALLLASAVSNPHLAGLPILVDMQVAHHGLTVPAAATSTAVELECFKPFPGISCFWLGFGCRRPVAGSGSGG

SEQ ID NO: 2912 - protein, 612 aa, Unknown
  Kingdom: Fungi, Phylum: Ascomycota
MEHNHMLATAPQSQSAAQQRTNDTTSSSAVLPQDERLSQNSADAITNVASSLPPSYPYSTGGMATALPMKADPVMLPPLSTVTRGRGLRGDFHNIQQPNSTASWSAIGPVALPPSSKIESPSAMDLDTGTNSVNSNASPDRYDRYGDGRAPSVNLDDPDVRLAAEALGDLRADFVSSPPSSTATLPISPPAVVLHSGRTQSPQQEPLFSLLTTSHPFLATTIGGASSAYGGVKNYSPRFKSGAEYVENYLTPIANTVGSVGRVTGVEGSVRWFLGAGRRNASSSSDVEAPGNSKKRRKIDKEAEMTSNKRLDNETEKQLASSNRELLEQEMYPPTPKGDRRLSLASTVDTLPAYDEMRSPAYTETVEGQRAPTSATHPNQAWQSRLVMSTSGLGVAMSDESLRSLKYCLRWLRWANDHMGGVIGNLKTTLDQYDHHQENGAAQLEETARQEEAVTAEEMALITPEQSRTELAARINLLKGDVLKTLQDVINTVSKYAGGALPENARILVRRHLTSLPQRFRVATMAEHNGPGGQPDSESAMREGAQKVLVLAKEGLDMVSQVSGVLDGTIVSAEEWCERMGKKKPSTDEETQQQGEPSLLPQTEPEADARMS

SEQ ID NO: 2913 - protein, 383 aa, Unknown
  Kingdom: Fungi, Phylum: Ascomycota
MTKIQLWWDDWFALLAWLTGAAWSAVILVWTSTAGLGQKLDTLPISPDEAIRRSLIYTFNAELFYAFSLVCSKYAILGLYWRLFKTSPIRLPIQILFAASTIWIIIRTFMTIFHCVPTQAFWDLTIEDKVCNIDNSKFFFGTTMTHLLLDVAILVLPVVQVRSLKLRKAQKFGVIGLFMFGVVVCVAAIVLIISSTTFKTDSPEMPYDISAIMIPATVEVNLAIVSACLPMMRPIVQRFMHGSPFGSENPSSSGGGGTRVGGSTSTGVKLRTLTTTNKAIELDDDNSSTQNFADRNYASHNWADAETGSSGSAEEGRRDSDGVAGGEFGVETLQGQQRHQEGQQHGVRTGVRTVVSRADGADQMPPDRGIHIKNEMSVSYENA

SEQ ID NO: 2914 - protein, 355 aa, Unknown
  Kingdom: Fungi, Phylum: Ascomycota
MTATSNRACVWVGKRKVEVQQRPVAPVGDNDVLVEIITTGICGSDCHNYESDKVSRQLVMGHESSGIIKEVGKDVKDRTVGQRVAVEPGFACMTCEFCLKGNPNVCANLRYCGMDPTDGTLCQYFTCRSSMTVPIPENVSWEEAGSIQPLAIAVQLARRASLTAHQSMAIFGCGPLGLLILAVAKAYGVRKVCMFDIEKSRTDFAMSYGADAGHVPPKKEEGKDSLEFAQEYAKQMIDELDVGHGFDVTVEASGAEICAQMALCFLKAGGTCIQAGLGKPLTNVPLFLITAKELNLKGTVRFTPGCFADAIDLLARGKVDLKPLITSTYPLTKSAEAFEAQLARKDIKIIIKNQE

SEQ ID NO: 2915 - protein, 301 aa, Unknown
  Kingdom: Fungi, Phylum: Ascomycota
MSDPNNEEAIEAHNNMLRKCLEEDGFYILHQAVSSAKTLRLQAVAEAVEKRARTGIWPHVRTVGKQFPPWNARDAAEHGIWGIQHLMNPKCPFNEEYTEMYFSDVLLDPAKALMECEDEELVMELFNMLVQPEKEFELKWHRDDIPPEATAEEELERLNRPSWHVQYNLALYHDSSLIVVPGSHKRARTDVERAAGPYDKLPDQEEVALSPGAIVFYNNNILHRGVYDPSIERVTLHGSVGHVKGSNLRARNVLQHGVGEWAQNINLSKLDPALAARAEGMRDRLVKMGTESGDVGFSLQG

SEQ ID NO: 2916 - protein, 314 aa, Unknown
  Kingdom: Fungi, Phylum: Ascomycota
MKLLYPTSLKLDTKSIDGFSVSLHPYDVKQKIPEDLIDAEFLVTWTNTDENLRDAVPRMKNLRWIQSLAAGPNDVLNAGFDTSKVTICTGSGLHDHTVAEHTLGLLLNSARRFYEMRDYQLQGKWPGHLGGAQPDRPSDRFTTLRDANVTIWGFGNIAKCLVPSLRVLGANVTGVARSAGVRDGTEVVATESLPTILPKTDVLVMILPGSDSTKNALNSERLALLPKHAWVVNVGRGTAIDEDALADALDAGSIGGAALDVFVKEPLQEGSRLWKTPNTIISPHAAGGRPQGAEVLIAENLRRQLSGQELKNTI

SEQ ID NO: 2917 - protein, 578 aa, Unknown
  Kingdom: Fungi, Phylum: Ascomycota
MDYFRNNGAFAPTSFRLQELAQDAYEMPLRTFANTHDSHPSLAHLCLLVFEAVLEVVCVSLPGYIIARLGHFDADKQKFLANLNVMLFTPCLIFTKLASQLSAEKLTDLAIIPAIFIVQTLISWVVSILVAKLFRFNKRASNFVTAMGVFGNSNSLPISLILSLSQTIKGLHWDRIPGDNDDEVGARGILYLLIFQQLGQLVRWSWGYHVLLAPKEKYEEYQDEIAEAGDYRREDEAHEEHETRPLIDTLDGETEDEGDHDEHSVDSHGYEPAGRTPIAGASHASLAELNQSSESLPKKKLAENPTALGGNHPMLNGVNSDMLSFPRINNDDDAEEPEPQDQGYIARAKYRFRHKLAVLNRKASNTAQSTYESLPVPMKKVLSFFKLMWAKTYGFLWEFMNPPLWAMLLAVLVASVPSLQKLFFEDGSFVKNSVTSAIKSSGGVAVPLILVVLGANLARNTMAKEDEIIDPEEEVIGTRLLVASLICRMLLPTAIMAPLLALTAKYLNVSILDDPIFIIVCFLLSGAPSALQLAQICQINGVYEKTMGRLLFQSYVIWILPSTLVLVMMALEVVEWAR

SEQ ID NO: 2918 - protein, 329 aa, Unknown
  Kingdom: Fungi, Phylum: Ascomycota
MTILQFDLATSSDQPKPMSSVMPESPASPRGPGEPIYSVEPLAAHTQTLILLHGLGSNGEKFGKELLETGIISSGLTLPQLLPGARFVFPTSKRRRSSAFGRSMLTQWFDIVNLQDPEVKKEKQLKGLEESAAEVMTLIRKELEKVTPKNLILGGLSQGCAMSLAVLLCLDHPIGGYIGMSGYLTYRADLQSALAVEEEEVDEDDPFAAPEVTGERPHPSVQAQMFERDLLGLEQLEDNNPAKTAHRTPVFLGHGVKDEKKPLAQGRAAAQVMGDAGYEVQWKTYEDLGHWYQIPEEIDDVVEFISSKVGWSISRQIEGDVDQEGHKSN

SEQ ID NO: 2919 - protein, 463 aa, Unknown
  Kingdom: Fungi, Phylum: Ascomycota
MRTKLVSASAGALWLSIITSCLASPLQPRQDVDCSPSSSSGLKAECWNALGMDQYITDWMAANGTAAGCDDLGFAQCYLQFNGLTTLTCDLITSSTCPPPSSTVTYFSDQHFYTLWNIYAIYQFFNQYSAALSNGVSLAGQTVDKIVATVAPPVEAQQPASTLMNVLSSTLGVVSLFTGVIPGGGGPAVSLIHGGLSQALSLSQNLPDTLVRPSQTANDRFIQLGDIGSSLSTLVTDYQVNLLDTVALIQRDHQAFLAACSEGGFSQRVTTSLTIQSNELFRQLQLFTLSIALKANGLVSAKSTGVDVLQFATETDEISCEALTTPGDFCNQWWVDGEGNTYSFHNPGDTENTHVDLTKTIIAEGWATLDQVFKMEECAGADPTFDPATLGVSCIASHGFCEWNYQPTLAETRAEPQFKNCDNDPNWGFLCSSFEERILVPESYLGPILKADRNGFAQMCKRR

SEQ ID NO: 2920 - protein, 251 aa, Unknown
  Kingdom: Fungi, Phylum: Ascomycota
MGLLETPAGQATLWGCAMSLFSSVVGQLITGSENDTGYSIDWIPVYRYLLFTLISTAPNFYWQDFLEKAFPQYIQPLHPKKTDEKEPAPPKFSWRNTLIKFVLDQSIGAVLNTIAFTTFFNAMRQAMDPCPIFTSPFKAARYWVSPGAIDFGKVDTAEVWAQSVEQTWPIMKAGWKLWPAVSLINFTMLKTVEMRGIVGGLAGIIWGIYMSIVARGSWFTRHTSVVQVLEIRTGDDVECTEEPDQDGWYKP

SEQ ID NO: 2921 - protein, 1270 aa, Unknown
  Kingdom: Fungi, Phylum: Ascomycota
MLRVKSKVSSNRRAVTLRPKDYDHEIDLVDHDGSASRNQTRESADDTIEVSRSSTNAELLQQSGGGATTDEDCTTDSPQTSRTNNRPRDDARRPSNEREHEAGPLHDALRPTISVQEASPGVFRENNANVVPKKPRIERETVIDILYENERGGFLCGAALFSAAALGGLDATPWTNAYHNPSPTSIHTATVPDPSWEWVWPEWRINHQDEMDEGGWEYSFAYSKKFSWHGPKWWNSFVRRRAWIRKRAKKSEEDISADMHLLNADYFMIRPASTKQSYGSLASSKSASKAPSMSQDSSVSGEPFVLPEIQDMETLTRFLRKGRIDREKLEAVENYLENGLDLEQLTEEMHSIMRIFVFQASRRLLLSHLMHIYDSATEELKKKSENDEGLESRREALRKAIKHADEEVRKLAYWSDVKQMAENGETGVMEERKGWDDEEWEGLDQSGPVRLHHEPDNLDLRFAHDHSSSDSNAVADSDAERARLSIMAANAGTLCRATATLRWRITRVSIPPRTTFLSRQDHRPLLRRNYAATSDVVSGKWGAIDDPVEKLQEEQEVLGEPKDEASNDGAKVDTSARNHRFRSIFKARDEETEALVGIKLKGSPFVPDIRTYPNKVSENINYRKAFRAARVQVAQDKIWEHHGQSTPTLNKILDTMRSMSNKEDDGPQMEAMRVLLPDKVDFALPSRRLEYVESATGLLAKLSVSVDHPNPDRGIVLRGKGPLLARAADEMIHYNKDIKVFRLGRVTTFDYDTRQLWPSLGLDDSKTRSLKDYEAAMSGESDNIWLHREGAPKVIVIPYEKISKPKTWNKISFHKYISSLIQSRLKTSLITRIYGKAADADGKRIALMMETFENPELRHCITPATLNQALNFIMWRGGHRATGERLFNLAQEWGVPIDTTTFNIMLGGYVTIQSSAHFHRILKKMHAGFYAPNTRTWLHLLRLVEKDDARRSIIVNMYDHGAFSDPAARREIAKVMAPHDLHVALRTSQSLTRFCDNQAEQYGVDWFTIPTLVNIIDEFFMFYDDIEGADRGKFEELLTLIKRQPDDGDRSFEKPVLAMLQAAIARKNWDIAIAALRIHKEFGCEPDQDLYAALVDLAIVTQTPHVLGALLIHGLLTDMLPWRSRRHLQRCLLATHPLAFWRRVKLHCFTSDMQKQMLDRDWASEEHPIELVSDIIKKSIRKDTLPTDSIIDIVTREYQEHDVPWTNMYRSNLEGEKLPEFSPLVLRFETMKGQHKGISFDMRLTRWVFTGGATKTNNAVLEDIAKQEDL

SEQ ID NO: 2922 - protein, 211 aa, Unknown
  Kingdom: Fungi, Phylum: Ascomycota
MTPKLIAIVALLGLGCAQDVRTVTVPPAIPSNEPSYSDFQDFTSAVLNSTNTYRDQHNASSVSWNSTLEDFAQEYLDDMDDDECEFEHSGGPYGENLAIGYRNSTAAVEAWGDERDIYDFDDQGFDEETGHFTQLVWKDTTDVGCARKLCDERGWYVVCEYWPRGNVQDQYDEQVEENDGDDDDEGMTPSMPQAKLFTVFFMMGVCILFGI

SEQ ID NO: 2923 - protein, 762 aa, Unknown
  Kingdom: Fungi, Phylum: Ascomycota
MAAAPHGEQVYATLLLSDSYLPGALVLAHSLLDAGTSKKLVVLVTLGTVSSDSITQLKAVYDQVIAVPCIRNDHPANLYLMNRGDLHSAFTKINLWRQLQFSKIVYIDADIVAYRAPDELFDLPHAFSAAPDIGWPDLFNSGVMVLTPNMADYYTMSAMADKGISFDGADQGLLNMHFKNDYNRISFSYNVTPSAHYQYVPAYRHLSSTINMVHFIGSNKPWFTGRGARGDSPYDDMLGRWWAVYDRHYGSQNQKDDVNQPSPQYVQYFTKGEWQPSVASAPTTSGDHGQGQGPVSSTGNHDSQSSSSASGYDISASGHEQSAATGVSAAHASRAFPSSDSAAHHPGQHAETRSETNRSGQQDEGTQAAPPPPSSHEHKSEPQQVGSHSWDAQWHPPPVDSKPEAANFPKTHYEMSRDAAPFVPPVRYPSPPKNMWYEVPKEPPTPTAQRPRAIFPWEINQPRASRTFAGEPEPSVDTREFGETWQTGGPASRTEAISTARSDTAETKSEPPTPSTPTIRVTSSDPWGSFSRQNAWDEVPEIGRYVDGLQKHRRGKSQGSAGVTSPGVQPATPTGSGLRAKRASFKLTDFPTEVERPSLPVTPAPIHRGSYWGEDAAKPGDVKPGEKLPVAEGVPAQSEWDPVAQLQKLAKQQSDMLLRRLGGDESGDQSREIPSRSLPFGSEEVKSGAPGMSPDPSATASRGIVHSPRPLDQQQLPTTSTWHSRRTHAWAFSKAKAMGALRGDISELKLEVGFTSICLPAS

SEQ ID NO: 2924 - protein, 341 aa, Unknown
  Kingdom: Fungi, Phylum: Ascomycota
MSTAVISADDALEPSLQTLLDQRSLRWIFVGGKGGVGKTTTSCSLAIQLAKHRRSVLLISTDPAHNLSDAFSQKFGKEARLVNGFDNLSAMEIDPNGSMQDLLAGEGEGQEDLNALGGGMGGMMQDLAFAIPGIDEAMSFAEVLKQVKSLSYETIIFDTAPTGHTLRFLQFPSVLEKALAKVSQLSSQYGPLLNGFLGSGGQLPNGQNLNDMMEKLESLRATISEVNTQFKDAELTTFVCVCIAEFLSLYETERMIQELTGYGIDSHCIVVNQLLFPKSGSDCDQCNARRKMQRKYLDQYEELYAEDFNVVKMPLLVEEVRGKEKLEKFSELLVKPYEPPQ

SEQ ID NO: 2925 - protein, 1351 aa, Unknown
  Kingdom: Fungi, Phylum: Ascomycota
MSESKRGIRIAIDRGGTFTDCVGEHNGEEIIIKLLSEDPSNYNDAPLEGIRRIMGHFTGRDIPRGEPLDTSKIESIRMGTTVATNALLERKGEKIAMVVTKGFKDCLAIGNQSRPKIFDLAIRKPDVLYEQVVEVDERVTLEDYAEDPYRNTTKTEAKAGTEEAKDKDLVQGLSGETVRILKRAEEADIKSKLKAVYNSGIRSIAVCLMHGYTFPDHEQLIGKIAKDIGFEHISLSHELMPMIKLVSRATSVCADAYLTPAIRKYIDGFSSGFEGGLGTRSVKEEKGSRGARCEFMQSDGGLVDVEKFTGLKAILSGPAGGVVGYAITSYDPETKTPIIGFDMGGTSTDVSRYGEGRYEHVFETTTAGVTIQSPQLDINTVAAGGGSRLFFRNGLFVVGPESAGAHPGPACYRKGGPATVTDANLYLGRLLPDFFPKIFGENEDEALDADASRKVLEELKEQVNKETGKNLSTDEVAYGFLTVANETMTRPIRSITEAKGHDSSKHRLATFGGAGGQHAVAIAESLGIGQILVHRYSSVLSAYGMALADVVDERQEPESITWGDNAVESLKARMEKLKEKSRTSLNEQGFDDKEIAFEEYLNMRYRGTESALMIVKPTEDEAKEFGGNDWDFGHAFVKQHRYEFGFTLDDRDIIVDDVRVRGIGKSSRHNERTVDQQLKEIQRQDVKEQKHGSKKVYFEGGRHDTPVYKLEDLSIGDVIKGPAMLADGTQTIVVTPTCSALITETHVIINIVDSRKDDTHDTSEVDPIMLSIFGHRFMAIAEQMGRALQKTSVSTNVKERLDFSCAIFDASGGLVANAPHLPVHLGSMSTCVRRQAEIWKGKLEKGDVIVSNHPSYGGTHLPDITLLMPAFDAKGENILFYAASRAHHADIGGISAGSMPPHSKELYQEGAAIRSEKIVSQGKFDEKRVTQLLYDEPAQHPGCSGTRSLGDNINDLRAQVSANQKGISLIKTLIEEYGEQTVQFYMVNIQKNAEDCVRMLLKDVYKRFEGKDLSAVDFMDDGSPIALKVTIDPGKGEATFDFEGTGPEVYGNINAPQAITYSAIIYCLRCLISEDIPLNQGCLKPIHVKIPPKSILSPSPGAAVVGGNVLTSQRITDVIFKAFDACAASQGDCNNLTFGFGGNQTGKDAVKGFGYYETIAGGSGAGPDWNGTSGVHCHMTNTRITDSEIFERRYPVILRDFSIRPNSGGAGQHHGGDGVIRDIEFRIPLQVSILSERRVYHPYGLHGGEDAACGLNLWVRKVEKTNWERSMRGIHGGDEEAGEKEYEEREINLGAKNSAAMEAGDRIIICTPGGGGWGMVGDESKVKNRDDHRDRWKKGSGAARDDTALQA

SEQ ID NO: 2926 - protein, 563 aa, Unknown
  Kingdom: Fungi, Phylum: Ascomycota
MQAFHKHRPSSHFIAPHSWSNDPCGAVYVPETQEYLLCYQWNPGTTVGGNCAWGMAKSKDLVTWTDCPPAIWNGTSYDRHGVFSGSIKSLLIEGKRVLLLFYTSVSAVPIHWSKPYIHGCESQSLAISTDYGRTWSRHQANPLLSTPPKGSATTGWRDPFVSQWPSLSQLVGAPDATSYMILASGEREKGPQLDLYASSDLQSWSSVSIILDAEAGARISPTSPLSWGVNFECASFFTFVGREYLIVGVEEEDTTRRHNGHCLLWLSGNLILESGKPRFQIKGHGVLDHGILYAAHIFRDAQGRLLQLGWADEAAKPSTVSTQGWAGCLGHPRELFEVTRPISETCRDLDEWVVDEENGTMTTLGARPAPQVDLLRHGSGYSQLSDLDMVHSKQVDLSATFSDLNGNEKLIFNVLASADMSEATSITFDVAANKVIIDRSRSSLTNIGTNTSEVGHVHLLPGEDLQIRIFVDNSIVEVFVNDRLSLTTRVYPVLLDSTGISYGFGDFDEKKIELEFWTDLKSAWPERDSGIHILEELHPLRPVAKAGETITTNELHRTAEVPA

SEQ ID NO: 2927 - protein, 1223 aa, Unknown
  Kingdom: Fungi, Phylum: Ascomycota
MSQFSATGSKNPTPSSSPPSDSPPLKSDPSFAGTNGNPFPSQNHHHTRPITPPLAPDYAVSSEQSPSFHVRSVSASGSPARGHQRNSSRPRSMVQTYQPPVMDIEDTIPELQPIFSFLNSHSNKLYQEGYFLKLDDQNTQGRANPDRTWTECFAQLVGTVLSLWDAGELDAAGEDGEVLPKFINLTDASIKMIESLPTRSNEEQPLQNILSISTAGRNRYLLHFNSHHSLVQWTAGIRLAIFENNTLHEAYTGALIAGKGKTVNNINVIMERARFKTEEWVRVRFGAGVPWRRCWCVISPPDEKEYAKLQKELKKRSPYDRSPVPVLKGDIKFYDTRKDGKKQKKAQPIASITDAHAAYAIYPQAKSLVDASTLLKIEGQVTIHSDPPSASEGFVFIMPEVRPAVTGFEMLLRFLFPTWDTFGLYGRPGRLIASTLDSRSLMYAMPKHKRYGYLEILDVTALVTEDGSTGWTEKDWRKRLKEATGSRMNAIEDGTRSHSRSDSRRSNRLSYSGGNGGAASRGKVGFAEEQPGVRSSRSFSLSGQQRADSGPDGRPQASMGGAQQGHARNSSDPSIMASAPPPQNDYNGNANPYSSSPQRSQQMPLRGILQGRMGSGDGMSGSEDERGPTPPGHDFNGMGRMQTPEPVQRPPAFNHTSSGGGQQKNKAYHSPALRRANSRLSSTTLAQLAKAGGVALPRDASQEEITHGRYSEDQRTGPSVQLQHAAPGGMSANDNRSREAMSPPGPAQGRSGPAYPAPLNIPNQQSRGPSPSNAPPSPYGPGPNSPAYPPQEGRRSPYPPGQGPPPNGPPQGRPPHPDGRGQPPQSYRPGPGSRPGTSASERSVQMGVPSHRKPLPNHTGGPAYGAPGPVDTNDILDSYGDDPGPARQHPYRAPPGERMGPPTPQGSYGPYGGESPGGERQRPGVLKTVGGGEQPLQGRSEVDMNFGPTVNYGAALRKPAPGGGPMPPHAQQQRPYSPAGQRPNEGQARPRGPPENEERSRPWKPAAMAPGGPQQGVSPEQYVQQRAAAAPQYGHARSPSGDALAESQGGRPQHNRRRSSFGMLDDGRGQARDMMNRPSSQGENGSHMSARDQEYMARMTGQPLINVGANQRQNTTGGAGLVGHIDARERERQQMRQGANQQAAQQAMAQRQQQQAAMHQQMMMQERNLSPAPGYGTPGSFSRPMGPPSPHQPNQQFMPPQGQYSPGQQQPPGAYPQYQGQAF

SEQ ID NO: 2928 - protein, 1345 aa, Unknown
  Kingdom: Fungi, Phylum: Ascomycota
MTPPETSDENHPPRATRPVLPGEDSNLDSSQQQYQSKDAASHHSRGGRFLREPVSQSLSGRRSNSQSPFRLEMPALSPAQLAFSAMQYLPVPVMILNNLKTVVQTNEAMARMLGLLVDGTEEDSSIVLDQLRGQTLSQVGIDMLQDGRPVWLTWDTFLDAMVDEMGIRGATGDLRRSPSDHGDATPTAAPRPSTNTPTSGATPAAQNAVVEVIITRKKMPKPTSANKPKGSVSSQHIYAKMIINIWEVEEKQPFFTLTFTSSESRPSSLVQSKKSIARPSLLEAADRPTITNSNSSSVTSSRDSNSPSFHSPGIVTMSSSPLPPMGPPAMASQSSTPSVLQKMLLIKDALLDHTEMPILAMWRDGSVTFPNKAARKLFGEDSDSGTSSDGFTMMQGWRMWNEDFTHQLEPEEFPISILIKTETPFSNMRIGTYHPEGHKVVLDVLGEAIRDDNTGEFLAGVVTCRDVTTMTEEIVQIKERDEEREEHFRLICDTMPQMVWTATPDGMHDYFNSGWYEYTGLTENESLGLGWQTPFHPDDLAEARPRWLRALETGTAYEVEYRCKSKEGEWRWFLGRAAPACNKETGEVEKWFGTCTDVHDNVQTKIAAAQTREQLLSVLKHSKVTLFTVDTDRHVTLLEGSLIWDKAEELSKSNRWFIGQNMYAVFNRLTDQLPEGERPEFLQPIEDILDGRIFEGVREHRIDDQWYRTRFIPYHTQGKIATHDTTAGVIGVIMDVTEIRRREEALEKQSEEKRKAIANEAAAKEATRLKSQFLANMSHEIRTPITGVLGMAELLGGTGLDESQRDFVDNIQSSATSLLTVINDILDFSKVESGHLDIEEVQFSLSLIVKEVGKMLQFAVERKNLDFRSDIGGDIRNDMVVIGDPGRVRQIITNLLTNSIKFTNQGYVRFSVVKERETADSVEVRFTVEDTGIGIQEEVRKRLFQPFSQGDASTARRFGGTGLGLTICKNLLDLMRGRITLRSTLGRGTTATFWIPFHKPSSPQNSKTVQVGALPDRLQSELSLSCNSSEHDHHGRNSPVSTDAQASPSKSRSRQALREAPDAESEPSKVDRSKILVLVVEDNPVNQKFAIYAITKMGFQVKALWNGKEALDYLLGVIDGKNVKPDIILMDVQMPTIDGYKCTHILRHHMPYKALVHDVAIVAMTASAIYGDREKAFKAGMDDYVSKPVTGSIIEHMITRWTTMRPRKGISSASTDISTSDCSELSEHCENADIPGTGIDDNAFVFGDDADAGIDYNSPITPRPLNTNGGPEPSPFDNIDAYQQQQVRRQEGEKEWTNKLHENKMLEAAGGVNAVRASQTHDEESRERLTEENVSKLMEESEHPR

SEQ ID NO: 2929 - protein, 614 aa, Unknown
  Kingdom: Fungi, Phylum: Ascomycota
MDFEDLAFHDYSLLPNLDEPDYWINDAFSPAAASQPVVQSPESDGIKGLQYTQSRSQRQPRSLSRLGFSSETPSSAILPDVESQAHSTGSPSDLFIEMTPISHHLSASPLDSNSLTPSEHSHRSQEAPPPLNTIADYGTKLVEFYFKDAASIMTVFDGNLNPFRTVIGRLWTSSNLLYLTIKSLSAVFLSNIYPQMAAIGVNLRREAISILVGLKEDEMDEKDLLALFMIGGTASWFDADDIGQEHFTIMIKSIQRMTASGQIASTSNNRHFFKDMLVCWRMFLAFIDDNAVGNEDDDDLRLGLDTLPSNRGLHQPASLEFPTLVVPHPLTGVASGAQRYLIEIGRLVRRNRRLVHDRRLEWTNRATVNELDEQLKAAKRLESDLFKLRVPSVEEIVDTGDARTPTWHLATLANVYRNVGLLLLYRVFSDVRATSRERLSKARSNHSTNLEENERGDSVMETLHGEDDDDAEWLRSLALRIVTALSSIPIDSGTKDFHPFLLVAVSSDLPILARKQPQSSTASDYRGQGRHHNHSYGHEEVYQESQELPPSALDVHGARAFVLSRLQSLQSALPRRPVKRCIDLVKAVWDSQGEEFCPFWMDVMMQNNWETFMA

SEQ ID NO: 2930 - protein, 440 aa, Unknown
  Kingdom: Fungi, Phylum: Ascomycota
MYSITSTANPLSALDLPLPPAPAPPHTLLSKNDLAKSQEAYSELLSSAKAYRTALATLSTAASTFGSALEACARLKEARADPVGPPGATSMSASFTTKGANTADTLMSASGVHHLIANHQQILSETVYRSFEVPLLHDLDRWQGVIDDEEETYKQQIKVQTKEIKRLEKEGLKLHKQRRRDVARFRAHLVNLTSKLDGLTTTHSDHARSLLRESQETSGRIVEASCSLVRAEVDIFESLARKGWSGGGLDDLLEKGQDLFATEHTSGQHASAGLSGHGSGETAKLFSILPPKSILADSASDTSRPGMTHARSDSLLVDTDRYQSLTAVASDVRPGGDADSVFSADFNRPRGARPFSPEPIRRIPAAVTDDELGMMGGFGDNSHVRRDTEEAHEQKNEDDKPTEEDVEDKPSPPEEEQAPESPRGRKSPEFITDESSPDGS

SEQ ID NO: 2931 - protein, 1132 aa, Unknown
  Kingdom: Fungi, Phylum: Ascomycota
MNRAKKRELRAQNEKAWDGVQDVLQVSNTLDSSLKKNTAFIKRLRTAVTPATLNTFLQEIRSLSLRKYISEIISACYEGLCKLKTPGEIDAGVEIVSALHQRFGPEDFTEQLAWLLGKGMATPDKSYLKTLGTEAREREEKERLGRQRALLRVVTELWLVGVLRTLDDATKPEDASMGVAAKVGELKPRSTSNKTGTTEPFPLEVLKDLLGHDREHANLPLLAIFVKAFSWDVLGVQSHTTEGRKVIEEDAAGVEQLIESTEDEASPGTSDATDQPLTPPDVADRFKNILKRYFEDVKGHVVRDQKSIQSQARRNAEAYVKSGEVFEDRQANYERQLKAQERLISNAQVIADAIGAEMPELKESDDTLGASNTSVGLLKTGEYLRSISDGAGIWADEDERRFYESLVDLKGKVPPILLEDGKKKKTDGDDQVGKKTDGDAGENSKSTDVADDQSTTIANKTIGAQVDILLSRLPELTNEEAIDQTAIDFCYLNSKASRNRLIKALTEVPKGRYDLLPCWARLTATLGRYMPDVPKGLVDYLDAEFRSLQRRKEKDFLGQVRLSNIRYLAELTKFGVVPEHVVFHCLKVSLDDFSRMNIEILCNLVENCGRYLLKNADTSPRMASFLETLQRKKSVQHLGHTERMLIDNAIYFVDPPERPAIEQKERTPMDQFIRKLVYLDMTKRNYGKILKQIRRLHWEEPEVVKILEKVFSKPGKVKFGSIHLLAILLSAIYRYHPDFVVRVIDSVIESVCFGLEQNDFRFLQRRIAEVKYLSELYNYRMLEHPVIFDVMYRIVTLGHGGPPVTGRFVALDPPDDFFRIRLVSTMLETCGVFFNRGAAGKKLDYFLSFFQYYIHTKISLPMDIEFAVQDTFALTRPQWKLAANLEEAAKVFQLAVTQDQKSAGIDKNTDADDAMSIPSSDDELADGDELDHDDDGDDSSTSGDEENEEHDEESDRGSDYDHDDEAIVVTRPEEAVDPEDEADFDREFAKMMAESIESRKFERKQQFDVPLPMRVKAREGPGADGDGAADSAPVGNPTMAFSLLTKKGNRQQTRTVELPSDSTFAVAMKSQKQAEKEEQQRIKNLVLNYDLQQSDEPESSERPSTFHHNRVERLGKDRGQRVRKLQLSDVDW

SEQ ID NO: 2932 - protein, 1538 aa, Unknown
  Kingdom: Fungi, Phylum: Ascomycota
MHPPSSPSTARHPHRRYRAISASGPSTPRYRASHSEPEVLSFPIRTSQHGGSFSTRTLHPAYTQGSEHRLRRKTPKGTIEAAYDASPPWRIDGPPPYKQIALSSSSLLSSDSSNTPVQPFDIGLQAPDLALLVPRGASSNGWASTWSWHSCPEPCPPLHSDVVRTRSWGIPPGMPAANTQNTVQPVQPVQPVLRANEYNVRAFCPPPMPSAPTLPFGQPEWPAAHWHTDWGHPSLADSLVNTPYMPSLANISQFPGYTSPTDGAWVAQGWAHPETVLHQPMSATGRSFGRTHSHSNTVHVLPQTGFRDKVLAQAHVHYMELLSYMQASRRSGQSQDGQAGRKAVKPFLYPKPPNPSYRGPIHSRKSAKSSASTLSYGDHFAIPNCVVSDAPHTKHASSSAGVDLDSRSSLQNEPRKVVPCQLSELTNMSPAPIEVDPISNASSSLNLITNLCEQSNWKWLEGMLLGGCLLYGLERYGEALKWFSSILSSDLCHVEALTNAAAALYCLGRQHEAEQHWLRAVRTRPAYLEAAEHLVGLLYRRRSKDAVQVISFVQRALKIRPPETLRPSQHDDATKGSAAPLVNQQLFCSSANHQTVPTPDYQPGTRATDFGSSGYALADRENGRILALVHAKATLLYGLKDVNGAAEAFEEAVLISVGRDMQDVHHLVGCIHAVLRSSEHTRRSYDPYFKATQPLLLTPERARRTARLLFPSSGDLPGLRLVLDGHSKRAAIQTTSNSLLSLAKILQDAISHGGAAPSLVTRPSGIGDILALYYLSLSLQESPSTANNVGILLAGVQPELSTPITNDSEKLSHPTIPGVPPGSGLAMALSYYQYGLKLDPKHVHLHTNLGSLLKDIGQLDLAIQMYEQAVSCDNTFDIALTNLANAVKDRGRIQDAIAYYRRAVQSNPNFAEAVCGLFTALNSVCDWRGRGGIILPDRSYDRWHVGEDGTLIDAHVQPQSRGLALRVREIVTSQLQEASQWGMHTLDDHSTDELLGQFSDLSQDEREILIRALRKWTGKPWEGSRLVRLVERTCRVLQRRSYLVQQQAKLSGSSSQQCVPAQRSQYRRPRLPPSLTVPPAPTILPFHTFTCPLTPGEVRAISQRNAVRISCSTLRATWLPKHIYPAPSAPSPVLNVGYISSDFNNHPLAHLMQSVFGFHNPLRVKAYCYATTRSDHSSHRIKIETEAPVFRDVSTWSPGRLADQISQDNIHVLVNLNGYTRGARNEIFAARPAPIQMSFMGFAGSLGAEWCDYLLADLTAVPPETLRPWRANTELSDLLVDDSESSHGDWIYSENVIFCRDTFFCCDHAQSADEAEHSVTWETEQKRRWVMRKSLFPTLKDDMIILGNFNQLYKIEPTTFRTWLRILDKVPKAVLWLLRFPEPAPKSQHISRARVCDLFLDTPECNAHTTAADVLWSSTPLLTLPRYPYKMCSRMAASILRGALPKNDAGEAAAQDLIASCEENYEASAVTLAAGLTYDTTNGVVRGAGRLAELRKLLWDSKWTCGLFDTRRWVADVEDAYEEAWRRWAEGKSGDIYL

SEQ ID NO: 2933 - protein, 1415 aa, Unknown
  Kingdom: Fungi, Phylum: Ascomycota
MASKAALKSINDAISNQQYEDAISKAKAFLEREPKNYQGHVFLVFALEKQGVLDEAERVCQAATELKPQDPRAWQGLVKLFEKQGAKKLVDYQQVAIRLAQIYHEAEDLYKCSVVVDKYVDFVRANGDPTQYADALWIRLPESPLYPILEGRFPHPAKTYEAVAHILEDFEKKRINTLVGERRTRLGARLDEVKLEVKREVYGQSKLEHIYRQLINWTSDDDVRRQFEEKLLRYCYERLMASASGDEKQEWQQKVLGLANDMVVIRHPYKLAWDIAIDWKDEKEVKSWDVEVLRAYCSFFPDSDMAKIVTAYLTSTLSPFPKEAPKPSEAELSDESEDDEDGGVPTAYVPLTDEERLLMITEGITTADSTLAYRLAGEYFLSVGEYEITVEFMRKGKELLIQERRKSGLSFLNTEDAYSLALGTALVYYQSPRNHQDAKALFDKVLERDSKSTPALIGVGLIFEEEEEYDQAIDFFARALARDGTNIRVRSEAAWAKALKGDWQAAKDELEHCLNLLEEKGRMDKQLLADTQYRYGSCIWNLEPSKEARKRRKGECSYGYWLKALRSDVNHAASYTSLGVFYGDYAKDKQRSRRCFQKALELSSAEVVAAERLARSFAADGDWDRVELVAQRVVDSGKVKPPPGSKRKGISWPFAALGVAQLNKQDFHKAIVSFQSALRLSPNGYHSWVGLGESYHSSGRFIAATKAMINAQKLEEELGEQIAGDAWFTKYMLANIKRELGDYDDAIELYRNVMETHSAEEGVVLALMQTMIDSALTSVDKGLFGKAVELVTETISFASATSPEVRQTFNFWKSVAEACSVFASVQSRVADFPADKVKAIVEGAGNEGFENLAKVDKVSLEALFSQEPERANVKANLIRCTHAMILCHKQAIAISAADLDAQAIGYYNLGWAEYRTHVCLGSDSSRKASSPYLRGAVRAFKRAIELEAGNSEFWNALGVVTSEVNPSVAQHAFVRSLHLNERSPVGWVNLGTLALLSGDTKLANDTFTRAQSADPDYAHAWLGQGFLALMYGDAKEARALFTHAMEISEASLLPARRHYSASLFDHILTAPPGLTVASLIQPLFALSQIRGLRPQDLAFSHLSTMFLERTHDSVRSVDYLEEICTVAEADYEETESAESLGRFTLARTDLARAYLAAGSYEKAMECGEIALDLSSDDSGSELTAEQRRQARLSAHLTVGLAKYFANSFDEALTFFESALEESNNNPDATCLLTQVLWAQGSESSREKARSALFEVIESHPSHIQSILLLGVIALLDNDEDSLEAVTEELLGLRTNDKVTDTEQSHVGEVLRAIATLGEGKTQEDLVTQVQNDVMLHPYLPHGWSSLAEVTGDSHAAQMALKVARRGIPPRGVLGCQDLARAHAGTGSVADAQRAVLLAPWESCGWKSLETATVSL

SEQ ID NO: 2934 - protein, 454 aa, Unknown
  Kingdom: Fungi, Phylum: Ascomycota
MRFQPRQSCVLLLALASAATALVADSIDPRAEAAAVQDPRDVPNPNAPIDGKDGVPHTGPFVTTDGDGAEKPGTPELRAPSEKIDTTGLEGGVSAKEETATGEKAPAQPEAPKEAPPLPHSEEEKLRDGPGGLDDTLVPEVDASKDSAYEVIDSDIEEEGSQESLEANPKTPSDSGTSALDGHGDEEGGIQPFHSFVLSFTMIMFSEIGDKTFLVAALMAMKHDRIVVFTAAFGALLVMTVLSAGLGQVVPNLISKRFTSFAAAILFLVFGAKLLREGMQMDPSEGVTEEMHEVEQELAEKEKELGQRGPHALEMGINGRASRSKSRFASPPRSPSQSPSRGSTSGVESIKSALQGASNLFSLLLSPAWVQTFVMTFLGEWGDRSQIATIAMAAGDDYWGVTLGALVGHSICTGIAVIGGRAIAGRVSLKLVTVGGAVAFLVFGVIYMFEAMYT

SEQ ID NO: 2935 - protein, 546 aa, Unknown
  Kingdom: Fungi, Phylum: Ascomycota
MRLPQGSKSALRTVSRAQRTQCLAPRSFTTSARLGYFNYDQSHATISNIKDTPNFIDNQFKASAAKEWFDIHDPATNKVVNRAPQSTQDELDAAVASAEAAFPEWKATSVLTRQSIMFKFVSLIKENWDRLATSIVIEQGKTFADAKGDVLRGLQVAETACGVTTQLLGDIMPVAKNMETKTFREPLGVTAAICPFNFPAMIPLWSIPLATITGNTLILKPSERDPGAAMILAELVEKAGFPKGVVNVVHGGKPTVDFLIDNPSIKALSFVGGNRVGEYIYTRGSAQGKRVQANLGAKNHAILLPDADKNHALNAITGAAFGAAGQRCMALSVLVTVGESKEWLGELAERAKQLSVNGGFEEGADVGPVISPESKERIEAIIGRAGSEGASVILDGRDQLPSQYPKGNFIGPTIIANASPSMECYKTEIFGPVLVVINVSTLEEAIQLTNANEYGNGVAIFTSNGGSATHFQNNIEAGQVGVNVPIPVPLPMFSFTGNKKSISNGGHYFYGKAGLNFYTQLKTVTSFWSCKDAAETKASVNMPTQQ

SEQ ID NO: 2936 - protein, 789 aa, Unknown
  Kingdom: Fungi, Phylum: Ascomycota
MAPEAKKRKLQATQTPSSKRPKNQPKKQSKSKSKPAPRAVVDPSSLTWESLGEEFGGLEVIRNVEVIRDGDRVQFAIADSNDTTKETTSADKPDDNAEDDSFEGFGDNDLEGQTGDSSESGAGKTGVEGEVSEEVDNGRKQKQDKKQKLEPKKTGKKQVAVQEQEDEQLVSPKKNVQKSAPRSNAFDALADVDETVGEEDDGPEVDVKAWAALTLSEPMLSAVSELKFEKPTKIQAEAVPKIMAGEDVVGKAETGSGKTLAFGIPMIERWLELREQPGYERKGPLAVVLSPTRELAKQLGDHMKALCNGLPGNRPYMCVVTGGLSIHKQQRQLEKADIVVGTPGRLWEVLDGDMKLQDAFTGIRFLVVDEADRIFKAGQFKEVEDILGALDKKDPEAEEDSSEDEEDEDEDEDEDDDEDEKGQAEKGRQTLVFSATFDKNLQTKLAGKGKFGGKKDDNSMEYLLKCLKFRRQPKFIDVNPTSQMASGLREGLIECGPMEKDLHLYAVMVLNPNRRTLVFTNSISAVRRLTPFLQNLSIPALPLHSQMAQKARLRSIERFTSARSTVLVATDVAARGLDIKNVEQVVHYHVPRAADTYIHRSGRTARGGSSGVSIMLCAPDEVISTRRLAGKVHAKRQRGESTKDQMIQTLPLNRTILTRLKPRVDLAKKLADAVLAKEKGHGDDTWLKNAAEDLGVEYDPEEFEGMELGHSGRGGGRKKKEKEARNLTKAEMGALRAQLRAELAQRVNLGVSEKYITGGRVNVAALLKERENATVGGLFLGGDGLGLDL

SEQ ID NO: 2937 - protein, 376 aa, Unknown
  Kingdom: Fungi, Phylum: Ascomycota
MASTAVLPPNSNSLVLPAFGEPLTLTSKPLSQPTNGAVVVRILTTVIRPHHRAGFQGKSFLSFPVPYTPGHTAIARVISSGPDSVHLSPGQLVYVDGFVEARDDPHGVSAITGLLAMGPQSEKIFKSWDGLWRDVATVPLEQCHTLNEAVLTKMGYSFGDMQMLERLALAYGAFEAAKLKAGQTVIVAPATGNYSGAVAEVAAALGCHVIALSRSASKLEPLTSRHPRITAVEIPSNPDDIPAAIQAACPPSGADAYIDASPPLPGATVAHFAPCIAAVRPHGHVVNIGMIFQANIDLYNVLAKNLTIKGQFMYTRQQAADTVRLVEAGILKLGKEAGHEIVGEYALEDWEEAIRVGEGVAGWGKQILFTPKHEDQ

SEQ ID NO: 2938 - protein, 292 aa, Unknown
  Kingdom: Fungi, Phylum: Ascomycota
MELLLVLSAAALLVVPALYAYIAAAVPTRLPTLKNKRICLLIAHPDDEAMFFAPTVLALTRQETGNHVKILCLSTGDADGLGETRKKELIKSGMQLGLRDEDDVFVVDNPEDFPDSMTTTWETQKIASLLRSAFAPTIGSPRPKASIPSVNIDVLITFDSQGVSSHPNHISLFHGARAFIASLLETTESSPVDLYTLGSVSMLRKYTTFVDIFATLGSWWMGASGAGDENEEKHPSALVFTNKLTGEAALGTAWKAMTEAHKSQMVWFRYGWITFSRYMVINDLQLEKVKGK

SEQ ID NO: 2939 - protein, 520 aa, Unknown
  Kingdom: Fungi, Phylum: Ascomycota
MTIATNDRIALAEANSTVQHEQYNGGSQGVLSGLLDGWSYMQLFITFVLLCATYDQVMYQWRKGSIAGPRFKIPFMGPFFQALYPKWDGYLAQWASGPLSCVSVFHKFVVLAADRDLAYKIFRSPTYASPCIVPVAKNLMRPDAFVFLMGKAHAEFRRGLASIFTNRALSIYLPRQEKVYEDYFDRFVKESEAAGNQPRPFFKHCRQLNCGLSCRTFFGDYISEDAIAQIADEFYIITAALELVNFPYAIYIPFTKPWWGKRVSDRVLKEFTACAEKCKINMANGAEPTCTVDEWVVHMMASDDYRKRVAAGEKNVEKPANLIRDFSAFEIAQTMFAFLFASQDASASATIWMFQILAQRPDVLDKVREENLRVRGGDKDKPYTLEIYEKLTYTNAVVKELLRWRPPVIFIPYNVDKDFPITPDYTIKKGSIVVPSTYPALQDPVAYPNPETFDPDRWITGDAETKTRNWLVFGSGGHDCLARKYVPLSMALMVESSPVYFQRTSALWFGVAERRTTSKK

SEQ ID NO: 2940 - protein, 180 aa, Unknown
  Kingdom: Fungi, Phylum: Ascomycota
MSSAPETSNTTPNTATSPPAKRVKTTNGDDTTTDKMASVPALQIKKLSGKARLPTRGSAFAAGYDIYAAKETTIPARGKALVDTDISIAVPANTYGRIAPRSGLASKNFIDTGAGVIDADYRGQVKVLLFNHAETDFEIKEGDRIAQLIIERIYTPEIVEVQELEESVRGAGGFGSTGAN

SEQ ID NO: 2941 - protein, 776 aa, Unknown
  Kingdom: Fungi, Phylum: Ascomycota
MNGDLSLSQALGGLRIANPDDAVDTTSTPATHSHHPSKTSQHSISGLGSQPYDASTRDPTQPPVQTDKARLSMYGLQNDTSLPPMGTSAMSSAMANSSPRPSRQSSQGSDQRSYNQSRSPLPPTSGPLPPRRSSKGMGGGYASIPAGPARSYGNEANISTSSEDWKDRGAAVGVHREIDANGRTVVRQVKKGVRDFSFGRVLGEGSYSSVYLATDRQTLKEFAIKVLDKRHIIKEKKVKYVNIEKNTLNRLTEHPGIVRLYYTFQDESSLYYVLDLCNGGELLGVLKKTGSFDVECTRFYGAQILDAIDYMHSRGIIHRDLKPENVLLDDQMHVKITDFGTAKLLPDPRDSRMQDASQRGVPEPGAADPDGDGRAASFVGTAEYVSPELLTHKTAGKASDIWAFGCIVYQLLAGRPPFKAGSEYLTFQKIVNLEYEFPAGFPGAARDLVERCLVLDPARRLTIEHIKNHEFFDGQPFGKQLWKSRAPKLRPYVLPTQEPNIIQLNGYTSPPKPIPTSRTQPPLGPIASSNGGNRPARIITELPPPTQLDIEWSPVLTRDNERILKLGDLMVLSSPLANGSNGKHGEDGHKKLSRFFGGSTTKKRQRLVMVTSSGRIILAPSGGEEKRAKQELFLLAPGASWRTQQDVKGQSVWCVDTGGNHYTFEETKGATSADGGQASAEEWIQSLERARDLAMSHHNSESYGSDNEFSDMGQQVSSPSSANQGLGSYGDNYGNIERSSRSHLSKSQGSLDDTSSHKRNHRFSKRASRNGLDSAF

SEQ ID NO: 2942 - protein, 597 aa, Unknown
  Kingdom: Fungi, Phylum: Ascomycota
MASETGASENRPPLPPRPVTNVSVDSNFQALATTAITPVDIQTLSFPDGSRGTFSTPGPQYSETPASAGSARASSDQVTGNGSGDVDDTASAVSYAPTGQPPGDIASLLAGEMNRKSAAWNLLRTQSTTVPPFDPSRVLSQDPLMMFDREFDALPTARDGAYGDEERLMVWKAKLKHYMILSSAGKPIWSRHGDLSLINSSIGVIQTIISFYEGAKNPLQSFTAGPAKFVISTQGPLYFVAITRLDESDSQIRAQLEALYMQILSTLTLPTLTKIFVNRPSSDLSKPLQGTESLLSSLADNFTKGSPSALLGSLECLKLRKSQRHAINNTFLKHRTDNLLYGLIVAGGRLVSVIRPRRHSLHPSDLQLIFNMLFESGGIQAGGGENWIPLCLPAFNNNGYLYMYVSFFDAGSAGEQAAESAAAKGLPADEEIALILVSADRESFFELKQMRDEVARQLAKNGSLSIIRASAKAGRPKIVDIAPGSQMSHFLYKSRANVQFCMSSMSPAFDDDVDRRRLMNVYHELHNSVHAKNAHMKVLHTVSIEATSLAWVTPAFEFYCVSGPNMSRAAMTQGANKIIQWAKKEEERLFIIGGGVF

SEQ ID NO: 2943 - protein, 290 aa, Unknown
  Kingdom: Fungi, Phylum: Ascomycota
MATMLPRSRSLASALRSGKTSIAGRSSNAARCLSTTAPQFVAMPKDAQNMRMAPRDQTGALKAPIINPADKYQSKSDNMHKYGAWVMGCLPKYVQQFSVWKDELTIYISPNGVIPVFSFLKYNTAAEFTQVSTVTAADYPTRENRFEIVYNLLSVRHNSRIRVKTYADEASPVPSITGLFDGANWYEREVYDLYGVFFTGHPDLRRILTDYGFEGHPLRKDFPLTGYTEIRYDEEKKRIVTEPLELTQAFRNFEGGSSSWEQIGPGEDRRPDSFKLPTPKPEEKPEEPKK

SEQ ID NO: 2944 - protein, 490 aa, Unknown
  Kingdom: Fungi, Phylum: Ascomycota
MASFTDEKKDLQVPIDPEVGPILTSIDSIAEAKLVRKQDLRVLPMVFLMYFFTFLDRTNLGNARIAGMEADLGLGTYGFNIGACLYYLIYFFADIPAALCVKKFGFLVLPMSCIAFGAVTIGTAFIRNSASFYAIRLLLGLTESFQFPGLSYVVARYYRRHEVTTRVSFFMLGAAGLAGGFGGILASGLLALENVGSVKSWRVIFLVEGIITVGVGILSLWFFPADPSKTRMFNEEERAMALARIFHDQPAIQEHKEKMTWSLIKRGVFNVNVMAGAWIYICDQITVQGLSIFTATILRLNFPEKSLIQIQLLSSAPPLVGMVVGLGVAYVTMKTRKHGIAIAICASLCVLGYAIWLGSSNPQARFAAIFFNTAGGFSFGVLILGWTLSNAAPDTIKNVANGAVSGLANIGSIVATWSYINTDAKTGYRIGNSLNTATAVSVIIASLALVYYQKRENKKRAEGGRDYRLERPENEVARLGHLHPEFRYIH

SEQ ID NO: 2945 - protein, 322 aa, Unknown
  Kingdom: Fungi, Phylum: Ascomycota
MANAPKIPLDEVQWKDPRIVASMGGLHSNTVLFYFAESPFYEKTSNNAVVLSQALNNQQMYPVIQTREAFEAHLKTMSGLEFLVGEEPAESGPGMGTGVWVIRKQTRKKRWQQEDEVTVHASYFVVGENIYMAPRLSDMLACHIMTISTNLTRAFSEASSLRQWRPSVGHVYKLPTPQSQVANRPRGLESKEATPMPEAKTGTAAAAKTSEAQIDENALERVAEEAFMTHMRYGGEYIDKNPITGRPGEFHLSSTGRKAVPPPHSDPKNATGRLGAMNGPPAINTKLDDKKDGKTEKTPKSATAPKPKRRKSKMGGTTPAAS

SEQ ID NO: 2946 - protein, 633 aa, Unknown
  Kingdom: Fungi, Phylum: Ascomycota
MGPGTRRTSDNDVRNLLASSFRSGSPLAQQALAEDIAACSDDDEDLDSHIANENAAPGHIMYRRPSGVAFGASRPVFSDRILDEPALTSVERQQSRNAERSLLRDNHVLPPKRRGHSQQPGLASRIYRRLFSTKVPQETSGGDENGDASAQGPSETSPLLQSAGSVNSIDDVEEQWEEAIASRKLTTTWQRETKTMAVYSAPLIVTFFLQYSINVVAVLAVGRIGKMELGAVSLANMTAAITCLAPFQGLSTSLDTLCAQAYGSGHKHLVGVQFQRMTFFLFSLWIPVAIIWFFSEGILNLVVPNPESARLASQYLRVMIFGIPGFILFEGGKRFIQAQGLFAATTYVLLIASPLHVLLTWLLVYKFELGFIGAPIAVAFTDNFMAVLLFLYVKYVDGSQCWGGFSKRAFKNWWIMIKLALPGMIMVEAEWLAFEILTLVSSRFGVEYLAAQSVITTLGAVSYQIPFAMSIGSSTRVANLVGAGLVDAAKIAAKVTFVIALFLGIFNQVIYTALRYHLPLLFTDDAEVIEICAKVLPVVAVLQVFDSLSAGAHGLLRGIGKQAIGGPANLIAYYVISLPISLGLALGLDWKLQGLWGGVIVGLASVSAIEYIYLLVTDWETAAREAETRNAAG

SEQ ID NO: 2947 - protein, 196 aa, Unknown
  Kingdom: Fungi, Phylum: Ascomycota
MKAVLATLTLSTLASASPLLNGEVNRIVRRTNEESKPDMSGVPFYYTSTYAIKATPDQVVDAENEFTGGLEGASGWFLYGINSHENVICYNITIDGFRGDFQSPANTATHIHEGKRGMAGPPRIAFPNPMGENGHINTVGCLKGPFETGVVTDGVDSGEGFHVKQIEDSPASFFTDIHSSEAVPGAVRGQLGPDEC

SEQ ID NO: 2948 - protein, 794 aa, Unknown
  Kingdom: Fungi, Phylum: Ascomycota
MQLVLDRQCIAPGFRVINLLTMKNQLPLLAMAGVASATDFAEQCAALANTLVEQTDNTTIQAATFVPAGTVLSEPARHETCQPLNQTAEYDFCRVQLTAHTGPDSAVLMESWLPLDWSGRYMTTGNGGLGGCIGYSDMTYGASRGFAVVGTNNGHDGNYGEPFFHKPGVIEDFAYRAVHIGTQLGKQITQLMYGKEHSKAYYLGCSTGGRQGFMEAQNFPDEFDGIVAGAPAFDFTGLQVSSGSMFGFTGPPGSETFLTREQWGLVLNDTLEQCDGLDGQVDTVIEDPDLCQYRPERLQCGPEQTEGCLTAAQVGTVRKVFSPLYDTKGQLVYPRMQPGVDSSMMLWNGQPFLYAADWWRYVIYNDPSFDGNLTVEDIEPAREAETYGIDAFSGDLSGVKNCGGKIIHYHGLQDPLITSDNSARYYNLVSRTMGLPSVDLDEFYRYFRISGMAHCSGGTGAFNIGNREGTDVSDEPEGDVVAAIVRWVEEGEAPDHILGTAFVDEQEKKDIKFQRKHCKYPLRNVHVEGDASSPDSWQFDATRVPSYLFCRVSLPKKFSSSQLCNLLISSKNPQYKACFCRCYSTLTITYPWNNTLDKKTTMSSTNHAKEGSGKPVTTPTEMPQSPTSQSSPVVDAQEAQQNPTPPGAEPRDALIRFQAQPTIQQPQDQVQAANAIPRAAPRIAPHEMVRARAGLELIRHRWSTHFHGDQFSIEDWAARLVLAVVNAVMGLRTGTVTDIASVIRQIKETPTVVLFRNNDFQILVCVAQVRQRLIEVVRAMGGSEETFLRGNPYP

SEQ ID NO: 2949 - protein, 503 aa, Unknown
  Kingdom: Fungi, Phylum: Ascomycota
MAEFHNPFRRRQPANESLESEATLGPAVENKSFFKRALPVFACGAGLFSDGYINNVIGSVTTVFGKKYGAEYTGTTAAKNVAAIAFAGTVVGQLIFGFLSDHWSRTNSLVISTIILIVFTALASGSYYHGSDIGLFNILTAWRFFVGIGIGGEYPAGSVGCAESTGELKKGTRHRWFILFTNSMIDWGFVFGAFLPYVIAAATNNKQYNVIWRVSLGLGVVFPLVLLILRIRLKEPEEFARHSMKRKTPYTLVLKYYWWRLLCVSIIWFLYDFSTYAFGIYSSPILEGIYGGGDGVPLTTIFGWNTVINLFYIPGTLIGAFVSDWLGPKYTLVLGVLLQSVVGFIMAGVYSQISKHIAAFAVVYGIFLSLGELGPGNNIGLLAAKTCATGVRGRYYGIAAAIGKVGAFVGTYVFPSIQDAGGDDPVKRNQYPFFVAGSLCILSAAIALFGLPNVGQDTIAEEDIRFREYLEHKGWDTSQLGIGPTPGSDDVKTTGNELGQREK

SEQ ID NO: 2950 - protein, 389 aa, Unknown
  Kingdom: Fungi, Phylum: Ascomycota
MSEADATKPTEAIAPQVEDKPTEAAPAEETATETETETKDESKDTDANGDKSNVLKTTARSDKDARNNRKFDPSTREVTDDPVAIRKQVEFYFGDWNFPQDKFMWESCGGSENKPIPVKAIHSFKRMRTFQPYTAVVAALRDSEFLDVEGEEGEETLKRKEAYKPMGSGRAKNEASTVYVKGFGDEKPNTQFDLESFFANYGEVKGLKLRRTNDALFKGSVFVTFSDEETAKKFLELDPAPKWEGHDLKIMSKAAYCDEKSELIRQGKLEPNAQQPRKFFEGAERGGGKPRGRGGFRGDNDDWKKRRDYDQKNGFKGGRGGGRGRGGRGRGGRGRGDRDRGGRDRDDAPRDPAAEEAKENSKRSREEDGASGEPAAKKVDTKTEASAAS

SEQ ID NO: 2951 - protein, 115 aa, Unknown
  Kingdom: Fungi, Phylum: Ascomycota
MKHYPQAQSSFTIPLLAGDNAYLGDVFSSDKTNPEKPISAGLFRLKKGEPLTYTYKYDEMKIILEGDYTISDETGQSVTAKPGDVFYFPAGSTITFTTTDYGLAFYCGQRKESDF

SEQ ID NO: 2952 - protein, 484 aa, Unknown
  Kingdom: Fungi, Phylum: Ascomycota
MVVLQATPGGGSGRPTTGGGATMNLGKNLALVTLTFQNSLLILIMHYSRVMPTDGDHRYFPSTAVFLTEVLKLIVCLALTFRETAATLAPDTPPKVLVEQVYNAVFAGDGWKLAVPAAFYTLQNLLQYVAISNLDAVQFQVLYQFKILTTAIFSVYLLRRSLGVKRWLALLLLTIGVSIVSLPPSSSTPQFHLHDISDHFFPSNMPRAAPAAPDIDDIVVPPPVVPRLMRRNEAIDVSLDDDIDAHAAAAAAAAHLLDAPMNYSLGVTSILIAAAVSGLTSVYFEKILKDSGATVSIWVRNTQMAFYSLLAALIGGVLWQDGAEIAVHGFFEGYNWVVWTAVLLQTFGGIVASLVIRDTDNIVKTFATSISIVISFLISVYLFDDFSFGLTFLIGTSLVLFATYLYGMQDRLRGAGMRGRVPPPIKIANFEKPTIEKVFTPGVKDNARPDPLARWGSGLAVSTSRPSSPMLPRQNSRSNFKRDE

SEQ ID NO: 2953 - protein, 278 aa, Unknown
  Kingdom: Fungi, Phylum: Ascomycota
MAYVITGKDCMISEWILLVLSYVFVAARVYTRLFRLREKLRWSDWLLIVSAIDALGLIICDTLTYDMGVMDNWAPSVALSKISFSSNYFYDVGMGFPKLSMLAFYWEYFHHDISSTTRKVLIGMTAFVVACYTAILFDDTFFCGSDVSVQWSQEEGACNVFWAPEPFIVNFTLNLACYLIVYAIPVMFLAQRLLRPSTGLWVAFALGTLTIAATVVRFATLKAHVGPENLVYPMSIIEMTLAIIVVSLPGLKPLLRRGPKSQTSDEHVEVQHHHHDHK

SEQ ID NO: 2954 - protein, 577 aa, Unknown
  Kingdom: Fungi, Phylum: Ascomycota
MLSVTRAAVPAARRASLSHKQAPRPFCQRCQRQLSTCRPLQNTTRRSTDFNSGFTGSYDPSDEPGRGPMFTKSNFGVPQFYPRDLKKRVDDYVVGQDRAKKTICATIFNHYQNVRRRHQHEHEERNRRDKMTRQRFTRERELHQRRREVHPVEDDFPGHHESVRQLHDNYEAEDDAINHLYEPEDTSAPQRVKIDKSNILLIGPTGVGKTYILETLSKKINVPFSICDCNSFTQAGYIGQDVETCIERLLIESNYDIKATEHGIVVLDEFDKIARRETTTGRDVGGEGVQQALLKLVEGTKVTVNVKDNRSSRSATPITTNYSSSGGSSTPQATPPSGKVEQYTIDTTNILFVFCGAFVGLDKAIIRRVAKPSMGFGGEVKGRTTMSGSQHKLPPETYTHLPHHNALSAPSFTPMDLVTPEDLQSFGFIPELIGRLHNVCALSPLSKDDLFRILTEPRNSLAAQYTALFETYPSRLYFTEKALHAIAERAAKSGTGARGLKMEMERVLAEPMFDAPMPYVLITEGCVQGKEKAGYWGKDGRFEVDRRMEEEEVGREQGQAQSDLTFERFREAGQSGG

SEQ ID NO: 2955 - protein, 690 aa, Unknown
  Kingdom: Fungi, Phylum: Ascomycota
MSEVSITNQPALGDGIASSSGTSTPPEDVPTKAKGRQRLLLGLQRISSSQSLSGLRRSKSVGGTPYKSRASLSCASLAATGPPSNLGRSTTPVPSPLRFPTNLTNESQTSEFPFYDEDQATLAVRRVDSTTLSSTPSSVPVPAELRATKQDAQIKRQTSAKAQSKKPFLLWDLMPLELRVQVLSYLEPKELVQVSRVSKSFYKFAFDGQLWTSFDASEFYQDIPAESLARIIVAAGPFIKNLNLRGCVQVEHFKRTEVIAKACKNLMNATLEGCRNFQKSTLHSLLRSNERLVHLNLTGLPAVTNSSCKIIAESCPQLETFNVSWCNKVEAKGIQLVVEHCHKLRDLRAGEVRGFDNIEAAEAIFKRNNLERLVLAGCAELNDEALQTLMHGIDPEIDVLTELPMVVPRKLRHLDLSRCDRLTDRGVKAIGHMVPELEGLQLSRCSSVTDTGLEPILASTPRLTHLELEDLEDITNSLLSEHLAKAPCITILEHLSLSYCENIGDVGVLPLMQKCVNLRSVDLDNTRISDLVLAEAAAMVLKRSTRTTDADRQPEMSLQMVVYDCQNVTWTGIREVLFRNTQVKPLSGHPGKVTYPTEIIGLKAFYGFQMTVDEHQKRVLRGDFKSAGRLERKWADYMQAAEEAGVMGAGYRRRRRRAREAQALHRDEEYSENGGNPRRRARTIGSCAIM

SEQ ID NO: 2956 - protein, 577 aa, Unknown
  Kingdom: Fungi, Phylum: Ascomycota
MPRPRRAPRAANTEAAKTTESKAAAVHGEEMETRGRARSTRASAANMSTSDEAAIRNANKSRDAALDRLANEDPTTTSGEDNTLSSVEVGRRGLGTPLRAVDTTGLDLADDMFGDLDESFDIGGDSLLKAPHSAESSTMSLRNLGRQRSRSRSRQSTFIGRNDAPIRPSSRNGTTPLMSSSFNIGVFRRRAREPSILGTNRKSRYDTTGSVTGSINGSVAGSVAGSVAGSVQGSDAGSDRELSPEAESTPLNARRRSARSKAVGEEKAQADVSAMSQARKRKSGDDMETSERPEKTSRVTSHGDGIDVSDSESELSSLGSPVILPSLERPVTPMRDEDVAPPASSDSEDDGAIWPDIQALGRRRRRPSVTHDHLSDVSSPPSLTHSPNFQATKRGRAVRRQRARSPEITTAHLANLLPKRRVKKTQTHVHEEAVDTSGLAQDDDELQLDARASRRNAGTRASSRNAETDNALQPRQTPAATTRAVTRSSSRAEKTYSRRASDKENEDQSDEDDDGDEPSAFVALPDDTFGEESDERQQFVETRELKAASEKFKEVDMWELSFEEVVEAEEVAPIDAR

SEQ ID NO: 2957 - protein, 4050 aa, Unknown
  Kingdom: Fungi, Phylum: Ascomycota
MSAYPETAEPRNVEPIAVVGSGMRFPGSSNSLSKLWELLLKPRDLLKRVPEERFNIDNFYHPDPTHHSTTHVRESYFLDEDHRHFDAGFFNIKPVEVAAIDPQQRVLMEVVYESLEAAGIPLESLVGSRTGVYVGLMTGDYFEHLHNDIDTLPTYVPTGTARSIMSNRISYFFDWHGPCMTIDTACSSSLVAVHQAVQLLRSGDSDMAVAAGANMILGPGQYIAESSLHMLSADSRSRMWDADGTGYARGEGVAAVVLKRLSTAIADGDKIECIIRETGVNQDGRTKGITMPNASAQIDLIEQTYAKAGLDPRNPSQRCQYFEAHGTGTAAGDPKEAEAISKAFFHPGDNVSHDHGDPLYVGSIKTVLGHTEGTAGLAGLLKASLAVQEGVIPPNLLFNRLHPHIEPFYTNLEIATSPKPWPALADGAPRRASVNSFGFGGTNSHVIVENFVPPTANGTAHSPPSEVAVSPAPHFAPFIFSAASGSALRGVLSGYSEYIASHPDVHLEDLAYTLYARKSQHAVRTSISARSPADLQAKIDELMVKPLEGNSASSFGAWANPLSRPVRVLGVFTGQSAQWPTMGRELMKSPFVRKIVSELDVELQNLPEPERPDWTLEAQLTCDASESRVAEAAYAQPLSTAVQILLYDLLSSAGVTFQGIVGHSSGEVAVAYAKGYISRIEAIKIAYYRGYYSTVCSNDKPGAMMAAGATAEDANELCNLPMFKGRLCVAAYNSPSGVTLSGDSDAIEQAREILQDEGKFARVLKVDKAYHSPHMKKAAAAFLDRLKGCNIQPRHAPKGSDAVWPSSTYDDKIEMRGDGQGLVDLSGPYWVNNLLRPVLFSHAVETAAAAQGPFDFALEVGPHASLKGPVLATLRGSGDGEALPYLGLLHRGKDDIDAFCDAVGTLWSRVSPSTVDFGGLDSTASGGNGRALIKDLPTYHWDHDRLYWHDSRSSRAQASAKNPPHPLLGIRTAESSEDEIRWRNLLKLSELPWVRGHQLQGQVIYPATAYISTAVEAARSLAPGKNIAVVEIQDFKLGKPLIFEDSDLGIETLFTLHGITQEEGDSNSYVASFSYHASVKADIELLSAHATGKLRVTIGETHAQWLPSRPDDPPNLTSVSEDQFYSFLEPLGYSYTGDFRTLSEVQRKLDYSSALIGVPPPNDEPVQMLLHPAMLDTALQGIFMAYCYPGDGSFDQLHVPKGVKSFRVNVGLCEQHLGPTSSGTVASCARLTENPLTTRRLRGDVDIYTHEGAGLVQMEGIQVVAFSEPTAEADKKMFTEYKWAPLNPNGDLAMAGYRATPEDYEFAEALERVCLHYMQRITTLFPESVRKSMNLEWHFECAFAFYNDVISTTRDGTRQFAQKKWIDDSDADIAALKAKWGHRTELQLACVVGDNLPGVLRGESTILEHMTKDGLLDRFYEVAMGIREISLSLGRTVKQLVHRYPRMKMLEIGAGTGGATKVIMSEIGRSFASYTFTDISTSFFATAQEVFDSLGGKMIFGLLDCEKDVVAQGYEEHSYDLVVASLVLHATSDLQRTLTNARRLLKPGGYLVFMEIPNNEVTRAGFVFSGTPGWWLGQDDGRKLSPCVSTLEWHKLLLESGFSGVDTATPEHDIFPFTLTVIVSQAVDDRVLSLREPIASLGTTHETAVQVDWDLVLIGGQTLCTCHLIDQIIRLVQPFGIKYTVATTLGDMSKTKTSPNSAILCLTELDQPVFQALSERTLKGMQRLFETQGTVLWATQGGRSEEPYMNMSVGLIRTVILENPELVVQLLDLDSSTKPDPRRLLELLLRLRYCATWEKDGGIEKMLWTQEQELAVDDGELMVSRVYLDTAANDRYNASKRTINRLIDPQTTPVSLSVGSSKPHLIHNSSLGVRVPESEHQQPANVDSNSNGLTLIKVDHSLLAPVLAAPLKPTYVLLGTSVGTDKSMVCVASQNGSYASVPPEDVIEVNVPAGNEIQFLSQLDTSLRVENILSVCRRDSTVLIHEPSWELASHIVDAASRLNVAVFFTTASSKPTIDGPWIAVESYAQIREIQSLLPLDVAVYIDASTDAQDKRLGVMIASSLPASCIQTTLADIHALQHARDFTVADLRPRLNSAVQWALKNTVHPGDSDPKLLPSITLDQLISGSEVADLAAPAVLTWGSASPAKVPVEVSIVDSLVTFHSDKTYIMFGLTSDLAQSVCSWVASRGARNIVLTSRNPKVDDKWLEYMTAAGVRVKVFANDITDKDALFSLVDHIRQNFPPIAGIAHGAMVLDDVVFSEMPLEKMTKVLRPKVNGAMYLDEIFGPGADPLDFFVFFGSAATIAGNRGQAAYSAANSFMTALATKRRSQGLAASILHIGAVMGVGYVHRNKMFLEAVHDVLRKAGFLMYSEREFHLCVGEAILASHPLSGRNPEVMTALKTYGLEDVIIRWPQLPRFQHCLQDDSENDRKPTKKAADASVKKRLAEATSDIEVHEIVQDGFVRKLRAMLHIPDDKEAPQILAATIDDLGVDSLVAVDIRSWFAKELGIEIPVFKILSGGLVRELLEHAVENMPVRETSDQNGTAPSPDAERAAKPDSPLVAATDVPTSLSETAQTDPPSLSQSQMDDDDQGKQESSSVTSASGAESSGILKPSFDKVLPLSPGQSRFWFQKHIMEDQTTANSTICLEISGAVRLGSLEAAVRKVAARHESFRTSFFVDENQKAVQAISATSRLHLETVVLADESGVEQEFQSLKNYVYDIEHGECMRIIHLGLTPTKSFFLVGAHHIIVDGVSLEVLLDDLQKAYHSQDFSATEPAYQYSAYSEKMREDLASGVLQGEIEYWKSEFAGPPSPLPLLPFSAARKRTALTTNAHYLVNRTIDPQLARQIQKTCREKKANPFHFHLSVFEVLLFKIFGESDVNIGMADANRWDDRVARSIGMYLNLLPLRFRLNDQQSFEEVLKETRRKTYLAMSNSRLPFDVLLENVNCERSTAISPLFQAFINYRQGVSEKRRFDNADLEVKMMELPGTGYDVSLDILENPGGETRVSFMVQKSLYSESDASRLTDMYFGLLSDLSRSSPQKLQQVSLFSSQDVSKAIQLGKGRVIPSRWPETLVQRVDDIIAKHPSEISLRDSNGQSWTYRQMDAQVERIASALLKANTKPGSAVAVLQEPSPQFVFSLLAILRVGAVGVPLDSNNPPARLRAMINESKCFALLGNSTTVAQAGNMNLPASITVLDILGLQDGVLPQRQAVPVHASDPAAVLFTSGTSGVPKGVILSHGSLRNHVEALVQTHGFGRETVLQQSSVGFDMSLNQIFMALANGGTLVIVPEALRKDPDAVANIVLKENITYTSATPSEYLAWLRHGSTSLFQSTHWKYATAGGEKFSPDLLQGFRKLAGRFGREFHFFNAYGPTECSMSSSELDLSLEAPGQSPFISAGRTLPNYGIYIMDQNLSVLPVGWSGEVCISGAGVAIGYINNAEESRVKFLTDPQPSPVAIENGWTRMYRTGDKGVLQQGGTLEIIGRMEGDTQIKLRGLRIELQDIEQSILEAAKGRVKGVVVTPHGDPTLLIAHAVLSPSDPSADDDVEFLRKLAASLPLPQYMRPAAIIPVPSIPLTASGKVDRKALQRLAISNVSVGQESARELTETESKLAQVWRDTLPQQMQDVHHIDAASDFFHIGGNSLLLIELRQLVNERFQANFPLTKLFENSTLSGMAAMIQDVSSGADTDIDWDAETAIPQELLNIPTQQRQVVGAENHTTPKIVVMTGATGLLGSSLLQLLVESPDVSKIHCIAIRDTSKLAEFSNSPKVVLHKGDLALARCGLTNAEAESISKSADVILHNGADVSFLKTYRSLRGPNLSSTKELMLLAAPRCIPFHFVSTATAGKFNKSDTLAPESLAQSPPDQNSVGSAGLADGYAASKWASEVFLEKASRQLGLPVFIHRPSAIMGTEAGDDILSNVLEYGSVIQALPDSSRWTGYVDVVSLENAAGGISRSVLQVPREVAGSSADTLVEYLHHAGDQVIPVQSIRDLLHGDGGHDLKSLPMREWVDGAIRSGMNPLVGEFLRNADENGGLLIGQKLLLRTGVESTQ

SEQ ID NO: 2958 - protein, 759 aa, Unknown
  Kingdom: Fungi, Phylum: Ascomycota
MASADLADYKYSPLTPGSRTFRAIRLLDRVRKWPAPFDRGTLHIEIEEVQVDSGNAYECLSYTWGVGPGEQPDRRVIVETAQKSCQLFIHRPLEAALIQMMDNGSISELLFVDQICLDQSKDTEKAEQVPLMRDIYANSARTLVWLGTETRLSNRWFDYLEEIHSEGVLSRLMGPNRGHFIEVFDAVMDTSIQTSGVIREDTNDLRALLDRYAPSFPLEAVKEVFSRPWFTRLWVVQEICLPTDVLIICGTRSLCLDCFRGGSLFFSTYTSYLPSHVDRKETRANIAMHFHVLALTQSFIRIFQERKSIHLAGTKRNSMETVLRYSIVDGATRTGATMPEDRIFALLGLTASDDKLHSMKVRYKDVIDVYTEFAAIHTKRNLDILCYAQFPKGNDLPSWVPDWTTPLHTPRAYAKLEQPCFTAGTALGRVTECEVDLTTRRLSARGTTVDRIKRIGVRELMHDPDQPDGESLDDRSARLFFNEIDEFLRIAEDIPGSRFLQYNTDAKRRADSDIRLADRGLSEIWLRSRGYSEAEIRTGLRAAKNHATTYGQRLLDVDNQVRSYRMDRIFKTVGIVPWYWVPPSEADICYAMATMPLVTSWNWAKGAAMFLTDVVGLFLASSMTVGVANWLRFRKRFQKLNLFPSQRDESLRRHGLDTLVEHGTEVNTLSEYMLKNREQRLYVTEHGHIGVGPRGMQPDDVVVVLFGSTTPHVFRLTGNEGCGDDEEWAYLGEVYCDGIMGGEMLREGENAEARSFRIR

SEQ ID NO: 2959 - protein, 250 aa, Unknown
  Kingdom: Fungi, Phylum: Ascomycota
MLRHQRTLAVVALGAIALTPSQVYAESEVANSKRKPIYDDDVVEVPSEKPSATTTLKQLIPSNPFTESPSETEDIKARGPTPTDRLAAQIGKARLFLYHQATHAEDALNRTVDSAFNLEESFTRTITSLAPPRESHEKLMPGAIYVLVASMAGSIISRNRNILLRAATPLALGIGAGWVVLPITMRNISELTWKYEKRVPAIAETHLKIREGLQKSASFAKVHGELGARMVDEKVTDAREAVEGWVKQGK

SEQ ID NO: 2960 - protein, 919 aa, Unknown
  Kingdom: Fungi, Phylum: Ascomycota
MSYGKKDEDADLGMVKVDRTQVFQEARLFNSSPIQPRRCRILLTKIALLLYTGESFPTNEATTLFFGISKLFQNKDASLRQMVHLVIKELANSAEDIIMVTSTIMKDTGGGTDAIFRPNAIRALCRIIDATTVQSIERVMKTAIVDKNPSVSSAALVSSYHLLPIARDVVRRWQSETQEAAASTKSSGGFSLGFSSSGGQVPMNNSTMTQYHAVGLLYQMRSHDRMALVKMVQQFGAAGAVKSPAALVMLVRLAAQLAEEDASLRKPMMQLLDGWLRHKSEMVNFEAAKAICDMRDVTDAEVTNAVHVLQLFLTSPRAVTKFAALRILHNFASFKPNAVNVCNPDIELLISNSNRSIATFAITTLLKTGNEASVDRLMKQISGFMSEITDEFKITIVEAIRTLCLKFPSKQAGMLTFLSGILRDEGGYDFKRAVVESMFDLIKFVPDSKEEALAHLCEFIEDCEFTKLAVRILHLIGLEGPKTVQPTKYIRYIYNRVVLENAIVRAAAVTALAKFGVGQKDPDVKSSVKVLLTRCLDDVDDEVRDRAALNLKLMGEQDDEMAQNFVKNESMFSLPYFEHQLVMYVTSDDQSTWQSPFDISKIPVVTREQADAEDRTKKLTATTPTLKAPKVGPTKAAPTSGVEAAASANAQAQRYAQELMEIPEMAAFGSVLKSSPIVELTEAETEYVVTLVKHIFKEHIVLQYEVKNTLPDTVLENVSIMATPGDDEELAEEFIVPADKLSTDEPGKIYVAFSKINGEGSLPITSFSNVLKFTSKEIDPSTGEPEETGYDDEYEVSEFDLAGSDYIIPTFASNFSDLWEKIGAAGEEAEETLQLSGMKSIAEATEQLAQALSLQPLEGTDVPVNTSTHTLKLLGKSVSGGRVVASVRMAFSSKTGVTTKITVRSEEENVAALVIASVA

SEQ ID NO: 2961 - protein, 608 aa, Unknown
  Kingdom: Fungi, Phylum: Ascomycota
MTPPPRFTASKSRSTQGCYTCRLRRKKCDEKKPECDNCTTLEIKCWSSEEKPDWFDGGPKQKAEMAKVKADIRIKAGQRRDRKYLEMMDKDSRETSAVASHDGSPEQDRPMTADINMSGASSNEPDEVQHGSSHAENSTPASTWSNTSFPLQRPQTAAFLHDESSDIDMHYIMIFLDSIFPYLFPYYHPFVLAGGKGWVLQSLIANRAVYHTSISLASYFFGILLGNTHTACSNAMVEKLQTQIEMGLRELRNEMGNLRTRPPALGNVEALNCMQSIVLMCHFEVATGNVGNWVLHLDAATAMLQQLVPTPDNWGCVLDSFDSGQFDAVGLQKPFTAHQNALRFYAAQCLYMDVLASITLSRVPRLHSYQPYLMPGCTKKPPNTMRTTMLFLDEFLGLHNSTLQLLSDVAALDAWKKEQRKAGSLSIHELLAKATTVGDAIKVMVEGLEEAIAGGYETCAALFAEPFDILKELQPQSPDDLPGHPTHNLIWLLAAQTQLHLVISGWQPSCPEISRNVKRMTELFTSLPRPTALRSMALPLCVAGCLVGPDQEHIYRALVENMGSLRVFGTVKESLAIMEAVWAKRETIDESWDMSKCLNILGHGVLLI

SEQ ID NO: 2962 - protein, 321 aa, Unknown
  Kingdom: Fungi, Phylum: Ascomycota
MGNGPSRLVPVDASPAQYTQAFFVLSSAFIVSIQFLPDDIRGVLMDYGARRPQQKDAASATAAANANASPAMLKLRGVLAKLTNCSQVPHSWFRHFYIVSTGWSVFWLAQFLSKGRVMAAIASWQQKTAPNGMGLGQTYVVAALMAVQGMRRLYESYFVARMGKSPMWFVHWMLGLAYYTAMGLGVWVEGSDAIIDGWKAGNHKLNVPSFVPFAAALFMAASAKQNECHAHLSSLKKYTLPEQGLFKHFLCPHYTCECLLYVALAMAAAPPGTTFNKTVLSGLLFVTVNLGATAYGTKQWYIEKFGAEQVGNRWMMIPFLW

SEQ ID NO: 2963 - protein, 316 aa, Unknown
  Kingdom: Fungi, Phylum: Ascomycota
MSSTFDLSNPNRTIHVGVVVLNSTTEILDVAPIDIISSLSIAEDFEIPKGMDVPAEVFPPEARAQRMDIEFHWVSEAGPSQLMKFTSGIRMQPTDSFETCPPLDIVLLGAHKMNDQPTEAELAFVRKSYNDCSAFLTICGGVMVPLAAGLLEGKKATGPRFFLKVLRQMSPNTEWLEKRYVQDGKLWTSSTLLNGTDMMFAFAKSVWGKRGEKEGAPNIVEMTGKLGAWPARDIDFKDVPILANTMAAGDESRKGLRSLKRFITTHDDTGKPTSIETMSEDVPFQTLPGNFDFALCYATEKFPATLSDQQDVDTYK

SEQ ID NO: 2964 - protein, 404 aa, Unknown
  Kingdom: Fungi, Phylum: Ascomycota
MSSSKPEFLRFTGHRHFAQRLVLSTLTGRPIHISKIRSSSPTNPGLAPHEISFLRLLETVTNGSSMQISYTGTTITYHPGLITGAIAGQGAVDGDLVEHNIPPTCNRGITYFLLPLCLLAPFSKAHMNVRFTGAGIITSATETGDISVDSFRTAILPLFALFGIPPARIELRVLQRSCAGPGGKGGGGVVELRFASQVRLPKTLHHNRNPGRIRRIRGVAYSTGVSASNNSRMIHSAREVLNPLVSDIHIAAQYDTAPLVPTGDKTGSKRRLGIGFGLSLVAESSATGVLYSADVVVPASGGTVPEDIGKRCAHQLLEVIAQGGCVSHTSASTVLILMAMGSEDVGRLRVGRDVLATEDTIWLARDLKTFGASSWGLRDAEDESGDLVLSVKGSGVGNVGRKIA

SEQ ID NO: 2965 - protein, 290 aa, Unknown
  Kingdom: Fungi, Phylum: Ascomycota
MKASIFALAAIASAVIAQSRDDLPECGRTCADNMLASSKADELGCDSDDIRCLCLNKNFTYGLRDCSLAICSEDEVSKVLDYGLAVCSSAGVKIATTSGTVPAPTATGEDNSGGAGGAGGSGGSGDKSGSVSTILSTITSDGDTLTTAVATTTLGGAGGAGGSSDDDDGSAASSAASEASGAASSASDAAGSLSSAADDAAGTASSLAEDASTAATGAAGDASTAATGAAGSLTDAASSLSTAATGAAGSASESADNADSTTTDSDDAAPQMTAAPAAILAAAGIAAMLL

SEQ ID NO: 2966 - protein, 336 aa, Unknown
  Kingdom: Fungi, Phylum: Ascomycota
MASSSAAWDALGHAASGSLGTATSTAALYPLDLAVTRLKAQSHLPPKERHEGIIDTLCDILSKDGLSALYSGLGPDVAKSVIDSFLFFGFYNYLCPRHRKPRALEELGLGALAGACARAVTTPVSNVVTLKQASATTQQESFGQTMAGIVERSGILGLWSGYSATLVLTLNPSITFLMNRRLAKRIIPALEEEDIPVAWVAFLLAATSKAAATALTYPFQAGKTRLQMASQDDDSNDAQAQVKSAPMAENKGSGIRRVWRRILELLDQSIFGVILHILKDEGVRSLYTGLQGELLKSFFSHGLTMFTKGLIHRLIIKLWIAAGPRLRQARLRASKS

SEQ ID NO: 2967 - protein, 466 aa, Unknown
  Kingdom: Fungi, Phylum: Ascomycota
MMPRNSLLARQDPAPVTCTDPRTEEPLWDAPLASSEDLDEAVAAAQAAQPSWGQTTLAHRQGLLRKLGERLEEHRQEFMDCLMKETGKSAIIAGIDVTNAIGQCNYYAKVGLEDEVAFEDDALRIISTYQPLGIVAAICPWNFPIILSNIKIVSALVTGNAVILKPSPLAPYAVLKSIELTHDLFPPGILQVLNGGGDLGVSITSHSGIDKVTFTGSTVTGQKVRESCAKNGKRVTLEMSGNDPGIVCDDVDVKKVASLIAAGSLFNGGQMCVCTKRIYVHESIYDKFLEELVNVVEAGFSINKDPTVPTLFGPLSNRMQFEIVTSMLEECKAKGFKIVSGGQVPNDGGYWIAPTIISKPDEDSVVVQKEQFGPLVPVLSWSDEDDVIARANACDTGLGAAVYSSNLDRAQRLARRLEAGTVWLNMAELPHVGGYFSGQKNSGYGGEMGKQGLLSYCHTQSLQIPK

SEQ ID NO: 2968 - protein, 414 aa, Unknown
  Kingdom: Fungi, Phylum: Ascomycota
MTAEITPSKQAAAAIDSFKMESPVKKLDFGVADKENNPDAAVATLAEQIDATHKPVVEEVKKIEEKKTETTVVKHDYSDEPLLQENPGRFVLFPIKYHEIWQMYKKAEASFWTAEEIDLSKDMHDWNNRINDDEKYFISHILAFFAASDGIVNENLVERFSAEVQVPEARCFYGFQIMMENIHSETYSLLIDSYIKEQSQRTYLFNAIETIPCIRKKADWAMKWIADKDSSFGQRLVAFAAVEGIFFSGAFASIFWLKKRGLMPGLTFSNELISRDEGLHTDFACLLFSHLKNRPSKQLVEDIITEAVVYEKEFLTDALPCALLGMNATLMQQYIEFVADRLLVALGNEKFYNSTNPFDFMENISLGGKTNFFEKRVADYQKAGVLASANKKADGASEEPKGENGGDFSFDDEF

SEQ ID NO: 2969 - protein, 371 aa, Unknown
  Kingdom: Fungi, Phylum: Ascomycota
MATSTATTTAQRQHHATTAKPANPGDSVVSTWRRQDKSNWSWHHWLIETLDIHHTFLDKPIPSHPKTEPLPVVKQWSQHVWIMFYAISSLAVHQGLLYITGYRNLNFWVVAFYYFTAFQVILTQEVHILRRFSHTYGFLDGDKHDRNEVPDVGVPRAVLSLLKTLGFRTVMTLWLTYDPAQTPFEAMANPSWWSWLVVKIAAYGVVLDFWFYWYHRAMHDVPFLWRFHRKHHLIKHPVPLLTAYADDEQEFFDMVGIPLMTYYTLKLLGCNLGFYDWWVCHLYVAYTEVWGHSGLRLYLVPPSTIDWLLYLVGMDLTIEDHDLHHRKGWRKSHNYCKQTRIWDTVFGTTTDRIEVAKDNIDFGHEVRMPLF

SEQ ID NO: 2970 - protein, 569 aa, Unknown
  Kingdom: Fungi, Phylum: Ascomycota
MAVSDYTLVHPRLGSIIGFARDYDVVQFRGIPFASIPGRFRQSILRTEQLPTKPFDARQPGPECPQLSLPYPPYWTAPPPNGYPTLDKPVQDEFNCLNLSITAPRKVLESRQHVAVLVFIHGGAFMGGSQSIQLSGREVYDATNLVRASIARSQPIVVVTLNYRVGLLGFLTSDRLAEQSRACGEAVGNYGLHDQRQALEWVSQFISGFGGASDRVTIHGTSAGGASCHYQVNFPNRKFQSAILSSGTSVGIASRPMPWHQDRFDYVISQVSSLEADDPNLLISLTNLPLDQLLPASPPSLYSPLVDGDWVPEAGLKPTLEKLSSAGETLPNLMIGATEYERDLTLLLLSDMSKPLPHPPRPEAQIMPVAQDVLAGSAMIPELDSSDSPFCIPSIAQAYGLRREKTSSDSFQDLAGLMADTAFRVPPVYSAAVIKKHQQRSGDTNPAPVLLYEIQATNPYENWPLSYNRANHGLNDVMLFNPAEDQVPEDHLENWRTAVSQIQGAWLDFCHGKMPWAPFEGAEDVNSLGRIYVFPNGGEGRLCQTLDEVDGKKTATRWRALLNIALEGI

SEQ ID NO: 2971 - protein, 508 aa, Unknown
  Kingdom: Fungi, Phylum: Ascomycota
MAVAELLLSPWTLVAAAAAFYLYPFFITYSSLRSIPGPLLARLSDLWLFSTARRGKRFQLVHEAHKKYGPVMRIAPNHVSINDDEAIQAIYGHGNGFLKADFYDAFVSIRRGLFNTRSRAEHSRKRKIVSNTFSAKSIGQFEPYIHHNLELFVKQWDDMAKNKASPEDGTVHVDCLNWFNFIAFDVIGDLAFGAPFGMLTTGADMAEVRSSPDSPPIYASAVQILNRRGEVSGTLGCMPSLIPIAKYLPDPFFSQGLAAVKDLAGIAIAQVRRRLDNPPPADRKDLLARLIEGRDEKGEPLGREELTAEALTQLIAGSDTTSNTSCALLYHAVRTPGVVDKLRAELDSAIPRDVTVPTFDQVKDLPYLQNVINETMRYHSTSGIGLPRQIPPTSPGVEILGHFYPSGTVLSVPTYSIHHSVSIWGPDADDFRPERWDDATDRQKNAFIPFSYGPRACIGRNIAEMELKLIVAAWVRRYDVVLRQEGMETREGFLRKPVALEIGFKRRA

SEQ ID NO: 2972 - protein, 855 aa, Unknown
  Kingdom: Fungi, Phylum: Ascomycota
MSLLFAESSFCGPVNDSSSHTGASDSHGSTPPTTVSDAASLHSDTSKHDAAVIDPEPLESITVSLPEPFTTIPTEDDATAHTRSLLIATTSLTDTATPSAESTPGRGRRARASAPVYNLARLSGTASHGKRRANGDVVDSKSSLRRQSLANQSTSGSPMSTRQTRPSNKVVREGIDALDLQWSLSKLESPRARRKTQTASQPTRLATRRSASEAVAALSNKVSAIGKRIRKPSEKALESVPRELRKLQDTKEFSHIDDKPVRYTVWSNGKYVDPNAPAEPPAKKVKTGEPLAEDAEKADAASEPITHMRKRRPKKYLDKGLYAGQEKPLDPVKCLLPAEKKKWALLPELHSTGRINTVMPAPVFNGLRLLVHGRDFKLPYNVCHPSPPGQPKPDEWKKMTRNRFIGDSKDYWRKFPMLDDSKCVCTADDGCGEDCQNRIMLYECDDNNCNVGKELCNNRAFADLMARRSKGGKYRVGVEVVKTSDRGYGVRSNRNFHANQIIMEYSGEIITEKECERRMNNEYKHNECYYLMSFDQNMIIDATTGSIARFVNHSCNPNCRMIKWIVGGQPRMALFAGDRPINTGDELTYDYNFDPFSAKNVQTCLCGEPNCRGILGPKPRPKPKQASEIKKAVKATVKAGKRKLKELTGNEDAGAKKASPKRRKVDAVKGVKTSISSASVKIKGAATSLKKSVSVKVSKQKPTAAGKASPAKGGKGTPAKIIKKTTTKRVVTAFKNTPTKKQQTSAKTGTKTTIVVKSPGSSLAKKQTGAAATVAKKQSATKTGTPKAKKASPGKVQKKTASAGTPKSVVSPRLTKKTPRKIIGKIASPRKAIDLAREKSSIRMVTSSAYDDYEN

SEQ ID NO: 2973 - protein, 344 aa, Unknown
  Kingdom: Fungi, Phylum: Ascomycota
MASSKPKILQLGVIEHAHDAWTEISKLADVVKPASKDRQSFIEECRSGALDGVVLAYRTFESVELTGRFDKELVGALPDSLRFVCHNGAGYDQIDVEVCSERNIHVSNTPTAVDASTADLTIFLILGCLRNLPVSMASLRAGQWRGSPLPNLGHDPQGKVLGILGMGGIGRAVAERARVFGMKVRYHNRNKLEKDLEGGAEYVDFETLLRESDVLSLCLPLNAHTRHIISERELSLTKPGAVLVNTARGAIINEAALVAAIESRHIASAGLDVYENEPEIHPGLLNSDKVLLVPHMGTWTVETETKMEEWAFDNIKMALSEGRLKSIVSEQKGRQEKMNGTSAH

SEQ ID NO: 2974 - protein, 1116 aa, Unknown
  Kingdom: Fungi, Phylum: Ascomycota
MSRDSLRSSMTSTTPARPNPRLRASASRDSLLATSTTTRPPRTKAQPPVTTPRASRILATPQRKPRASLVPEPETETVIEDEEPGDRHNENAEDVGTDEPLFKRRLTLTRRPSEVFNVSPHQELFDSIHQDDKSEVATESTSSGEMAPPPMRTIRPRPSLTERTMQSLAQIPSSPAMKKKPSSFFEQPRSRSRAGSTSSRPGSSYNSDGSGRQVPRPLSRPSSASGQDDNGSRPGTANYKSSLSTIDGTPEGLVTGVSSLRLSKSQATPSRGSVSSKLPSGRPSIGGETFATPAKKTYGKLPAKAGSQTIASRPAKTRGATGGLFKKPSLPAMTSTESFAATDASSESNWDSTIPAISPIKPAETAISTPSTARKSSTALRDQIAKAKAAKRAAMKQAVEAQPEADGFEKPIVPVDDGFDFGVAHQDPFNLRRGENPGKKVLQQRVAAGRTTGKLNIAALNLKEIPIEVMKMYDLENIGTGDGSWAESVDITRFVAADNEFETLDDFIFPDHSAVATEDDGEGSGNIFGGLETLDLHNNMLVNVPLGFRKLNFVTSLNLSSNRLSNNSLDTISQMPSLRDLKLANNLLFGPLPESFANLAELEILDLHGNNVSALPRGVEHMTHLRIVNLNENSFESLPFDALAKLPVTELLVQKNKLRGTLIEDPIESLPHLQTLDVSANQLQRIVDLGTSISFPVMHALSLSMNRLQGLPDMTTWTSLLTLTVDENNISSIPNSFTSLEKLRHADFSSNDIRVVPPEIARMDNLSMIRLSGNPLRDKKFVSISTDDLKEMLSARLEPPPPYQEPKNHQVAGNVAVDPKVVQSSDLPHGDNKPPVDDQDDDSFDDDFATPPTSAPNSPSRSRTHTNASLRSRARTLSNQMWPVKSGGLLDRSHTESSSLHPVVASKVAAEYQIKQVQLHHNLFTTFPNSLSFFADTLTSLSLANNQLTAESYLAEDLELRALRELNLATNRITSLRPLTKHLHAPVLEKLDISFNRLNALPTDLKEAFPSLSVLLVSNNHLIELTPESITGLRIVDATNNDISHLNPKIGLLGGKGGLERLDVIGNRFRVPRFNVLERGTEATLRWLRGRVPVAEMAAWKGDDGDGDESPDGGWP

SEQ ID NO: 2975 - protein, 513 aa, Unknown
  Kingdom: Fungi, Phylum: Ascomycota
MTDTRQEPDHAELENKANMAETEFKDVKNESDHTNAVGYKEYLESLDLQFTDKEASRVRWKIDLVILPCFLITQALQFMDKTALNYANLFGYQEALSLKGLEFNYLSAMIYAGYFFGQYPCGWLIGRFQAQKVMAISILLWGLTVVILTQCRTYSSALAVRFIMGVFEAAVTPGLTLMTGFWYTRREIPLRQCIWYSSLGWGGIVGSYISMGVSELPVNMTPERWELIFYILGGVTCLWSFVIWFALPDAPSNAWFLNKRQRIIAVKRVSGNETGIKNKSFDKKQAIVAFWDPKAILIFVSVFAAAIPNGVLNSFSTIIIRDLGFSTTKTTQLKSVGDAVQVVSLLIGGAVILNVPNSRLATATVANVLCTVSAALVAFLPRSNTWGRLVSFWLVNSQSVGFTVALTTISSNMGGYTHRSMASALVFTAYCWGNFAGPFVVKPSQAPTYTGATIGLLVGYSIKTACHLGILFYMLMSNRRRDRVYGPANKEASNEAGMQDKTEFENKDFRYVL

SEQ ID NO: 2976 - protein, 620 aa, Unknown
  Kingdom: Fungi, Phylum: Ascomycota
MGINSSNVATSVVLTPDPQVLPSPTHPLTTAKDMIVEKIEPINNASTFTCKDVPVENQRPLKVRVIGAGYSGVYLGIRIPQRLRNIDLKIYEKNAGVGGTWYENRYPGCACDIPSHSYQYTFAPNKAWSGFYAPAEEICEYIDSVATKYGAKRYIHLQHKVTSSIWDDIAKKWIITVENAEGVSITEEVDIVIAARGNLNDPAWPEIAGLESFKGKKIHSAAWDQDYDFKNKKIGVIGGGSSSIQIVPELQKVEGTQLSCFVRSKVWISNRFGDETMQQLGWDPADTKFSADRLEEFSKDEGSYLKFRKRIEDDGNMVHSSSLRGSDMQNMFVSFFSKITQERLAGRPDLLASFSPTFGVGCRRLTPGPGYLEALTQPNVDFITQGIDSINETGIKLSGTDGRQVDVDVLVCATGFHTSYVPPFPVTGRGGKTLEEKFNPFPGTYLTMGLDDFPNYFMMLGPNSAIGAGSLTCLLEAKGDYIVKCIRKLQKEDYITMTPKRARVEDFTAYIGEYFKKTVYMDDCKSWYKVGGLGNMVSALWPGSILHLMETLRAPRWEDFEYESLEENKLRWLGNGWSMCIMEEEKEGDPSWYLNPEYVDVPPEGEPEKDEKIKARPWSQ

SEQ ID NO: 2977 - protein, 210 aa, Unknown
  Kingdom: Fungi, Phylum: Ascomycota
MEARSLLRPMANLLTKPSTTTSPVLTTTRGHKTTARTKRSLKIAPHPSFQPDRTRPYPAADSIIYNPPSSQATPHHTPFLFLPQNDPRRDALKRIRANNLLPQSTIEPSGKLAPEVNYKRRTPQSNITKEQVEEMKALRAEDPVTWSVNALARKFNCSTIFVKMAAPATKEHTQWLAEKLERRKARWGPMKTQAREDRQRREEMLHRGEL

SEQ ID NO: 2978 - protein, 743 aa, Unknown
  Kingdom: Fungi, Phylum: Ascomycota
MSSKDEDGPDGQISYPSPGAEAMDAGPYYTTTGREGETGQDLHGTGTEHVPEHHEADLHDPNAAHHDPNHESHHDPHHDQQDGRPANLEELQLAAQLGQGLTETPMMSEPEANMEDPNLRSILPHPEPEHQNQNDHQSQPQPYMGPDQSSAEALAAHGMPVPVPPQMPPHYSLPADHVPPRKRSKVSRACDECRRKKIKCDATSDSGENPCTSCAKSNVRCLFSRVPQKRGPSKGYIKELADRINNIESKLQSEDGLGHEDLEKFFAQERQRSSTGPVDEATRKRPYSSISGNEFSTPTTNNRQATWASESRGPQSESFANYTNASLAPEASPIKPDATPSKQAVASMDIPMPDDDDVPEVGDNILHDYVTLIQPLYQVLPEDRTKLQSLLVQSPSPVRTGFLNAVMAIAQPAGGNAKLASSLLNDWENSDTPRTTAANIVHAQALILLVIDADMRASSTLPFLLARAVTLVNSMKLWKMPDMVAAAEPDSDTQLCVRIWWALVLLDRWHAAGTGKPMLIPESSVVIPEGLEAVVGESRYYLIRLSKVLGKVATTIASLPPSGTAEPMAAAILSDYVENFREDLPSHINSSSFPVVHQAYWHARLLVTLLHPVMSGTPNRLLWPTSELITLLTSEPDVKTPLTHHFTSLLVLALTRLSQLDESKESALQLARDVVDQPGATVWDDVRERLSRLTRPISSVEAAASQGLQHLADLATAGQDESEQDLTGQGQGSSLALGYLDLI

SEQ ID NO: 2979 - protein, 527 aa, Unknown
  Kingdom: Fungi, Phylum: Ascomycota
MFRVSRSFSRLQGLPRRPALTAGTRPQSIIVFRQPHQALVPTSLVQRVGFASKKDDKADPPPPKQPIDYERERELGQKKLEARPSEVSTKSTTTNELKTPIENTAGDPILQNELKHDMGIIKDTFSLDNVPHESKVLGLAGTIPYFATSLSTIYLSWDLKQTVPTGNSLYDAIAIDHGTAQYLLSIVEPVQLGYGAVIISFLGAIHWGLEYAEKKPHAERTRFRYGMGLIAPVIAWPTLIMPVPYALTTQFLAFVGLYFADARATARGWAPTWYGSYRFMLTAIVGVTLFISLVGRQKMTQGNALTQEGLKDRLEQTGNADHETDWAKLEEEERERRRKEKAEAEKKAKKEAAEKKKKGKDSKKSKDGKSDDGKASDTKKDDDEENDSKDDKEEDSEDDKADEKGEKDESEDKDNSDGDDESDKEDNEDDQKTDKKNEKKDEKKDEKKDDTKGDKKADKKADKKDDKQGDEDGENSGKDEQEGDEAKGDEESKGGDDKEDKKSKDDGDKKDDKKSDKKSGSDKGKKK

SEQ ID NO: 2980 - protein, 221 aa, Unknown
  Kingdom: Fungi, Phylum: Ascomycota
MSRATPRKGRGHNRDPSNRIPAVSDYESDAAAMHTSYEPPPPRDNNELNLSVLRRYLPSIHTVLSIAANAVVYTFDSLAEQWDKSGIEGTMFVCAQAPLPEDPNQRPRACVFVLNRRGLDNVIVDLARVTHAELTSELVILSVAGEWEGQGPRVMGLWIHNDHEETRQANYAMIQEAWKIASTSGVVEGAGPEVGPALQAVGRRLSLSELFTKQNGAQVGG

SEQ ID NO: 2981 - protein, 368 aa, Unknown
  Kingdom: Fungi, Phylum: Ascomycota
MAYNTQKIKTRILIISDTHSVKPKPENPSDDPPSDDEYIVPANIHNDTTGFKDPLPTADVALHCGDLTTNGRTSEFRATFQMMRAIRAPLKLVIAGNHDRMLDDEFYNKYKRQDVRYNRPEMFRIIKDAEADGVKYLTEGNYTFDLENGARLTLYASPYTPVYGVWAFQYDEVHNFEIPRHVDVAMTHGPPKDIFDLCRDGTRAGCRQLLEALRQARPRIHCFGHIHEGWGAMLAKWNEDSKQWDDVEEATDGAASKVVLTLADQAGQVADAKGQTLSKEKRDEMNEQRGVVVDTTKGEYALKTGEQTLFVNAAVMDRRYHPSQLPWIIDIDLNRTPTPGHEADEGADVKVDAKVQKSGGGFSMPWLK

SEQ ID NO: 2982 - protein, 214 aa, Unknown
  Kingdom: Fungi, Phylum: Ascomycota
MNVASVVRPIGCLKAACRRARYLNAATRGIATAQAKNSTPAWQFAHSKKQREDIEKISKFTIWPTVPSVVANPLPALRAEQVAKLDPTGARTRLFSKEHADSAKVGDVLMVTPKSGEPFAGAFIQIRRQGVDTAIQLRGQLMKTSTEMWFKIYSPTVSGIDIIWRRPKRARRARLTYMRKAKHDMGSVDQHVFKWKKERYALRSKAAGQQGKRR

SEQ ID NO: 2983 - protein, 256 aa, Unknown
  Kingdom: Fungi, Phylum: Ascomycota
MKFICLHGAYGSAKAFETQLAPFVSVVEKANSGKFTWVDGAHEASPPEGFTNYFGPPPWRRHINFDGVSVLDDIIDKIREFPEGACAEDAIRELVGGEAVFHGPAVRSALERIFKMIDDDPEIDGILGYSEGATLASTLVLEERRRFEEEGIPRRIKCGVFFAGWPPLKLGADGKVEPLLADECEDVIDIPTCHIYVDLLACSYIHGSMALYGMCDADTAILFDHGKGHTVPRDSKTVVELAGAIGEAMVKVEVAA

SEQ ID NO: 2984 - protein, 540 aa, Unknown
  Kingdom: Fungi, Phylum: Ascomycota
MAQSEQPKRRFAPVPIETTFQSVRKSSNRPPGPNPELTPEPSPRSTSPPREHKQKRKFAPQLIESSRRSRRVGDAGPATRPTDKTDITPYTKNIYTAKHTSRRPWDDGADEELRRPMPPTRRETEDEGVKEYLLELAAKEAERLIHEEALAAFPNSHAREGGVAHFYFQESSDSDELAEETPGDDTQQRLRRKSSNLGMNWWHKHMQEHVQQAKDDEDAMDVDVEPTDSELDKMDLPAPPDPLWTTTKRAEEEQKLSTKPQTDAQEPIKTDFAAPSATAKPAGSPFGTPFGGLLTKADPKEKKKKGVSPPMLGDDLVFRSCPSPKHTKLETDHPFVEKDRPNKHQDLEGGGGLWRGYCYRSESDETYIVPAQLRPAPMISTPLLPQTPGGPMATDYFSSEPSPVGKSGLHALQGLEERLRRAQARAEKYEKIAKDFTDDFVTQVYNYLSLGYPAMARGFDDELSRISRIDIEELRSDDDKPLAKGYMLELKLQDSRAGQKCPRWRALREYITEWGMQHPDLDNLDPMAWGVRERRGSWGI

SEQ ID NO: 2985 - protein, 312 aa, Unknown
  Kingdom: Fungi, Phylum: Ascomycota
MASHSDRFGPEVDLNSFTQAELLAHFDACVDTGVIKFDCNFITRVHTIDGIDFEFRISKALQSKPHETSSPLATTLSTTSVAPRPGSDLRTAGTEIASLGSTHFLALNGFACYRPHYLMLTTDGYRRQWEPLDIDDFTAVHALLDSVVTGSKSGKGEYLIFFNGGPDAGCSRVHKHLQAIPQESYGGDPWKNMDKGVLPFAYFEHHFGQDGEEFGPEATLKAYNNGMEAVKRSIGAPTVADGEKARAPAHTVLMDRERIVVIPRPKSGTGGVAANAAGMLGMIWTSDEASTQKWLDAGPEKVLKVAGVPKLA

SEQ ID NO: 2986 - protein, 343 aa, Unknown
  Kingdom: Fungi, Phylum: Ascomycota
MFAWRKHRSNSEPIWEEVPVPETPPTGVLCKMIAAGVCRSDRSLLSGVAETDWFTDKWTLGHEGCGRIISIGDKVVNPSFKIGDVIALFAVPGCGADDCTECSRDLSQLCEKGHHSGIGQDGFFAPYATVDARGVVPVPEGVTPAEAAVATDAVTTAYHAITRRAEVKSTETVFLFGLGGLGFNALQIARNIGARVIVCEVKQVLLDEAMKLGVPKEDVVPIGTSPQDFVKQNKLQIDTVLDFVGLSQTFTDAQHIVRRGGKLLCVGSISTENTVYMKIGTRKRLSFIFTYGGQVRDVVEALDLIAKGVISPQVTLAKLEDFPAKLAALVNGEIQGRTALMME

SEQ ID NO: 2987 - protein, 953 aa, Unknown
  Kingdom: Fungi, Phylum: Ascomycota
MRRHAHSCDQCRKSKRACDAPQLTLPAGIEADRALLLSGNLQPPETPPCSYCKKTSKTCTMSWAWNQLHLTNVLDAASRRNLDGIESVPAKRSQPADAGELSDSSSQSQYGDRSDSAPLMGSGAMPFAFPTSMPQQTPPMMHAQHNTDAPLFPGPLPGGMPENLFNMQGSFNGMQDDGSVPNLGMPDLGFTFNDGIPHSGPMDPSMAYAFSSGVSPPSTAVMSTPYDQQNADLSFPVAGNNQDLLNTPMNSNVGVSRAYSARSDSYSDSQPDSKRRRYTQNAMEVATRPSMSPFNIDQQMMKMHTRSMFSESLIRVYHDVLEHNLSCWVTEATCPYSGALTRQDGRQTAEWGQTWTNRILDRTMKLDAATKASGMVTLSRSQEQAASRAIQMAIMAFATQWAQGSNRKTERYSPKSPSESGSERTDDAPSVDFADSLDRMAQQHFWNEAEKALNEVANVESYAVVCAEIILGFTQKPWTPDETETSQDDVPNDRKNDAFDMDSLMTEISNCIEKDGPPLYLERAARKAHALKFRVNSAAKGIAKRQGLTKRAARGQVLSKDDEKTAGLLYWLAVMADTISSSMNERPVTVNDEDSQHDLVSEEDREGGRWNVELFIKDDLENPQMRLTWPCSHEEAAEGVTVAGPVKILMYRHVAWLQGMLRRGQSGKRVEDVVYSGLRLWKYWNQTHGMFFRQLVEDSDNVPIRVRGWFFCISAHWHLAVLLLIELIEVVDEDDQGTAEGKQMRASRRTLGRMREVSLRELSDLGRMSLPPSETNRPPLSMLGDSGMQPEIHHAISEATILSEPWTIILIRAFSRVAAMLMKEVNDARHFGTVPVFNESESLRRAEDCIKTLFYLGRKSDMARRVADKLSDAMAVLEGSQGGNMPHPDDLHGDMFESLHSNLDNHITGNGNVHGHHAYGHGHGHNGSGHNGGNMAALNQSQFMGMAMPTGTA

SEQ ID NO: 2988 - protein, 330 aa, Unknown
  Kingdom: Fungi, Phylum: Ascomycota
MSSVPSVLTEAEKEHFLQNGFIHMKGCFTREQAEKITGNVWTRLGMDPNDKSTWHRLRTNMPGHNAFGADELAPRAWEAICELLGGEDKINLRRSKTWRDSLIVNLGSTEFEGKEVNPQDLPNWHCDGDFFVHYLDSPEQALLVIPLFTDIKPGGGGTIICPEAIPKVAKHLHDNPKGVSPLMWPRGHPEFKNEGNREFSLNTAKSCTNFVEATGEVGDVYLLHPLMLHTPSMNPLRQLRIITNPPIAVNEPFEFNRPDGNYSLVERATLRALGKDSLPDWKIAGPREEVIPARVRIQAKMKEEEDARLAAAAAAAEAAKGGQAQAVAAN

SEQ ID NO: 2989 - protein, 419 aa, Unknown
  Kingdom: Fungi, Phylum: Ascomycota
MGAIERISQVAGQLSGNPTAGGRDKILQKNPDDVVVTACCRSALTKGGKGGFKDTPAQDLMAGIFKAILERSKINPALVEDIAVGTVLAPGGGATEMRAAALVAGLPETAAVRSLNRQCSSGLQACVDIANQIKTGMIDVGIGAGVESMSTQYGPQAVAEFSDLLEGNAEAANCKVPMGVLSEDMAKDLKVDRASQDAFAASSYQKAVKAQKAGLFDEEIAPLKAKFEDPKTGEVKEITVARDDGIRDGITAESLGKIRPAFAKDGSIHAGNASQISDGAAAVLLMRRSTAERLGQTIIGKYVCASIVGVKPLLMGQGPWKAIPKALDLAGISKDDVDIFEINEAFASQCLWCANELGIPHEKINPKGGAIAFGHPLGCTGARQVSTLLYELKRTGKKVGNTSMCIGTGMGMSAVWVAE

SEQ ID NO: 2990 - protein, 764 aa, Unknown
  Kingdom: Fungi, Phylum: Ascomycota
MHRAMASRKVARTLVSAEPLSSSFVVPLFLCPALARYSSSSTLPRAQAAPRVIPTKPTRFPLCQRRSIHTQTIKAVSDAELDPAVAGQPVEEDAYLSQSTARELPISCTGCGAFAQTDDPESLGYYDLKAKRVREWLKPSKPRSKTAVAAEEDQVVESVLANLNEAKLQELGMDPGLLRLNDEAASAGVPSVPLCDRCHLLTHEIGNPNKVEMFHPTVDSLRETIEESPHKNNHIYHIIDAADFPMSLIPRLNVLLGDIPLRTKNRRSRSAKYMHDRKTEISFIISRGDLLGPTKEKVDKMMPFLREVLRDALGRIGGRVRLGNVHCVSAKRDWWTRELKNNIWKRGGAGWFVGKVNVGKSRLFETVFPKGMVSQGRTADGTAATSSESSDPESLPEPEDPASDDAVDFGDLLPPPRPLEMYPQMPIVSSHPGTTASPIRIPFGNNRGELIDLPGLSRSDLELYVKPEHRNSLIMQKRIVPTQISVQSPRSIILGGGLIRITPKTDDYTLLFYNFTPLKDHLTATDKAVEFQAQTRHVRDIENLSTEEAAEKMRSAGIFKLKYDVTKARAGPLTSKHVGGLSVDRLPFRVLSVDILIEGVGYVEVVAQVRKRDMEDMIAGDAAQDAAANPPAPWSPRHQAEPEMKPEKDVSVDPFQQMTDNRIDASKSAKPNSKPTSKPTAVLSRQPQQQPQQAVQQRTRPTKEWPAVEVFTPEGRFIDYRQPINGWLNNKPLVKDIHKKQRPRKSMRGQKKMEKVARRAQTDA

SEQ ID NO: 2991 - protein, 232 aa, Unknown
  Kingdom: Fungi, Phylum: Ascomycota
MRRSAEMIANLSPSTPVIADADTGYGGPIMVARTVEQYARSGVAALHIEDQVQTKRCGHLAGKIIVDLDVYLTRIRAAVQARRRVHSDIIIIARTDSIQKYGYTEALTRLRAARDAGADAAFPEGLRSVEEARRMIADLAPWPVVLNMVENSVTPSISAQEAQKMGFGMMIVPLATLAPAYTAIKASLQDLKRTGSAETRLKAQDIFRVCGLDESIRIDTEAGASEFEGGVD

SEQ ID NO: 2992 - protein, 629 aa, Unknown
  Kingdom: Fungi, Phylum: Ascomycota
MMMVSPRTEALAGVGFAGYRDVRQYVPSSAGASPTAAWARKRAASVDAMEEDRVKLEQTLPGAPRGMLAEDQRDHVCLCTSDPKIPRPRNAFILYRISHHTKVAQENPGLSNPDISKIIGDKWKKEPEDEKERWRKLADEEKRRHQQMYPEYRYKPRRASKGQPPRKGGTSPVEETGRCPKCNGRLLTTPDTFQNSSNPITPKNEMNDPLSAQGNYSYDSLAVDRRRHSVQTAPVRSLNEESPEAKRRRLNENGETQLMQPPSGTPNSFTPRQNAEAFQAGPGSAHTPSRLPFSGGPLPQPGGIPRSQSGPLNAPSRSFSTAQWNSPGHGPRPAGPNPSFQLPPLRTSTPPQPSGLGLRPAISRHGSFTSEVMQIPVDRKLSTLMKLCRTLPNRLGRGQIIAVEGPSEGSALGQISQVVEQALQNCRNVSVRSWAADPSGSASRSTLEDTALGNTYSAVSIPEYYSSIMSWHEKSNQITRHVNSNVRDQVSSAIEGRPNSPFAGSPTMDRSGARLQPTPVALIKDGYCLTESDRFACNSAAAENWSATDHWQWAAMLWRGIVAPDLTVYICPSRSEEIEHMGSVDFQRQLNLMMVRVPIDLEVSESTTRRVTFEVKEWMADRLPRQSGN

SEQ ID NO: 2993 - protein, 283 aa, Unknown
  Kingdom: Fungi, Phylum: Ascomycota
MAETAGLVVGVVSVAALFNSCIECFEYLRLGKSFGRDYQTCQLRIDVAKLRISRWGEAVNIRQKARFAAEPVQNDADAMLAFCCLDQIHHLIQGVQKSAKRYKLVDPSRDTSIAASTDMTLIGRNVHNRATEMWKRRQSGAGNLDKLIWALYDGKEFNRMITQIMDLVDDLEKVFPIEPACQRLVQLEIKEFDDDLSLATLQQGAESTDQVLCDALARKRLLISGSNSAGAIQTEAFADVQIGNQFTANFLAQGLYATDRTRNSSGDISAGGNSRVQIGNRFG

SEQ ID NO: 2994 - protein, 408 aa, Unknown
  Kingdom: Fungi, Phylum: Ascomycota
MRSPTLLVSLLLCLTQHETGVTALDIGLGQQPIHHAASQPKSVSVRLFAELERLARLVDISYCIGITGVSKPFNCASRCNEFPTLSLANTWNTGLLLSDSCGYLAVDHGASCSDIEGDIPKSETGHKAIIIAFRGTYSITNTVVDLSTVPQKYLPYPSPDHGGDAPTKPEHRCDNCTVHQGFLESWQEARKLVLPELEGLRAKHPDYPIHLVGHSLGGAVACLAGLELKVSLGYDNVVVTTFGEPRLGNFELARYVDEVFSLDEDTELETSSYRRVTHKDDPVPLLPLTEWGYRPHGGEIYIAKHDLPPSEKDLQICKGNSDPSCSAEEDSSLTEAMRRLLPWGETDENKKEAGLDEEHVKGFPTRYKLWQLFFAHRDYFWRLGLCVPGGDPANWGRERYDLVNGDEL

SEQ ID NO: 2995 - protein, 365 aa, Unknown
  Kingdom: Fungi, Phylum: Ascomycota
MRGTSQWQQQARYAPLVPCYVAATVRKELYVKHKPQQATPATAHPSIPSLGAGSRFVYIRPDALSPPDYSRLHPAQISPDQDILSAPVAYKPSPLGYGSPPAVRSSPFRRAESPASPSPLRYTTPTGSPTKTVPLHGTPSRFAPEPRTPTSPREREYTPAREAAASPQRPPTMRTTTAKPALGNGNALSQLQPSQVTSLRDGFQILDRDCDGVVNRDDVADMLNQLGLPSGHSDVSRFFPPSSPQTIAMPAFLNSLAEALAALSPSAELLSAFSAFDDDDSGQVDVAELRDALLNTAPEPGQRALTASEVDKVMEGFTGRRAFNRNMNAQLGSKRGEVFKYQDFVNSVMGSNAGSEGNPQESSER

SEQ ID NO: 2996 - protein, 847 aa, Unknown
  Kingdom: Fungi, Phylum: Ascomycota
MAPARDSAPAQAREGSFWWTAGPMAPPVSACGGGIDSRPGSIAASESDGLFPVYHGFPSDSGTSASRSHGYAQQIRHGLASKRPRPEMKTFLDLESLSARSLASSRLSSGFSTPRTSKPRPDDFDANLFLFSGRTSTATITTTTETAEATNLMAVTSTDTTTRTAGADATTLHHSALRELRDLELMQDTDLGLPDRGRQRTRANNHHLRVFDHLSIDERPSSSRSHLRYLHRSKSPVPHASKYLRVSSDGSSPSINNLPSMTMTRDEFDALPPTIQRKHLNKPGEPILCFLTLGRLRLPATCSPIYAVTVAQADSITPAAMSTHPWFATAVRIWLQLRRLHWAPQAQPPHHQQLPTPISPDKTPTLVPLLLAQYFSTLERIHISQNPAPFPESAPPTDVRQDFPPLGLNDLSCHRPSVLTTLSDPTSTSGHGHLRINSTEQRFYANLPDKIKRRHLSKEEQLVAQRQHRRRSLSVGAADDLRPKQRQSLRALGATNPSLGSTISLIEELPKMQPRQTEQVSAQGRPQATEGTFFETFRWLEDEDDLDLRLFLDDYHINLRDEVPLPSKSRRPSFRRHLSISKLPFGRTSISTTRPSTSSKGMVTTPTTAKVPSLFGDGPGHTPRKSRALSLVNGNRQPMPLSPTTAAAHYHDPEARLRLREYIGSSTKFDEALEYGFPSMEDRPAKRGKAPLDLKLDFDKPKTFLDDDDDRSSCSDEASLADPETPRTPHAFEKPSTEQSNTMTAFPISDHKADLLQAPLSSREMTLRMTLTRPDLRANEDQMYGWQKDGLNRPPHTRSGSKAPTILVRDISPKESIEKQFAAFDQENLAANDNGVVKRFWKRVRRT

SEQ ID NO: 2997 - protein, 508 aa, Unknown
  Kingdom: Fungi, Phylum: Ascomycota
MVVLAASICTRGGKAVLSRQFREMPRSRIEALLASFPKHADSGTQHTTVEQDNVRFVYQPLDELYMVLITNRQSNILQDIDSLHLFAQVVTSTCKSLDEREITRNAYELLSAFDELVTLGYRENLTLSQIKTFIEMESHEERIQEIIARNKELEATEERKRKAKQLEMQRKESARSGRAPRAPNYPTYTPPAQPSTTTYDSYEAEKNKTFNKPTAPKGKGMQLGKKSKTTDMFNRVRGDMGGEIDDTPLVAPTPQASEQAEPRISSTLDRDAIHVTVSEAITAKLSREGAVNSLSVSGDLTLRVSDPSLTKIKLALTAVASHGAQFRTHPNVDRNLFNSSKTIQMSNTARGFPVNNAVGVLRWRATPKVDDTSACPITFTVWINKDADKFNITIEYELTGGEALNDVSVVVPYSGSEPVVSSFDASYEVLGDTLEWNVGNVDDEAPNGAFEFEAETVDENDFFPMVVRFNKATPYIDVDVSSVTLLEENEEVTFSKDIKSGADNFLIE

SEQ ID NO: 2998 - protein, 285 aa, Unknown
  Kingdom: Fungi, Phylum: Ascomycota
MQLLESYRAQVSTSSRPKELTFVPFIPADSNYQERSPWPASPYAYDIVHASNTSTIWSSFPVTDELQLLDWLSEHTTIPVPRVRSQGFNTQRRQHYAQFDTPRGLPLDDCWDDLSDEAQIRAIEQLRSIMKQLRAVTEETLPNHGTRDMFLDRRDGVVAGPFATQAEFLKALSVRIDAIGSIYNPGPTRKAIRFIEAMEHMSTDRRMVLTHGNLSPENVWVDEAGEVTAVMDWSQAGYAPVFWEYIKACLGDEESGVHLDGLYDEILEPWPLHLAVMMHVHDIIW

SEQ ID NO: 2999 - protein, 460 aa, Unknown
  Kingdom: Fungi, Phylum: Ascomycota
MKVFTCTLVAAQVYSACAGVTTLEKRLDNGLGKTPPMGWSSWNVAQCASASAKYALDTANKFVSLGLKDLGYTYVNIDDCWSTKNRDGSGNLVADPSKWPNGVKAVVDQIHGMGLKFGLYGCVGTLTCAGYPGSWGHETQDAKLLANWGVDFWKYDACYTPCANGQSPQTCWDPAYNTRGWYEKMRDALASVKGTKNIYYNLWNSWRMSGDNWQDWASVQRIGAAAAGISQYSGPGGFNDLDMLIIGNNKLTENEERLHFGLWSIAKSPLILGNNLNTISSASLAIIKNKGIIDINQDPLGKAATTFRPSGSPNPVNGQIYPYWAGPLSDGVVIGLVAANGAATLSVNFKDVPGLSAASYSWKEMYSGKTGSGTSVSFSLGNHDMAVIKVTTSGGGGAITTTTTRTTTSAPPASTTAGGGGGGCSSPQYGQCGGNDWTGCKSCASGTTCKFVNDWYSQCL

SEQ ID NO: 3000 - protein, 505 aa, Unknown
  Kingdom: Fungi, Phylum: Ascomycota
MQQQYRAYQQQMPPQVPHRSPHATTQRRGGYGPVMTGGQPAMQPAHVQNQHNMQQQQALQAAEATKRLKTRKPTDKTLPDGVENCIIDPEVARRYKELRDVERRIDTTMTRKRLDVVDSANRNAKLYRTLRVWITNTVEDQVWQGSGDLNVDAFDFSPNMEASYRVKIEGRLLDEDDDADSPKDSNEQDGDKMDEDAPDSDKKTGPSSSKPRFSHFFKEINVEFDKQRYRNGADQAIEWKRPEPGARAQPGANQAADFDEFTFKRNGDENFNITINLHRFEVPERYSLSPELSDIVDMKEGTQHEVVMGLWEYIRMNGLQEDEEKRNFRCDELLKRVIGQTDVAHIPMLNEYVKRHLGPQVPISLPYTIRVDEDFHKDPQPTIYDVQVLVDDPMRATLQSLVVNPQYASMLKDVTDLDDQLGRLVQAVAVSHAKHSFFNSLSEDPANFVRNWLSSQKRDLDVVFGETARSGAAVAGDEWRKGGKDSIWATSNARESVNVLLSKQR

SEQ ID NO: 3001 - protein, 254 aa, Unknown
  Kingdom: Fungi, Phylum: Ascomycota
MEQQTTGQQPVVGAEPNALKVANPAPQPPPSLIKSTSPDLNLSSFYCEPPSKYSNKTQVVDRVLQSPSLEWLNRTWTVTHSTLDMWRSARNVRISYTTLPSSPGKPDRIDDLVEYEPNNSSTPKLKTVRGVDTRGSNGWDWRGKSWLFFVTSHWEILSWGEVLSEDGAEVVERWAVTWFAPTVFTKEGVDVYSDRPEGVSEQTYKKIYEGLEGMVENEEGSVKDSLKLGKGEDIVKMWREDLVPVEIKLPWVQG

SEQ ID NO: 3002 - protein, 480 aa, Unknown
  Kingdom: Fungi, Phylum: Ascomycota
MAGKPGSRWANAAEDAELDAKLKREKEEKRRRKQEKIAAAEAAKAEAERQAADNDRPSKRRKLTPDPTTTKDQSTVTPDGKELPPAKLLRFERGSWGMARSVEEYDKLNDIEEGTYGWVSRATAKKTGDVVALKRLKLDPVDRGGLPVTGLREIQILKDCRHRNIVELKEVVIGDNHSKLDNSIFLVLEFMEHDLKSILDDMPSPFLASEIKLLLLQLTTGLSHLHAHHILHRDLKTSNLLLNNRGVLKIADFGMARYYSPPPAAGNNDTPASQQQKLTQLVVTLWYRSPELLLGTKTYGAEVDMWSVGCIFGELITREPLLQGKNEADQITQIFDLCGFPTDASWPSFRRLPNARSLRLPRTSNPTSTSQLIRAKFPSQTSATTSLLSSLLALDPAQRPTADEVLRHDYLVKDAPKPKPESMFPTFPSKAGQERTRRKAEPHAPGRGDEAVDLGEVDFSGIFGGRDKEERGAGFTLRMV

SEQ ID NO: 3003 - protein, 203 aa, Unknown
  Kingdom: Fungi, Phylum: Ascomycota
MSRVTQLSRTVSTAASRASSPLLDSTAHGAGASIMPKYADLLARRSNENQHDSRSITTAHRPTPQPSIANRTRPLMQTFSSSSKRSQASDVTILPSSSLLQSSSAYINEIRVPLLPDAYTTAHPEAAAPIVETPEVTIVASDPENVIPASALTEVASAGGADTINLGFAHSSQQAESKDEGNMLTDLWKGMVDDVFGAAAKKA

SEQ ID NO: 3004 - protein, 356 aa, Unknown
  Kingdom: Fungi, Phylum: Ascomycota
MSSTTANNNKPPGAYLEYTDHGDIFTTHRFPETIVDLGEIRMNYAVAGSSDKPALLLVPGQTLSWWSYETGMEHLSSSYQVYAVDLRGQGRSTWTPGRYSLNIFGNDLVRFIDRVIGRPVVVCGLSSGGLIAAWLAAYALPGQIIGAVLEDPPIFSSQLSPPLGQSAKQGFAFPLFSAWTKWLGPQWSINNEEGFKANIGREMPWWFANAIEGAIKEGLQTIGAGLPPRYYDPGWASAFEAGKMDVNCDHEAMLKQVKVPVLFTHHLRYIDPVSGNLVGAISDVQVAHVKRLIEGTGNSFTLLSFPRHAHSMHGTDPGTYVTTITKWMAEKGFGQEVKVAADGAGEVSQAPERTLS

SEQ ID NO: 3005 - protein, 239 aa, Unknown
  Kingdom: Fungi, Phylum: Ascomycota
MLFQSLFALTALATASSAQTLNIPTRVGNIISLPSASSISGSVDLGNREYDRGRPCNSDEDTGSQNAVFILENGATLSNVIIGKNQLEGVHCKGACTLRNVWFRDVCEDAISALGTGNVLIEGGGAQDASDKVVQHNGRGTVTIRNFTVVTAGKLYRSCGNCSNNGGPRNVVIQNVKAKGVSELVGINSNFGDTANISGSCGSSVKKTCQEYKGVQKGSESSKVSTTASCKGQTSFSSC

SEQ ID NO: 3006 - protein, 326 aa, Unknown
  Kingdom: Fungi, Phylum: Ascomycota
MAPQITRNSILSAAVAVLAALPNAAAQCALPSSYSWSDSGVLAEPANGWASLKDFTTVIYNDQYLVYATKHDGNDYGSMAFGLVSDWGQLGSASQTAMNQNTVAPTLFYFEPTDQWILAYQWGANPFSYLTSSDPLDANGWSSPQPLFSGSISESDTGPIDQTLIADSENIYMFFCGDNGRIYRSSMPIGNFPGSFGNQYETIMQDTKENLFEAVQVYTVGDSGTYLMIVEAMGSGGRFFRSFTASSLDGEWTPQAATEDNPFAGKANSGATWTNDISHGDLVRSADQTFTIDPCNLQLLYQGRDPSNVPDDYNLLPYRPGVLTLN

SEQ ID NO: 3007 - protein, 369 aa, Unknown
  Kingdom: Fungi, Phylum: Ascomycota
MRTALLTGALFATGVWCKDAGKKKNIILDTDLYSDVDDVGALLLAATLPSSNLLAVNINVPSTYSAHAASALLGYYGHSGTPLGIARPLSNMTFFDGFFYEMGEYASKIAYHFRDYAKLEWEDGWGPGELERSAENGTEDAVDLYRRVLAEAEDGSVTICSVGFFNNLSGLLNSTADSHSDLDGPALIAKKVAELVVMGGEYPSGSEYNFFGDNPLHTAHVINTWAGRITFSGTELGGHVFSGSGLLSSGPKSDPTLKGYAWYNYGKPRESWDPLTVVYAVEGLGCLFEEEGKGGRNYVFQNGSNEWRWDKDQKEGEDDGEKRGEQRWLKLKVKNETAEAVLDDMFLRGAWSHKKSDYKKDGCKGKEEL

SEQ ID NO: 3008 - protein, 130 aa, Unknown
  Kingdom: Fungi, Phylum: Ascomycota
MPNVRKEPEPESGMKRAADFQEGFMGVPGYSDDSLLSVVRYVSQVQMTLRKCDFDEFMEELKNIENATKAPAETPAARIEKIKEHRAKAMAKIAEFPELTAGFETFMTNSKRLRRQQNEAAKDSSSSGPQ

SEQ ID NO: 3009 - protein, 625 aa, Unknown
  Kingdom: Fungi, Phylum: Ascomycota
MEPVVYEETPLADYLQDDGNESGEEWAPVHETPPAPDSGRSSPSLPSSPTIGFAPVGRPLIRARFRNKPKPLHLETTSVPSSFRAINRTYSAAVAASLDRGDTARFLEQFRYTIVASQLLNGHSLLGQGQLAPVDFPPVADTADKSLVSVEGIFASVLGALGVAVILSWVLGNAPSYFTRKRLIFLVVLLVAAVLLGQVYMRRQWLRYRRQQSLSEIRTFVSNAQDFDSAAGAALSLIQEVELVSRGYRISLPLPPISRLEDRSQSRKCVRLRRTLKKSFSDMLQTYNQVAKVVRGFAEQSDLEKYYDIYDVSDFDMSDALRGFDETEFDDFESLRTLKILAARFQMLRKLFLCGLLALDACGDERDLLRWTTAVEALRSVNETTEKTHTQLQTILREEESFPTPPTPKNPLSPGRERWRSQMHKLNSLSTGIRGLQAKLQLLREESDQALDDSSDISELGPNLMSQYESIGADLKEVMSAWEEGKAALAVGIDRNEKRLSSISTLLSPSSSLSGLTAVEQSGTAADALKALTGQSPTPSEANEESPEVFEAVAKPRPRSMLSREERLIKMREDREVKAQARSHFDATRGMLKELETVINLRPRKRLSTNPPSTPSTPAGRIVSM

SEQ ID NO: 3010 - protein, 611 aa, Unknown
  Kingdom: Fungi, Phylum: Ascomycota
MVLARLRTGNAAVQRWQATRIVAARAPIAARCYSTDDGSKTPARREGSGIPETKSNRSFQGQVMGSIGARLRREREQRVEYEKWRTTTDPMRNWSFTFVFLFGIGSAYWMGTYYQREPEPSSTLPLNKTNPPKHNTKLENMQAAWTDFTNILGKENVSTGEDDVEHHAHSEWSSHRAEPNERPFCVVFPSTTEEVAEIMKVCHKRRIPVVGYSGGTSLEGHFTPTRQGVSVDFKRMDKVVALHKEDLDVVVQPAVGWELLNEQLAKDGLFFPPDPGPGAMIGGMIGTGCSGTNAYRYGTMREWVLSLTVVMADGTVIKTRQRPRKSSAGYDLTKLFIGSEGTLGLVTEATLKLTVLPESTSVAVCTFPSIRHAATCVSHVVGKGVPIAAIEILDDNQMKCINEAGMTSRSWTEAPTLFFKFTGTPSGVKEQIAQVQGLAKQSGSKTFEFAKSEEERAELWSARKEALWSTMAVRKEGDRVWTGDVAVPMSRLPQLIEETKEDLRKSGLFGSIVGHVGDGNFHSILLYNDAQRKKAEAVVHRMVKRAVEMEGTVTGEHGVGLVKRDYLPHELGETTVDAMRQIKRAFDPLNILNCDKVVRMQKPARGEVEEW

SEQ ID NO: 3011 - protein, 317 aa, Unknown
  Kingdom: Fungi, Phylum: Ascomycota
MFSDLLPIMAAMAMLPGTESAKHGISSCTDVSCSVDGPDDTCTLAEDTFPGIGVINVKDIPPALPQISIVKGVTVTDPLYTEDVSDKYILPNGYAISDGYKSVYYLDTPASVEISDISGCVALFHGAHEGLRFFGSRLEESNGVCEDLINDGCISALKDLADSASKEGQPCSALSRMLAEANIDTCGNFAGVGRGLGRYTVTDLADLEPITAQENKTSDCWPIVPKTSNLSYIASDVASGNTIADTWLSELYKITPVLTLLVDRDADARSSQLSCVKVVTDMHVDREGMVWDGADRKSLSEFAMVVAMAAIIWVFQT

SEQ ID NO: 3012 - protein, 499 aa, Unknown
  Kingdom: Fungi, Phylum: Ascomycota
MSFSRVTKLALAALTFVSHVRGDACDDVESLTSVSVSRPLTLSYISEQNEYWSEACSMLKPVCIVFPTTTEEVSAVVKILAEHDHDFAVKSGGHSPNKYFASVDEGLLISMSKIEHADLDEETGVLKAGPGNRLDGIAKKLDGTGWTFVGGRIGNTGIGGLILGGGLSYMSAQYGWSASSVYEFEVVLADGSIITASEDSHTDLFHSLKGGGNNFAIVTSYTLQTYRQGDVWGGNLAFLRTSKTDQKLLQAVRDFTEYNDDDKAAVIVTAERGNIDLIDSWILFLFYDGPEAPAHIFKNFTDIGPVLNTCKTQSYSKLIGGSNWVIVPASHVLMGTETMPIPSAEDAATVFDELHSFWRQVSSTVLLVPGIIASIAYQPFPKRIALAARSRGYDLIDAEPDANKLIIEINYSFLPITSYNAMSDVLAQTYTGYRQRIQAWQADGTLPSDVYLPLFMNYANQRQDYWARLKPQSRALAHDTAAEYDPDGLFRERTGGWKP

SEQ ID NO: 3013 - protein, 71 aa, Unknown
  Kingdom: Fungi, Phylum: Ascomycota
MPRAIRGVLIECDPSIKSIIVSIDSQNHEYIIEDLDEERVVVKENMVALLKQKLEDRLKENLPPVDESGSE

SEQ ID NO: 3014 - protein, 1282 aa, Unknown
  Kingdom: Fungi, Phylum: Ascomycota
MTILDINKDLAALFEQQAQATPDAIALEDEKRTLTYAELDSETFALAERLRDLGVGRDDLVGVLMGRSADNVIASLAALRAGGAYLVLELAYPSGLLREVIEDANPVVVVTQKAHAGQIKANVPIIVIDEPEPKTNGKHSPVDHRARKPLPEDHDVDRLAFVSYSSGTTGRPKGIANPHKASVRSYDLRFGVSNLEPGDRCACNVFFVWEMLRPLIRGATTVAVPDSASYDPVALVDFLAERKITDTLMTPTLLSTVLSRHPKLGETLPHLRSLWLNGEVVTTDLCRRATTALPNAKLLNVYSASETHEVAAGDIRTFVDYEARVCPVGPPVDPEHTYILDEAGNRVEPGVSGELFVGGHLLAREYLNLPETTARDFQPDVFDSTKGARMHRTGDLARILPSGLLEITGRVGGMIKTRGYTVHPGAVETTIVKHLAVRSCAVVAHGDGLERQLIAYIVPDREEVGHRTIVVIDDSGYSPVARRALSSHLAHYMIPPIWVEVDTIPTHGISGKIDTKALPAPPAPKSPTTEQPKEQNTKVKMETIIKMWAASLNMPVTAISKEHDFFDLGGHSLTLADLASRLSSTFGFPVPLAPLAGTPTLEGHLEAVKAARDGHTEAVQADLPSVLRADCILPEDIQSTGVAMRRISEVDTILLTGATGYLGAFLLKSILESTSAHIICLVRFTEPLEDHRAAGMARIRNNLVDLGIWEDSILDRMEILPGNLARTRLGLSPEAFEEVAGRVQVIIHAAATVNLVYPYAALRNANVGGTREILRLASRSGATLHHVSTNGVLPPSVDGWAESSLLDIDAVPTQILDGYGQTKWVAEKLVYEAGRRGIPVRVYRPGTISGHSVTGSANSWDLLNAIILEAVNLGVVPEIDGWLAEMTPVDFISSAIVTLADHTSSRQHTYHLGDSKPPTASDVFAVLSQLGYDTSKSLPWAEWVELWKAKRGNGKISPEPFPVEILRGGMPTVEGLKSVSILNNNVTQPALDSYGLKRPSIDASLWETYARHFYARGWLPKPPKRSQANGVAVPSKKGRLAGKVAVVTGASSGIGAAVAAGLAREGAHVAIAARRTDALEVVKRKMNGPGKVLIHKTDVTNKQQVESLMKTTAEKLGPVDILVSCAGVMYFTMMANCQTDEWERTVDVNCKGLLHCLSSTVPKMLSRGGGHIVAISSDAGRKVFPGLGVYSASKFFVEATLQSLRLETAGTGLRVTAIQPGNTETELLGMSTDKEALKKFGEPTGAKVLDPEDVAGAIVFAVCQPPHVAVNEVLIEPRDEPI

SEQ ID NO: 3015 - protein, 501 aa, Unknown
  Kingdom: Fungi, Phylum: Ascomycota
MFRIWRPKEGQYGDQKPLGSSLKSETLSYPELGMHVVQNMDCSVDREHLAAVQRRNGLEDRIRYLKRYIRFHRTPDLKRQSLSRTTQSFLPSEIRTIDIRKKQPDIQCDPALEVDVTTSGTPSTVDASLFMFGVSTTYARLMNTETSPMEEWKFWLTDGRRRSNGGKLILALLDATDAQLQEVANILADAGVDVDVYHSESSLPMAVRYFNLIPILYNHTEAIYKNWLVLCDDDTFFPYMHKLVDTFRAFDATVPMYVGTLSEDVFSVERHGSQAFGGGGIFLSLPMANVVTELYDSCTTRDKVHESDTGWGPQGDILLRKCIYENTDVRLKTIWDLWQLDIMGDGAGFYEWGKQPLSIHHYRGGDWTSAKPVEFTKIAHICGEDCSLQRFMTQDGFLISGHSVAYYPEGTEFDWDMVERTMEAMPKDKGWNLDFMFGPQRPSLSRTGKKVAWDLQESQLRDDGSVLQTYTRRWDDWRWMYPDDSPMSNLDGILELVWIPG

SEQ ID NO: 3016 - protein, 448 aa, Unknown
  Kingdom: Fungi, Phylum: Ascomycota
MAVASKAALGLPRSLCQYPIHAYYTVIALMPRPFFRFVLISATLLFFSALLLGASSHNPELSKTLKGTATKAHDKVFPHPKGSHEPLEPFPETPMVSAAEGDSGRGGDRVEVPWLAAVISPAYDIERRMMIRSTWMQMYADVPFDARFVVSNPGPKWMEAVRFENRTYGDMIVLDHIPENRFTANSIKTLEFYKWLLKSGRRYEFVSKIDTDLWFNARGFWHRYIEPRLINTTTSPSSETSMKATVERTAIGQLYYSRPYHRAFPHGSMYTHTWDLVELLVTLQERNPVVMGEDQAVTKLLHDAGEHANLVNMNTAEKFDYDDADSRTADSAWARAATHPTATLHALYGSEVLAVHQLKDRDLFMKVAICFDSAGIKTPPRLEGPEKTPPFFTRLHDFLDSLGWSTHFEGQLERIPASLYHQEGSDWIVNDVWNLGPDMSGYQKDNKE

SEQ ID NO: 3017 - protein, 664 aa, Unknown
  Kingdom: Fungi, Phylum: Ascomycota
MASPETKKTPVLPVEGKRNILITSALPYVNNVPHLGNLIGSILSADVFARYCRARDYQTLFICGSDEYGTATETKALEEGVDPATLCAKYHALHRGIYDWFRIETDIFDRTPTDNHTRIVQGIFTDLWNNGFIEERETSQPFCPVENHKSFLADRFVEGECSICGDKGARGDQCDACGSSLDPLEPDRDSDGAQQDVGAAGWLINPHCKLDGATPERRKTKHLYLKLNALQEKVAAWFEEASKTGGWSLSALSITKSWLDKGFQPRAITRDLKWGVPIPKVEGLSEEEYRNKVFYVWFDACIGYPSITNTYTADWEKWWKNPDNVKLYQFLGKDNVQFHSCVFPASQIGTGQDWTKVHRISATEYLNYENGKFSKSRGVGVFGNNAKDTGIDPDIWRFYLLSRRPETADAEFKWEEFIDTNNNELLKNIGNLCQRVLKFCAAKMDGVVPDAGNYTDEGLEAHKENARRVLGDYIEHMEATRLRFGVADILTFSGLGNKLLQDNKLDGKLLTEQPERCSAVISLALHHIHLLASLLAPYMPGVTTNILTQLGLDESTSPAHIPDPSAWTFTALPAGHKLGTPAALFANIPAAKLDEWRDAYGGEELKRQKALAAEKVAAKKAKKLADKERKRLEKEKKKQEEGASVEQGVEKLAIDGESKPATGS

SEQ ID NO: 3018 - protein, 446 aa, Unknown
  Kingdom: Fungi, Phylum: Ascomycota
MTMAILRGHQGDSVEAPNQYTQPSRKGKKAWRKNVDVTEVQKGLSDLNEEIIRGGVIKEKDSADLFTIDIKGESQISKRHPKHASKKGLKADEIIAARSAVPAVSMRKRPGDGKLGEGLVPAKRVKKDWVTHKELSRLKRVADGQHDNTIEVRDATYDVWGAAPEPSEVEAVVASTKPVVKAPKTSKQKPISLLASGKQVAAVPKPSGGYSYNPDFHEYEARLNVESEKALEAERKRLAAEAAELEHQQAVARSAAEAEAAEARAELSEWEEDSEWEGFASGVEDDRPEVKMPKRKTPIQRNKTKRRKEDEAAAKHRAAMKARRVQEQRIKEIAEEVSQRDAERQLALQNVSDNDEELDTIDADEGSKLRRRQIGKYKLPDRDLELVLPDELQESLRLLKPEGNLLKDRYRSMLVRGKVESRRHIPFKKQAKKQITEKWAYKDFVL

SEQ ID NO: 3019 - protein, 238 aa, Unknown
  Kingdom: Fungi, Phylum: Ascomycota
MLSATVEGTDESAGAPPSAPRPEEETGLAETPPPVKRAVCGVCNEKPAKYKCPRCYLPYCSVICNKQHRENHPPDPEPVAKPAPAADAAAQAAARQPTRASDPNNPFHSLEQSDKLKILFAKYPSLPAQLRRIHDATLPPKPAPGSKPGIPESMMQGVQKKETWNHDLGIKNGKAALRRAKTADGEEGEGVREYYELVLHMMNETSDRDRASQLVQQQIAQEDTKLVERLLAQEQKQR

SEQ ID NO: 3020 - protein, 1041 aa, Unknown
  Kingdom: Fungi, Phylum: Ascomycota
MSTNFRDRAIAEVQKAIAADHKKEYQQAFDLYMSSMELWVKALKWEKNKALKATMQEKMATYLDRAEKLKQFLQAESEGNADGGKAAVSANGTSGGKGKGAEDDESKKLKNALSGAILQERPNVRWEDIAGLEGAKETLKEAVVLPIKFPQLFQGKRQVWKGILLYGPPGTGKSYLAKAVATEANSTFFSISSSDLVSKWMGESERLVKTLFNMARENKPSVIFIDEIDALCGTRGEGESEASRRIKTEFLVQMDGVGNDSKGVLVLGATNIPWQLDSAIRRRFQRKVHIGLPDAPGRATMFKLAIGDTETGLKPSDLNVLASKSEGFSGSDIANVVQLALMRPVRKIIQSTHFKPVMVDGKRMLTPCSPGDPEKIEMTYDQVSSEELLPPDVVLHDFEAALEDSNKSVGKEDLQKQVEWTQDSDLPAKRTGVTICLNGKQNVETEGHSNSKTSRRNEALQKLDNLRNSWRGDEEDEESPENYESDLESNHEGEDYGNENRTPSSVLDPGRVNVVSEKLCDDVLSYMGESLDRHIGCDLIDLNPGGGLWSRKLHERLQPRKHILMEGDAELYAPLLSELTSKDNVELIPKSGIIWKDLNEVLETKLDRQVVPQHSGPPERNDTLLVTANLATNPSRKLFGFESVSVMVLHQFITSIHFSSLFQRYGRVRMLIWTNDDDKRRMVPQSLTRRKRFAFQTELSCEWAHQIVSMDNAHLDTRYLRDEWLNVESAYKTLERMQAQGFVMPPGREPQHHLDALAKPDLIGRRLAGSQPPHMKRPFKEELEELRAGIEDVSALSPENVLQGKRREQFLRSRERADAQYNKLFQDLLTERDRLFENAKTMPPDEFEAASKAWLDTTAGLKKNPFNEWATIRDNYHLFRQEEPVLLWDRRAFEPLVPQPSEFFPNSPCALIDLQPKAMNPLFLQYGPNSTRSGDTSDGLLRSWFSQTSHTVPHAMQALWPGFGDSYEACPSLRDPAKGGSPIKDQGALTARIINEVQWTELVQAWMDWPFRPEYHLFLGRTLDDPEGDDDEDAGVGSPDL

SEQ ID NO: 3021 - protein, 478 aa, Unknown
  Kingdom: Fungi, Phylum: Ascomycota
MADNGASANTAQMPPPQVTAGAPGFEAGKNGQGAAPNQPPPLQIPTNNNPIPTSITSPLSGVDGGILSPTSAARRAAPEPNKRALYVGGLDQRVTEDVLRQIFETTGHVQSVKIIPDKNAKGFNYGFVEYDDPGAAERAMQTLSGRRVHQSEIRVNWAYQSNTSTKEDTSSHFHIFVGDLSNEVNDEILTQAFSAFGSVSEARVMWDMKTGRSRGYGFVAFRDRPEAEKALSSMDGEWLGSRAIRCNWANQKGQPSIAQQQAMQAMGMTPTTPFGHHQFPANGMASYDVILAQTPSWQTTCYVGNLTPYTAPTDVVPLFQNFGFVVESRFQSDRGFAFIKMDTHENAAMAICQMNGYNVNGRPLKCSWGKDKQAGFDPSQPFSPGSAQTPGGFPGTPTFYPQYGEGQYGGQPGNFGSPQGNTPTGYGGSPMGYGGTPQSAGGYGRGQQAPNQQQWQQQQPQPQGQNFGNNSGFGGYQS

SEQ ID NO: 3022 - protein, 718 aa, Unknown
  Kingdom: Fungi, Phylum: Ascomycota
MAPPRHDEEAFGAQRTSSSTNSDRNSIASRSSDVSSLSDIQVADGFRHNPNASDFTSSSSTVTSQHGAGPFGDIPPESPPDRATNMRNRPSSVAKPHRPHESLTLRHEQNSSGNAQPSFPRASIASSEGPVIRPDSPYRGPTGPSHPYQMYPQRTLSNATAETITPLPHEPSIETRQQGPTHPYTLYTQSTAEVEQTPSRTIPVGFTNRPDNYQRQLGPDGEEAGDLIGPLGHTEELPPYTRYPEIAYVRKGSSNDTDSISTPSSSTSTHGLPAVAPGAGGLGRATRDPEFSSTEEDLAIHRSRPSIRSQHSQASRHDINTAAREITEKSGRHEKWEKRARKKLWGIVPYWAICLVMVGMVLMGIIMGAVIGTVLKKSDDKTRKAIAESEAPAPKTPVGEVIPYTVLPGDLDEIRTGLYTLPPLDKDEAPRKCFNNSLEFNAWSCDIPSLFYFIDITHIKNASKLAQYDLELNAFNKTAASFIWGSQPPSVPNAIPLKLVNDTFDMGRGPAWWLNVTYNKTVIVPENNFPLPERRLKRGWDYDEYPASYFDPTQLGRASRSAVVGDKPWICTWPDTTLEIFIYPNVNASLAVPENDPNDDIPDYEQPTPENSSDLPPAYPKAVKFLERRLSGDPDSTAVCRQVIIAADGSTYDELYDSDGKPIRVEIIETATAWEEQAVANQKRQVTREWFDTKESHHSLARRDAQELTSCGCLWWST

SEQ ID NO: 3023 - protein, 866 aa, Unknown
  Kingdom: Fungi, Phylum: Ascomycota
MKAHKFQIGTGEYTTGFVDGSASVSDKKVGVVGLTLFDLRRRGKVNNLSMVGVNGTKFPAIREHLNKNITQAYNGLDTSFDSFPANDKKDPDAYKSAIDQLKPGDAITIFTPDPTHYPIALYAIERGIHVLLTKPAVKLLEHHQDLMAKATEKGVYVFVEHHKRFDPAYADARFRAQKLGDFNYFYSYMSQPKYQLDTFKSWAGKDSDISYYLNSHHIDICDSMITDRGYLPVRVSGTSSKGVATDRGCHEDTEDTISLIVTWERKDQPGKRGIGVYTSSWTAPTRAGVHTNQNFHYMGSGGEVRVDQAHRGYEYAEDDAGQLQWLNPFYMRYAPDEDGNFNGQTGYGYISIEKFIDGCRAVNEGKLKPADLDAKPLPTLKNTIATTAILEAGRRSIDEGREIGISIENGVWKLVPLTIHNRLTSIVSDAAFVASASDSKRFRGRPVVANERCGSWYVPPNSKGGSAYFKSTDGHERAWKFSTRRLNLHLVELIEANDGVIIVDSTRRGKRMPDALSTTIPIWCTVLNLTLLPSHPLSSKLHLPPSALPTTHAQISALIPGFVASLKALNLPLDKYKLTRPLRPYWVTRDSNLDSDEDEDEISAGDGNTRAGIYDEYRPVVCCTASRRVVGSEVDEGGYIQGAGDDTENWAHGLTPPVFWAHADELLNASEAELPDLIASFVKDHSEAERAKDRPWKEIVKGIAVQQLPLASEEDLGNEVLCQIALTSNNATPKDTWIKSKKTMEVSLGKSKTASRNLRTALPDICAFVTTCLEKRETDTTEKQKLPATIVLGCDSGREYSIGAALALWCWFLEEDGTLRPQGGGDVHFTKDLIKSRLGAIMTRHPEANPSRATLQSVNSFLMDWR

SEQ ID NO: 3024 - protein, 499 aa, Unknown
  Kingdom: Fungi, Phylum: Ascomycota
MAATPPLEDAQVLISNQLNTLHLATELPGGGESLRKSVETDYCTFQAGTGHKNSQKRQASPIVKEEELSEEESPIRDNTSTPSTPESDSSTMLNIKKLERQARFRAQLEDDDLIVIDEANLEETRAQLKKDMEAERQRFTGASNWAPEEERLFELLYMREHLALMPRHWGYDFQGVPFQDHVFQTTERNPPVIFAHSRKTEFQATKGMMNLIDLSSKVRTLLQSGFEAKAPALIEKTLNDFVSWSAADGDYQKLEIIPNLIAEVVDWDADHVAVIKTRMDALAQLHRDFLRVDRNDHGWQGVKAEVLDQGFLMAGSPPRSAKSRLKRFVHKAKQPMTEVDDADSLFSRMSVREISPQERAELAARASTSSDESRTAGQKRKRSPADQMAAPGRRKKNRASPPRTPPSSKQQDGFTRQPPVVWGLFIINSSVFLCTLDAAKEGDEAYVSWHAEIAFTQTRQCVWHALTIALVVCLARDELMTRLDDFDALPEEPVEDPDL

SEQ ID NO: 3025 - protein, 552 aa, Unknown
  Kingdom: Fungi, Phylum: Ascomycota
MAASMGTEGFGQGLVHHQKLTKSRNRTVVKPILKKFHSAGSDNNSLDLDRGWEEQNIHYFDHAHDDPLPSTRSAARDVSFSSTNHTASGPIAVDNNSRRRNGLADKYSHARSTSGASHASIATSGSGRTGTFVHPFQQTPRTSEPPLSQSYSNTSHSRPSLDLNYGLGLRDFEYTSTITEDQDDSEGYPFTSVTATPTAITPTSITPGRNISSGTVEYPPVTNGRIQDHHHNTSPFYSGGHRSLASQRTNSLSDVTSPSAAPRNTISSRPRQVPTPRMPVGVNHNRSELYASSVSSGNESSPLSSTVPALHKEASASSPLTVATACSSVTGGTPVTSPLRSSLDMGAFRLRSRSSLDTATRQEQVRQARRKFEEKEKAKAEKYARAESKKRERADTKEAQRQLRKGSSGGLASGRTSSSTEARPTMSRESPSPVGIIGEKDHDPYGQGYDSVRTGARPQAKAEEVVFTPAPRRTKTAKRKTTGAWTSFDRTAASVRERVPGLQKEEEISPLDLWIKEGRVPGHFEVNDFKIRQLYRAEQEQKKQARRAGGQY

SEQ ID NO: 3026 - protein, 378 aa, Unknown
  Kingdom: Fungi, Phylum: Ascomycota
MRYSLPIVAALAATASASSSQEAKRDGAKLYTLELSPGETVEVTEDEKFQMIDDHVHFFDITEWKDHEPVMARLMSSAASPFPAAVSHKSAVEAIVDKVDMAKVRKQLGCFSRFHNRYFNSRYGVEAAQWLHEQVKKTIDASGQPFASVRLIQHQAWSQPSIIVSIPGKVRLKTIVTGAHLDSVISNDRGAGRAPGADDNGSGSIMLLNILGALLEDPRIAKGDHLNTIEFHWYSAEETGLLGSQDIFNSYARLGIEVEAMLNQDMVGYGGRDGVERFGLVTDFTDPGQNEFIKLLVDEYADIPYEESTCGYACSDHSSATRNGFKSSFLFETPFGNHNPYIHTPNDTMEHVDFDHIKQHVKVTSGFLYELAHNDFTA

SEQ ID NO: 3027 - protein, 628 aa, Unknown
  Kingdom: Fungi, Phylum: Ascomycota
MPRATRSQDEQASVMTIGIDFGTTYSGIAFAHSSQPNDIEIIVNWVDGHNTDKGKCPTLLTYEGDQVISWAYNAVRDPRAVKWFKLLLLQPGDLPADVRECDEIQAARENMRALGKQPVELVADYLKQLWTLTLEKMVKSNGLDVVENSQFHVVLSVPAIWPDYAKDMMREAARWAGICGDRPSCPAGETVLDLISEPEAAALATMMDKFANKFTPDGEAMAQVGDCFVVCDAGGGTADLITYKIKSVKPWRIEECVRGDGKLCGAVMLDKSFRNILRAKVNPKIWQQVSENFNIFEVQWEKIIKREYKATVGNQDLNIPFRDPRIPAEDWNPVVTLTPDDMRAIFDPVINSITHLVKKQIDAIPRRSNNKGPPAKYVVLVGGLGSSNHLYQCLKAEFAIGGKGPKILQSEGALPWTAICRGAVLHGFNQQKLHGRAVRGAPSFDVQARIARRSYGTICTFEEWDARFHHIDDRRYCPVEDTYVADYQMSWFVRAGEPIGEGEVKLCAFSQALENPEDLEDGVTTELVYSDAPRPPKRCDGSVKKLCDVRWDQVPAFEALPERVTDAGRDIRDLSYDIEMVFKGASAHFGIWHEEKRVASRNVLVDFKDSGNAARKERSKPVPFRPQK

SEQ ID NO: 3028 - protein, 815 aa, Unknown
  Kingdom: Fungi, Phylum: Ascomycota
MSSGKGIAEFPDVEAKLQKPTKQSAFEKQRAEAAAKRQREAAENAAVLKDFVESFDDDSTGGYPGNNARRDHGAGFPQPPQRGRLGGGPPGPSRRHFGATNLKSGPGSLGPAPGSFGKKRSFQDFSRGGGSRDSRPTGFQGGFNRDDNDRKSQDRIGRAFGASDDEDEHMADSGDRAEEKAVARPTLRLLNLPPGTSPSMIKSLMPDNLTVEAVKILPPASGPSGNERKAATAIVTLSQETPANDMDAAVSSLQHRYLGYGYYMSLHRHLSSAALTATTAATLSSSASESHPFGAKPVETPQSSQRPPQHQGFHRGFAPPSSYNVSMGGVDRSSLLHVPVKPPQDVKTVQLISKVIEGILAHGPEFEALLMSRPEVQREEKWAWLWDARSEGGIWLRWRLWEVVTGGQQQGKGKYVPLFDGSHAWKMPEKKLPFEYTTKLEEFVSDSEYNSSDDEDYEADGQHQVNGEDAKTFLNPLEKAKLTHLLARLPRTISRLRKGDIARVTAFAIMHASRGADEVVDMIVRNVSQPLSLTSANPQRRQQDDRAAKIDDKETTTDDAGAANLVGLYVVSDVLSASSASNVRHAWRFRQLFDSALRESKLFETLGSLSEKRGWGRMRAEKWKRSIGLVLSLWDGWCVFPAESQEAFVKGFENPPVTTIMPEVKATVRENGERAPLPISTVEDDDVEGEKMAEDDVEGQPLEEEDIEGEPIDDDDIAGSPIGEEDIEGSPIQDLDVMGEPMNEDDTMAGGDEPAPREAGAEDHASLEQGPHGSEQPGGSPPQREQGAGTGDGMVPRRKRLRAVDMFADSDGEGA

SEQ ID NO: 3029 - protein, 1107 aa, Unknown
  Kingdom: Fungi, Phylum: Ascomycota
MAPQTSGVYADHPFPILSTPVAQLPAGTEPTIFHDMASEMVHIHNIVFRGLNSIYLQAEHIADADINSFLNYMAQWLRILTSHHEGEEALFFPAIERMSGQQGIMEQNIEQHHAFGTGLTFFQEYVHACLAKKEAFSGKKVVELIDGFGSVLAQHLTEEIGTIVALEKFGEKMNDLPAVLEEQAEHGMSEAGLFTGLAFISANFDRHFEDDRWLTSFPPPGPGQTAMAIVRNVTYWVHKDWWKFGACDRTVQGGQSGHVAVGYELRPREWMLAKDLDAFTADSSPGAAAGHSSGTEGVPASLDVVSAQLRDSYAMEQIDAQASDLRFLSQAHSALSAQDASASSRQIQGYGSHSHSGATPPNMMSPGSASVGDNSAHPAHPGASAQGSAAATPTAGAGGKRKEMDDMNSGKQSRSKRNRYISIACNECKRRKIKCNGETPCQRCGNLNLNCLYAPNCCSNSFKDSDEYKQISSQLQRLQDEVGNLNQTVRSMQNDPTRGGNIHDRSAVAASSTVTPSPSQTSSTLHRNPDAPSGRRAPFHGPTSTAFSLDVANKTIANMGYRPANEGIDEPNPPSQPNDIGLSGMGGSRDPLLDYDKEEIIRLCNVHEAEVGIMFPVIDTAAVISHARSLFSFLESLKGQRSLHAINDEKTLQLKVLMCCAHVVEENGHSLKAMRLYESMENVLNRKLMADECDTGSLPLLALLGGYRFLSNDEVLGWRVIGQVARLCMELGIHQRMGLMKIENERERKDALTTFWTAYILDRRWAFGTGLPYVVQDEEIDPQLPLPDEYPFMIAMITYSRLAAKVWRQVSHFEPVLARELRDEEMERLDQEIIEWYDSVPDEVKVRNWDKERHMASTPSYNLQRLRIWTYLRFNQIRTWLYTPVLHSATSIMAHHTQAQKVVDLAKDTIRYLTHLNNTTTLYQTMQVFYHQFLTSAISVVFLASVHAPVRFSAVCREEFYLSLDLAKDLSSRSMVSKRLWSTIKTLKDVAPRFGLNPDDDPHSSAALGMIGLARGHLDQDTASSTPYQRPLAPPAQTPTEGVIDQNGTRIQSEMSRIFEGYVSLNGFQQDSDHEADDQAVMQSNNNTRGGVYGTDDTVYPHLRAMF

SEQ ID NO: 3030 - protein, 542 aa, Unknown
  Kingdom: Fungi, Phylum: Ascomycota
MTKPLLLLSLAASLVQSLASSDGLCDSSDRPQWIRDSEDNLVCHERVRVITIKVGSEAIHPEDCDKSKNDNLDHILAQIDCDKCVIAIEQYYGASKLSAPITTTISGDDGTTTVIIYTSRPDATDEAVIRTIPYAGTSAITAPITRTLLPDGTGDPTIIVETPEASILGDYITITVPYTGASSITRPITRTIPPRDDEPGTIIIETPVTTRPTRAPSSSGRQTVLPLVTSTDEAGNVILPEETTDPAVPTEETDGPETDTAETEDPDTEESTTPEPTPDPTPPPTPTTEPEPEFTTTGTPAGPTFDCDEGGYLIQQRTLYRLDLTTGDNPAINTRVGPGGNINAMGFNILDGYLYAFDSIGDGEQQLIRIGADGTYDLLDLVVEGGLTAGDIDEAGQMWASNAGRRWLQVDLNPNSSNFGEIVDQGTSENGNIADWVYLENGGDYLYSIRIGATRTAARWSRTSHEWENLRQYPAADGQSSGFGALYAVGDELWGSNNQSGDIIAFPVLSDDEDSRKISDGPATSSNDGARCFRASVPGGPT

SEQ ID NO: 3031 - protein, 314 aa, Unknown
  Kingdom: Fungi, Phylum: Ascomycota
MTQPQTAGGAKPAQHFVSGLGSGVASAVLLQPLDLLKTRVQQSKHSSLSTTLKELRSSPHFLRSLWRGTVPSALRTGFGSALYFTSLNALRQNVRKSAYYRQRTQHQAGSSDLPSLSKTANLLSGAAARTFAGFVLMPLTVIKVRFESSLYSYPSLAAAAKDIVRYDGIRGLFSGFGATAIRDAPYAGTYVLLYELLKTEVGSIVTARPSDNPLPSKMGASLAGTVNFSSAILAGAACSALSNPFDAVKTRIQLQPQTYMNTWHAARKMVLEDGMRSLWDGLALRISRKALSSALAWTVYEDLIRRMNQAPRHM

SEQ ID NO: 3032 - protein, 489 aa, Unknown
  Kingdom: Fungi, Phylum: Ascomycota
MWADIIYLQPIWLLILGHFASAANVDWKTITNSRGDKLPDFSFCGYHASDQDLPDATGAPLAVITPKTGDQTAEIQAALDGAAKAGGGIVQLGKGKFHISPGLQIPSDTVLQGSGIPYTTLVVDKMVVGVPVLSLGNSVAAKIVPKQESQITDQYVGIGSSTVTVKSADGLKAGQSVFVSRAVTADWVRYNGMADLVRDNEPQTWIGEGVLVQQPRQIKLISGNKVTFNVPLTDSLDKKYMKPYIAVYTPPSGSKEIGLEKMSITHTPTCSGLKLNNTDPCGSSAIVVSPWTTDSWIRRVNITGFNSFLDIQSNSSRITVQRLGLIRDADTDNGAGYPADITIKGTQILVRDSGQYGLSTAKAFAVVTQSGTPGPNAVVRHVTQSSAQQLYPHARWAHGFLADDTDASVSFINRGTSGSGQGWSINAGVAWNVRGDVQIQSPPLGVAWGIGSTGKIVSPTNGTMIQPESSVTPKSLFDAQLSARQGSKG

SEQ ID NO: 3033 - protein, 416 aa, Unknown
  Kingdom: Fungi, Phylum: Ascomycota
MRNFAGGLFLLALGHLVGARGCANATQWVTIWGTMPQLTEPANLPPAPFNDTGVVFEDATIRQTVMMTSAADAIRLEISNAFGGSDLPITAVTIAMPSNQTLGISGVKPDSVQALTFSGTESFTVPNGALVFSDPIQFPVAAQTIISISIYLENGQATNLITSHPGSRTTSHLIHGNHVEDGVLDGSTTTDHWYLISAIEGKAPEGASTVVLVGDSITDGRGSTTNGADRWPDQLVERLQTNSATRNVAIVNQAAGGNRLLADGLGPNALGRIDRDVISHSGVRHAVIYNGVNDIGVAATDVKTQEIIGDRITQAYDQMILRLHRHGISVYGATITPFTGPNQVYGHPNREVTRQRVNKWIRESGKFDAVLDFDQVLRDPDQPDMLLPAYDSGDYLHPNPKGYKAMAESIDLSLFE

SEQ ID NO: 3034 - protein, 904 aa, Unknown
  Kingdom: Fungi, Phylum: Ascomycota
MATPAPPEDQARLLEDALVAVRQQTSVMRKCLETPGKLMDALKCCSTLVSELRTSSLGPKQYYELYMSVFDALRYLSVHLRENHPVNHLADLYELVQYAGNIIPRLYLMITVGTAYMAIEDAPVKELMKDMMDMSRGVQHPIRGLFLRYYLSGQARDYLPTTEGDGPEGNLGDSINFVLTNFVEMNKLWVRLQHQGHSREREARIRERKELQLLVGSNIVRLSQLVDLETYKSGILGPLLEQVVQCRDVLAQEYLLEVITQVFPDEFHLHTLDQFLGAVSRLNPHVNVKAIVIGLMDRLSEYAERENNAEANGDRETAESEALAKLLEKVKLAKENPPEPKAAADDEAEASITEAEANAETDKPEESNGAEAEDLSKDDAAEASEDGPAASGDDSSTLADNAAPSTTETDTTAVNGQESTSAPNVQLYEVFYAQVKNLVEAQRLPIQDIIALLVSLTNLALNIYPERLDYVDQILAYATAKTREHINNADLHSPQAQQSLLALLQAPLNRYVSIFTALSLPTYVPLFQAQSYPTRRAVAGGVARALLKNQTHITKTEQLENVLEVLKVLVKEGNQTPQGYPGAQRRTAETDETVEEQGWLARIVHLLQGEDNDTQFKLLQMTKKTYAEGNERIRTTTPPLVTASLKLARKFKTREHLDDNWETQSNALYKFIHSMLSTMYARVNSPGASELALRLFCSAGQIADLAGFEEVAYEFFAQSFTVYEEAVSDSKAQFQAVCVIATALHQTRNFGKENYDTLITKCAQHGSKLLRKPDQCRAVYLASHLWWATPVASNGESEETELYRDGKRVLECLQRALRVADSCMETATSIELFVEILDRYVYYFDQQNEAVTTKYLNGLIELIHSNLAGNQQESASVESSRKHFQQTLDNIRSRQYEGVVLEPN

SEQ ID NO: 3035 - protein, 778 aa, Unknown
  Kingdom: Fungi, Phylum: Ascomycota
MENFNHGPSDDDVRRTGTQAEHSTPSARSSPVLRRLNGRPQACDPCRSRKVACDNAQPVCRRCVKRREDCVYTISDQTSHSAAASARRSRQSNGRSSTGGRITDVQEPIPTPTARRSTARSRAHVHDRFHAATSSRSLPVQNPHDSRRANSSNPGTPPERPTPRLRTTLPLGEGYLGFISYSNIFDEARNTLSLLNSGYPTDSPAGDAATNATNTNPNSNNPTPASAPSTHHQQILDPPEYDPLPPATRGVCLHVLHNLPDPNDPNLAHPTGRQPASLWGRHSAMLIIKTLRRKYGSILGPNRSDAKLEHMAREICANSAKPFNSDLEDPKAFLDQFAGDNLRWESLGLLFTFREYGPDVNGSGMQAAPPKRGWDKKVAQELWNGNTIAMYLCIRQMVVDSLVYGDASLDCWLSHGAAVAIATFLGMHALPDPPDYKPSLASELKRRLFSNLFTLDKVGSSFHGRPPLLGYRYATSPAPLDIRDEALIAGGEELERAVQELDEDGWARDGVLDYVTLLRARRRIAVLKDELMEIALGNMKSTSLGVIKEIQKREQQTYDAFPPWCKYHDDDLENPDLGIDTLFSRILLNLEHLQACLIAERLIARHDGPDDGSLLFISFEMVRHVLVLWLHVDLFEGGWGGARVDFLWIVMSFGAPAGGVLCMELLYPTLPNRPIPYTNAASPRITRSSIIQQLSLLVGFLGWVGPSAPNREHTANCKRVIQSVLDYTLNASSAPLGPGQHVMDGMGMPFEVGGLDLGFDRWGTFDWFRTEDGMPAFN

SEQ ID NO: 3036 - protein, 396 aa, Unknown
  Kingdom: Fungi, Phylum: Ascomycota
MSKPKKPLELGARHAEVVQSAIQHWLDTQLLSESEATQLADSIAIRTFDWEKFAKYTLRLAIICLVIAVSSVVLEASFIRIYRRIVALPAWLRGAITAMLAVGVHVFAYDRSVKLPRQKYANEGIHAIGALLFALAALQVIEQLNDLYYDRMKRSQGTDEQSEAEKEDEEAARQRRIREDKERSRLIGNAIWAVSLGLAAVYAAVALLSKSTLIWTCAIMVTSSCIGGSGGYFGGGYWIDMESPFLFIGFGSFLLGAAKLMQSHPVTEPLWSTTRVWGLLYGFISLWILSIWGYDDYFESSNRRAWLTRKIRMFLWSVVFFIAAGVGVWHGLRFDDSTTKGFGLTFLGINLYTKYFECFWGYSKAVFFAILAGSFAVVGKYAENVWNMQLEALQLG

SEQ ID NO: 3037 - protein, 267 aa, Unknown
  Kingdom: Fungi, Phylum: Ascomycota
  misc_feature (62)..(62): Xaa can be any naturally occurring amino acid
MHLIHIRLRDGPPPPRHRTSHPGASHLSTAFIWPDDSRELICFPVTKLLALLKLRKPPNQAXALPISWSAAQLAKSDAMNGENGDRFIKDGFWRYNRFYSSQQPLKYVFPIDAEELDRLDLFHKFFQIARGGEHYTYALNTLGRKPKILDLGTGTGIWSISVAEDVPEPGVEVMAVDINKIQPRLIPVGMKTIQYDIEEPTWDPLYQDCDLVHMRMLYGSIQTDLWADMYRKAFAHLAPGSGYVEHVEIDWRPNWDDTDMPHNSALK

SEQ ID NO: 3038 - protein, 132 aa, Unknown
  Kingdom: Fungi, Phylum: Ascomycota
MSALFGTAARYNLGYCLRHPSARELLAFLLCSPASSNDTRAHPILTKQPTLPLLNKSAKMTAAWKAAGLTYNRFLAISARAVRRSLKEDKRIVAERRGEMDLRFARWQNGKQGEAKDLATANAAAMAEQASS

SEQ ID NO: 3039 - protein, 271 aa, Unknown
  Kingdom: Fungi, Phylum: Ascomycota
MSAEETNSRPVLDHLVILVSENTLATLTDKLKDSFVVVTGGEHTGGQTFNKLIFFQDGSYVELIAFYDRVALEDRKTHRWGSAEEDTIVDWAFTLPEEKNFVHVQKRVKEANGGITYDDPWNMGRIRPDGVELKWSIGASRQDDGKAPPPGTVPFWCLDQTERKLRVPYQDNPQTKQPSGVVGISEVLISLPTGKFEDVKKVYAGILDGKNHAKSESSWEAVVPTVLESGAPIIAVDSTSGERKLSVTLRGSSGSPSTIEVLPGLVFKVKA

SEQ ID NO: 3040 - protein, 812 aa, Unknown
  Kingdom: Fungi, Phylum: Ascomycota
MQRVSAFLPSWEKRNSNASAGASSATSGGGGNSGGGLFGWPHRSSSRNSTASNSGLNSSANSLHRPAKLSIASINSNARVQREAFWPTTLDEECDKAARILKSFCGDGYLAPLSTESAVSSPTTEEPKTPTKIMKKIPRRIIQNAAGIAVFTCMRSGLWMTGSGGSGILIARKSDGTWSPPSGIMLHTPTLSFVIGVDIYDCILVVSDLAALEAIIKPRVTLGEDVGLASGQSVACDSEDSDFKWTDPGATVLTYLKARGQHQHVNLSGCILTERANENERFYGSEVSQMDILAGNVGRYVEETKPLFEVIKMAEGRTDYDSSIIDRISAASAPGDALIASPKSKSASSGVSFGVPDAHDPDPFGVLALEMAGLEIREAGSRIRPTSSQMNINSAISSPTTNKFTRQSVDTFLTKSNRGSYMSTHTVKSQVTDVGTQTANATPETTPSPGQQEASISPRPLERDVRISEVEEEEEAVDYTAVDMSALKHISSPPSIHSATSVDVDTAKSQPKRQDDDADKVSKASSVYDQDSDSDELDDSDGEDDFSDEEPVVFEVAAVQPARPQQVASRVMQAKGSMVTIPKRLPPPLPMRNPGRRSRLGNNDMGGETSGLRSPLRQEFGADAQDDLQPEAHAEVPKSESMRLEVPVEDASSKKPDDEMDTPRAAEPMHSLDDKQGTSETPAKTEVSDAVRVIPAKPDLNAADDDKARHADDPKIEENTDKSPSLAHSRTSTDTTGSMVDEKHASSIFTGPTEGRTSLDRSSVTTPTSERPFSVIGESIGDDTPKKLIKAEESQADETFVAARMPLQGSAN

SEQ ID NO: 3041 - protein, 643 aa, Unknown
  Kingdom: Fungi, Phylum: Ascomycota
MPAKRKRGSVESPNPRPEASRRSNRRIKEELNPNSASPYNTKVHEFGDKKTHTVWDTKEGVQDAVKQLTQMEEELQSAVRKQRLAVENSDLGKETQEPANRPLRPKAKKVEKATVNKTPDDAPDEIEKAPIDDHEAELAVGAVDAAKGDDDKAERGAKRPPPVNSDLLPLPWTGRLGYACLNTYLRTSTPPVFSSRTCRMASIVEHRHPLQDPSQPEHPTKNRPDKEKPADIERGMKYVQELGLANARDIVKMLRWNDKYGIKFMRLSSEMFPFASHPEHGYKLAPFASETLAEAGKVATELGHRLTTHPGQFTQIGSPRKEVVEAAIRDLEYHDELLSLLRLPEQTNRDAVMILHMGGVYGDKGATLDRFRENYERLSQGVKNRLVLENDDVAWSVHDLLPICEELNIPMVLDFHHHNIIFDDSIREGTQDILQFFDRIKKTWTRKGIKQKMHYSEQTAPAVTPRDRRKHSPRVKTLPPCGTDMDLMIEAKDKEQAVFELMRTFRLPGWDRIHDVVPHEREDESRKAIKKKKTPKKAKKSKAGATTNGDDANGTGAQVKIEEEEDDIEVPEKIVSDENFGMGGPEGRVYWPEGMEEWLKPKKREITKKEPGSKTATPAKKKKTPVKKEMKEEEEDNDFDEAD

SEQ ID NO: 3042 - protein, 412 aa, Unknown
  Kingdom: Fungi, Phylum: Ascomycota
MLSGLRLTCQPRSKKRKLAGELEEEIRNLKGRFDALESERDELAATVKRQAEALEKSEMEARRLKEAVELVCSTMRDSQSTLQAALGHQNGGGAVSEPSPVASTRQREGRASRTPAELRLLEYSNEFDLPFETHSTSDIGSLPDLSLTIKSFAHVPLDETPFTPSQVLDDSSNDDIPQTLSTTTSLLPADIPEGWDRIPINTAPMGNVDHGFIDLERLCRNIPAQDVPMAELNAQAFPHISNLLNPEVPSHSLQHPLSSLVIDRMMKQMPLRTTLGRLAAMWVICTILRWRICRTPETYVAMPEFMRPNNVQLTVPHPRWVDTIVWPEARTRIIRDFDMKLYPEFRDDLNLSVSVGWTRPAAEAICQGQTQGEHYLSKEYVKHLSDLRNWTLPRRTIEKWPFLEGAVNVRDQ

SEQ ID NO: 3043 - protein, 573 aa, Unknown
  Kingdom: Fungi, Phylum: Ascomycota
MAISPEPAPAPIDQPHEKPLATSQDGEAPVHVEGEHASIEILLNDDVLLAQYAEEAAKGELALGVWGSIKLYYPGIGWALLCATCVIMEGYDTILISNFFAYPAFAGKYGTLVDDRGNPQLTAAWQSGLNNSHGVGAFFGVLLNGWLVQRLGQKKTLIYSLIALSAFIFIVFFAPSTAVLVVGWFLCGLPWGVFATSAPAYASEVLPLSLRLYLTSYTNMCFIIGQLIAAGVLSGLVNLDNQWSYRIPMALQWTWPLVLVPVCFFMPESPWHLVRKGQFEEAEKSVTRLISKKTQDNAAHLSIDTRKALALIIHTNKAEEELSIGTSYWDCFKGPEIRRTEIACVCFAGQVLSGSQFAYNSTYFFQQVGLDADTSYRLNVGGTAMALFAALVQWFCLAPYIGRRTNYLGGMAGMAIILFIIGFLQIRGDSDTFGMAQAVLTLMWTFAFQLSAGQLGWALPAEVSSSRLRQKTICLARNAYYLCILVANAIQPYAMNPFEWNLIGYTGFIWGSTSVLVFIWGYFRLPETKNRSFEELDVMFAQRLPARQFKKYKPEVFVEAHHDDEVVVKGDEA

SEQ ID NO: 3044 - protein, 624 aa, Unknown
  Kingdom: Fungi, Phylum: Ascomycota
MASNSQKRGQGPIRIGNASGAIGDGIDQLYRLASSGAVDAITADYLAEFNIAWKAIELQTRPDLGYEPNFLEQLAWKNGAGARAVADNHIKVVHDGGALNPKGLAEKTDQYFKSLGIRHVKVAWVEGDNVTAQATSGRLGDVMHLDYANTSFSPKDAQTLAANVYTGQRGIIEALKQGADIVICGRCCDASPVMALCSWWHNWAPTDYARLAGSLMAGHLTECGAYVTGGNFCGAQEIPNLHHAGYPIAEVSSDGTSIITKPPGSNGAVTVDTCKAQLLYEIQGPKYLNPDVTALIDQAKLEQVGKDRVRLTGIIGLPPPSTAKVAICLLGGFQAEISGYAAGLDTDFKFNLMKSQVMGQINKDDFTTFSIEKYGSVPADPKSQKECTVHFRFFAQSPDLEPFTAFKRAIFYNGMQGYCGLHLGMDWRTMVPKPYVRYFPALVQQSMLPDLTVHFVTGETFTAPPHVPGDSKAAQIPRPKAHAPRSSSTSGKTVRRPLGDLLFARSGDKGGNANVGFWVRDPSAYSWALNFLTTQRLINLLGDDWNSRYTIERCEFPQLNAVHFLIRGFLDEGVSSSAILDGFGKSIGEFLRARVVDLPVNLVEKEDQRRAEGVKAAQAVQSKL

SEQ ID NO: 3045 - protein, 481 aa, Unknown
  Kingdom: Fungi, Phylum: Ascomycota
MPFPFTLPTTSAFSFSSCVDCDSHPSLPLNASTYRGVVRDTLKKHKRLPPSSQISNLSTVSAAINDYIPYLLAIDAGLSDKDLPSGEILSAVLKSPPSIEWRPTLSGDVVPGRERNRVKITSFEHEIVFVLSSLGFCHFLTARATLQPLYTTTGDFLNAQQRTTAITGATKSLLDAASAYDYLARRGEQASAPAPCADVSPATMRALSSLAHAEATLLAVLKDDPYPAMVAQDRNKTDKDWMYKAPDIPKVRAHLYARLCLAASEHAAKAASLCHSGGSSGTKIDSGFSKYLDDLRRTSRAKACRFFGIDAELGGQTAEGIAWLRAGLKEMGIEVKEQKKGLSLSKFKKDFVEKREDRKVDKEAAWGADAGRLEETRILEMLDAKWNKMNDTMNTQAIPLINSLLSKMPSGREIHSIPQYQPPSLDRDVLEGMRGPPEERDDYGDPSSDDDEQSAQTYVGAFPGATEDYSRAPSTAGKAYY

SEQ ID NO: 3046 - protein, 704 aa, Unknown
  Kingdom: Fungi, Phylum: Ascomycota
MENAMAHDLDLQDLLQFDTNMSLGLSPLQNDFTAPDQLPLNNNGANLPGDAPRIARPRNRNPRSCDFCRSRKTACVVESSMPCNACRDRGLQCTFAHRRRRNPHTTHDSVMTSNQWQQMATQPRQTLGTAQLISERMDLQPDFTVAEPVYGQGQGFLPASVSPNMPETDVPEVEEEDSFSDTSEVSQVSDQRRNARELPLDQPTWTYMLLSDSGEGDPHLLKRSALAVHADNIHFRRFPRDPELNGDLDCRRPIVFMLGRETLYNKYEPRIEQEELDAMRVDIDKISGHVGARLIKLFFQHVHPYFPILSRTAMLQNGDVPDETLLSLPLSLKAVLFAVALPYMIYDDVLSTMLDVDLPTAKTLYRISWTAVTQEIHIPRLSTLQACLLLLQRDNIDRYVQGSPFQWSLMAWTVSLAQTLGLPTDCSTVRGMPAWEKRLRKRLWWATYVLDKWNFATTGLASHIHSDDYDVLPLTDADCQSPGDGQPKFGAFRHLVDLTHLLAEMTTSFFTVRATRLVGNDFAATMAKANDLQYRLSAWKTSLDTLTTTQSSQGPSQTRARLDGNASLIVAFWALQLLIHRAILRALEAPDGTDEDKQLRRDCRQTARRSVESCCGQVADYVDQLRAGAWNAFWHKFSPSNFAIVSSLLMRLLITSTSQAETTRLNELIDRWRWVLRNGGGNIGGAMMSLGLLRLDRTLLKSRS

SEQ ID NO: 3047 - protein, 596 aa, Unknown
  Kingdom: Fungi, Phylum: Ascomycota
MSSGNDRASQLSEKHYNEHTEQIRPVSGAHHDVVEDENTFEVEEEQLPKGYFTSPFFIGTMTGICLGLVAGVAGFGFIAPILGVINADIGPDGNIVWVALTYTLTSAVCLTIIGRVTDIFGRRWIFVGGAFLGIIGSIICAVSTSVNMLIGGMTVVGIAASTQLSYYYVMGELVPMKWRLAGNAVCYSLLVPLSGFAPVVSWSFVQDHPSVGWRGSFYVLIGINTASFLCWLCFYFPPTFQMKHGQNASLLRYIKDFDYVGTVLYTGSLMVLMMGLNWGGGVYPWKSAQVIGSIVSGFVGLVVFVLWESFANLKEPLVPMHLFRNGSWLAATILSGLGASVYYALAIVWPSMVAVLYNEGGVMTNAWYSSFVGLWITVGQVLGGFAAKRIGFIKWQIVITVLISGIFFGCTATSTPDSKARAAAFVAVGTFMIGWAESLAITVVTLTVWDQTKLGSASGLAGSIRFFITSIAATVYNVTLTNRLGETIPERVPAAVVKAGLPETSVVDFLTALTTGAPFEAVKGISDSIIAAGVAAYKEANAEAYRTVFFVSIAFSVIALICACCLPNVDKLLSGKVAQTLHKGKKDEKRAMQDGV

SEQ ID NO: 3048 - protein, 385 aa, Unknown
  Kingdom: Fungi, Phylum: Ascomycota
MTSTSYHHRSSRVVDPSLPVNARYSATKPSQSHRESKKQKPTPFDPDDLCRRLQIVLAEEKGYAERKRRSRANIDRPVVKDDDGKRRGREVPLEITAYQATATKSAQVTAARRSVLSSSAAKRRSKATEGDLIAPPEPPEKEGQASYHHVPSVAATQFTRTTAHEPSSDRSIVHKLSRKAMQFHMEGPNARVDAKANTAPDEQAKMIHRVREEREKTYGRNQFQHPAAILEAVGDVDDRQDRDASYRQTFDGHFRAKHGVQDEGDQHYNPRLSSSSARAHQHGGARESADYPAGIYPVLSEDDAQHQNVPVRIDDHRVDWTQSDEKTVEPLSPTLRKADSRWTLRGRLSFHRGSKSEKEILAIEDRTESPMLRPQRSSFFARFKR

SEQ ID NO: 3049 - protein, 252 aa, Unknown
  Kingdom: Fungi, Phylum: Ascomycota
MNNTQQDLDAAAMASSVTAAAKQQLRSMMKQKLSELSPDVVGAQSSSVFASLKSFKPYQNARRISIYLSMPGAEIQTDPIVRHALDTGKQVFVPYLHRSPLETPDTPARVMDMVHLKSIEDYESLKRDRWGIPSVDPATVHERQRILGGPDAFHSDKSTLDLILVPGVAFDVEESGHVRRLGHGKGFYDFFINRYLARAGDHGLDDTSLQLYGLALAEQLLPPSSEEQIPIGPYDRKLHGLLVGDDQVIDTE

SEQ ID NO: 3050 - protein, 531 aa, Unknown
  Kingdom: Fungi, Phylum: Ascomycota
MADFGDYPPNMAPQDALIVRQQAEPNHDIVKYSAEDLSRPKAGPANPFKDETNVLKRKNVLTGSASETFISEHTFRSKHRAIEREGGPEREHQTGAELKAEAARIRAARENKGDATIAEGDGAYLGPWAKHKRQEFEVVDDEAELGSDDEYEIVEEEEDDVVESGTVLQAPAQAIARRKEVEEQGEETSKFHGTQEFDYQGRTYMHVPKDLDVDLHKEPGSITNYIPKKQIHTWKDHSKAVTALRFFPNSGHLLLSASADTTVKIWDVYHERELLRTYSGHTKALSDVCFNESGTQFLSASYDRMMKLWDTETGTCVSKFTTGKTPHVVKFNPDPDHAHEFLAGMSDKKIVQFDTRAPPKENLVQEYDHHLAAINTIVFVDGNKRFMTTSDDKSLRAWDYNIPVPIKYIAEPDMYPMTRAAAHPSGRHVAFQSSDNKILVYGAEKIKQNRNKCFQGHNNAGLSIELDISADGQFLASGDSAGYVCFWDWKSQKMYHKLKAGQQAVTCVKWHPQETSKVVTAGMEGDIRLWD

SEQ ID NO: 3051 - protein, 685 aa, Unknown
  Kingdom: Fungi, Phylum: Ascomycota
MWPVSAPKDQGKLTTTLDTKNAGVACVDGESARLRDLPRSYIGGLQSRVSWLESIIRERCPDVDLSDGPSVEEDAGNTTIGNTTERPSPDSTLAPIAANSDTVNRGWQLGGTNALSHEIGLVSLGTNQDQRYIGPSSGFFLARVMLTKPTQSNNETTNRDAHLPSELVEAVQGPLPLPSKDMALRLADSYFEYIHPQYPLLHKPTFMAILEAVYEDNSSDHMTLFQVKMVLALGATILSGRSKARIPGESYCLSAMEHFEHLNVENSLQGVQCLLLLFIFTIHNPYMRLNVWYLNYQCLAALLDIGLQRNITVQSGISLLEQEMRARVFWVIFMLDRIVATMMGRPIGIRDEACELRLPEGYDDAVLSSTSSIPVGDAPPGTSPMAYSVHLFRLAKLNSEIKYVANSVVRGSPSYAYPAIVDINDWHKNMLGQLDQWAAAIPDDGDSGSFMHLTCHLRYHSLRMVLLRPSPNIPKPGTESLTKCHDSARATIRLMDRMYRKNCLTHSWFTFYSLVLGTITMIYCIKTVPEVARNTRLEVLMMDLGSAMSMLSATGEHWSGAKRSRDILDELGRSTMRWLQNLPADNGSAENDVDAQQQINIQIGQGLSSSTLQPTPGLNSNPGASMYMPTGLVDDSFGFLPDSSGDFFAMDGLPNFLDPNETSNVDSIVQSLFQGFIPAQYPSFT

SEQ ID NO: 3052 - protein, 453 aa, Unknown
  Kingdom: Fungi, Phylum: Ascomycota
MASSSSNVVGVHYRVGKKIGEGSFGVIFEGTNLLNNQNVAIKFEPRKSDAPQLRDEYRTYKILVGCPGIPNVYYFGQEGLHNILVIDLLGPSLEDLFDHCGRRFSIKTVVMVAKQMLSRVQTIHEKNLIYRDIKPDNFLIGRPGTKASNVIHVVDFGMAKQYRDPKTKQHIPYRERKSLSGTARYMSINTHLGREQSRRDDLEALGHVFLYFLRGGLPWQGLKAATNKQKYEKIGEKKQTTVIKDLCEGFPEEFSKYLTYVRNLGFEDTPDYDYLRELFTQALKNSGEIEDGEYDWMKVSKDSGKGWDTKGHNNAYLHNPNSRPGPSQMELHSGHRPGGTTSHQQAQNLTVGRLNAAQPPPPSPIKQMGKQRDRQNAPGALSPHRGSGVGGLRDMATPTGSTQAQFQNSAQNLPQQRGPQQQAHMSPQAQPNAQPAEAQPSGFQKFMKTLCCG

SEQ ID NO: 3053 - protein, 428 aa, Unknown
  Kingdom: Fungi, Phylum: Ascomycota
MSASGSPVGSPTNAPVNDGQEEEFQDAVAAADSDRDSDLLSEIDENQFEDYNVETANIEDRPVDIDEDIARTLKASKRKRADGEVPRRPREGRREKKRRDRDDDTTMAGAGEAETAAAPRRQRRTGDGERRARAKPASPEPQNEEDLSPEERRKREIDRQLDAAIKKPSSNRRKRKDEEDLENEIDDKLIALNQMMDRACQEDNDAREQGQPALHKLKLLPDVVAMMNRSDVRHAVLDPDTNFLQHVKFFLEPLNDGSLPAYNIQRDIFMGLTKLNVEKESLLSSGIGKVVLFYTRSKQPEPSIKRMAERLLGEWSRPILKRTDDYKKRAIESRDYDYQAAKLAQRQKTGSQFSLTQRPAPVTAETEREKLLAPKGFNNKARAAGLPSSYTVAPKSTFDGARGSEHRPLGASGMDAFRKMTQKKKKAN

SEQ ID NO: 3054 - protein, 382 aa, Unknown
  Kingdom: Fungi, Phylum: Ascomycota
MSHPQQRLVPGQDDRPFQHTTTPADHAALVQSRETGDVIPMDIPKGEVKALPFAKSWVHLMAGAIGGMTAATMTAPLDVLKTRLQSDFYQAQIRAARQAQPTVARNPARAAVHHLTETLQILRSVYRTEGGRALFKGLGPNLIGVVPARSINFYVYGNGKRLISEKFNHGHEAPWVHLMSAVAAGVATSTATNPIWMVKTRLQLDKNVAEKGGAAASRQYRNSFDCIRQILRDEGIRGMYKGMSASYLGVVESTMQWMLYEQLKVGLARREMRIQASGREKTWWDNTVDWTGKFCSAGSAKLVAAVIAYPHEVARTRLRQAPMANGQLKYTGLMQCFKLVWVEEGLLGLYGGLTPHLMRTVPSAAIMFGMYEGILRLFDTPS

SEQ ID NO: 3055 - protein, 280 aa, Unknown
  Kingdom: Fungi, Phylum: Ascomycota
MKFTLTSLALAALPFTTAIHGPSINGMKIIWQDTFTGSSGAPLDSKTWNIARDTNTNNELQDYTSSNSNIQLSGGETLQLVPWKKNGEWTSGRVETKESWTPENGKKLRVQASLRMGEAANSKGMWPAFWMLGDAIRHGTEWPLCGELDIYEQVNGDGIAHGTVHCDQEGGGACNEPLGRGASTPIPDREFHDWSIVVDRTSRDWRSETIEWARDGNVFHKLSGAEIGDEGVWSTLAHSPYYILLNVAVGGNWPGNPDKSTEDGYASMMEVQYVAVYESS

SEQ ID NO: 3056 - protein, 163 aa, Unknown
  Kingdom: Fungi, Phylum: Ascomycota
MGNIPSKSDHDHHLSSHPPASSKSRHQSPQYNSDNESSAQLGQASSEYMQATLLAKWDTETSEETTGEPVSTDTTVTNEDKTTHTIAGKEKKMTVIKEVLTIRETVDVARASMEAVRGSPAATPGKMKDDIKMEPWGIVNEFHREKELVGMGGWIEDELSRKK

SEQ ID NO: 3057 - protein, 381 aa, Unknown
  Kingdom: Fungi, Phylum: Ascomycota
MAVSSTASNLEREDHNRDADFNKAMHGKSAQARGGIAAMFSKGSDAKKAAVDEYFKHWDNQAAKDETPEQRAARTAEYATLTRHYYNLATDLYEYGWGQSFHFCRYSHRESFYQAIARHEHYLAAQIGLKEGMKVLDVGCGVGGPAREIAKFTGAHITGLNNNDYQIERATHYAQKEELAHQLKFVKGDFMQMSFPDNSFDAVYAIEATCHAPTLEGIYSEIFRVLKPGGVFGVYEWLMTEEYDNDNIRHREIRLGIEQGDGISNMCKVSEGLAAMKAAGFEMMHNEDLADRPDPFPWYWPLSGELRYIQSVYDVFTIVRMTKWGRWAAHNFAGALETLGVAPAGTKKTADSLALAADCLVAGGKDKLFTPMYLMVGRKPE

SEQ ID NO: 3058 - protein, 794 aa, Unknown
  Kingdom: Fungi, Phylum: Ascomycota
MSAIPDTSPETNFDVRVADYLDDRLQSALDLDNLDDLLANIETQRTQLQTQLDDAVKELEQARRKAEGGQGSLNARIEDFKKLQDSIDTRVQIAAASDAPSQAIARLQRPMKKVEAVDFARKYLVLLRDVDQLRTETRERFAQDPKAALEPYTALKQLSSNLHSLEAGEGLHLVDHVEKVTRSLWEEMKESLSADLEGILNKHKWPKVDPSTEMDEEWVAAVEKLVDLQVPEIMYASGTVSLLPFDTMAHIFVSEFRFHFMSDKRTSDPQAIGSHCFPWFVSLIEKWEDFFRDNLSHLLASEFYDTPVATNAAYVDPVCAFITAMLPVMREKVADVVSKAVQSPSFLSSLISQLMTFDETLRTKFGYDGGDAENGWPGLTTEVLDEHFDAWFQAEKNFAAERFRTIMTASDAHNIDYNYTADGKMKPTFAAVRVTDLLSSLTKQYNRIRKFKHKIRFLIGIQLDILDEYHDRLRGSLEAYQAATSTLGRTLHGVSKEQMAVLEGTGALETLCKVIGSSDHVVNTLADWGNEDFFVGLWDELQARAAKRSSGGDFSGAMSIDDVKERTSSSVGVEEDGGLFDETIAAYTMRRKGAQDLLVRALDAAHTKALRGYVSRVQWTTIGDSALLDDPSQLTISPELDQPLLVLRSNLEFLIKAVSTACYRRVWREALSKVQDQLWHDVLHRHTFSTFGAAQFARDVAAIFSLVDHFIPHGSAAMDTLSEGVRLLNLPTEVEAPEEGKDASLTLKEASDRIFTDNDEARAVLDELRLQALTPTNARLILQKRVENSENVGW

SEQ ID NO: 3059 - protein, 1106 aa, Unknown
  Kingdom: Fungi, Phylum: Ascomycota
MPHPVSPPTMVSKDAPPPPSQEDVAGLLDTIFTAKTSNASIDACYGLCEMLLSTVGATGLTQYGILTEVRKAAADKKSGLRRESSQNLLGAIFERFPPRQPLSEVVLLLLDGGAVPCALDALADKGSVVREAAQYGLDALFANLSSEALVAGLLPALVDYLSKRTGKWQGTVGAYRLMQKMAEKSQMTVGATKEEAADKDVLRESMGAKLAGLIPLVEAGMHDLKAEVEKQAVLTMTSLTALLSNDDVAPRIPLLIETMHNPNTQSSQKAIHALAHTTFVAIVTSPVLALLTPFLERSLNTPTTAQEVLRQTVVIVENLTKLVHDPIEARTFLPKLMPGVKAVCDRASLPEVRELAERALATMKKAMGDDDKIEARTTADDVAKVLDEHIKKHNGLSGQLDLYKVARPFICEQVVIDVRFRYVNRIAARVAPYLKGLMQDAEAPGKVADAVQEHFIAEDQRKYGVPEKEDDGEVEIVNADFSLAYGGMLLLSHTNMRLLKGHRYGLCGRNGAGKSTLMRSIANGKLEGFPPQDVLRTCYVEHNQGEDADISILEFVSKDPEIAAQGQERIIEVLAEVGFTSGPDGRQSHKVGSLSGGWKMKLALARAMLQRADVLLLDEPTNHLDVANIAWLENYLKTHTEITSLIVSHDSGFLDNVTTDIYHYEPNKKLACYKGNLNAFVQIRPEAKSYYTLSASNVQFKFPPPGILSGVKSQTRAIIRMSNVSYAYPGATKPSLSEVSCQLSLSSRVAIIGPNGAGKSTLIKLLTGETIPTTGKVEKHPNLRIGYIKQHALEHVEMHLEKTPNQYLQWRYANGDDREVFLKQTRVLSDKDREQMDKWIDLKDGKPAKQIEALVGRQKYKKTLQYEVKWRNMLPKNNTQISRETLIELGFDKLVQEFDDHEASREGLGYRELQPTVISKHFEDLGLDPEIANHNEIGSLSGGQKVKVVIAGAMWNNPHLLVLDEPTNFLDRDSLGGLAVAIRDFKGGVILISHNEEFVGALCSEQWLVNDGRVAQRGNTAVSLDRFEDSSRPGSGVTSTAASSVVSSAVTSGAEDNGELKFRARKKKKMTKKDVKEREVRRRLRHIEWLNSPKGTPHPPDTDDEE

SEQ ID NO: 3060 - protein, 481 aa, Unknown
  Kingdom: Fungi, Phylum: Ascomycota
MAPLGRRHNYKPLPGDEELDVVKQPAGPSDKAARSSIDDDASRPRRSNRLARWIISFAVLSFLFAGLCPSSVRNAYGTVSHTAKRPARTLEEKARRILSSSPLIDGHVDFPLVVRAFFGNRIYDPEFREPFEDGDLKGHVDLKRLRDGQSGGAFWSVFAPCPANYSDFSDENYASSVQFTLSQIDVMNRLQHQYPKQLSQHVDSSNAMTAFKAGKLISPLGIEGLHQIGNKVANLRLFHDLGVRYATLTHNCHNKFADAALVGEGGKVAEPQWGGVSPLGQKLVHEMNRIGMIVDLAHVSDDTMRDVLGGKGDWDGSIAPPIYSHSSAHSVCPHPRNVKDDILQLVKRRKSVVMVNIAPQFISCRTSESDPTGLPEYVPEDANLDQVVKHIVHIGKLIGYAHVGIGTDFDGIEDVPEGLEDVSKYPDLVAALLREGIPDSDIRGIIGGNILRVWREVDRVAAVMQAAMAPIMEDDEPKLME

SEQ ID NO: 3061 - protein, 523 aa, Unknown
  Kingdom: Fungi, Phylum: Ascomycota
MAIIDIATTFVTQCSLAEAIGLILFIAFARFLRGDLDSREPPALRSRIPLIGHLIGLIRFGPYHLPKLGSKGRPIASLPILQGRFYAVWDPTCVQTLQKSKNLSFFPFLRLFIKKETNYDVRHEEIMQSVPGVVEKGRQVIHNSMTTKNVKTMSLTALNHLTKKLGKITADEPLTIDSMWIWFRDAMTSATCEAMFGEDNPIDRLDKYPSIMNDLWKFEGGVDRLVMAPFPSLTCRKIIAARETLQTAMREYYKNKSDQNQDVSVLIRDRAAMLREAGLSDDDVGGYEILIVHVAITNTIGTGFWFFAFIHTTPGLVDAIREEAKGAIQRDANDEVTIDIAHIAETCPLLLACYRETLRLTNQFIGNRQIMTDTTVSDSQNRTYFLKKGTSIQWPARFLHTSKEIWGDDAMDFKPERFLEVQKNPDSQDTKTKMASYIPYGGGKHYCPGRAFAQAENVGFILTMILGYEVSPLKGDWSTAGIPGVEVPSFASAVYKPANDGEGWGVKMQKREGWENATWKYLT

SEQ ID NO: 3062 - protein, 1120 aa, Unknown
  Kingdom: Fungi, Phylum: Ascomycota
MVPFSNAGTASPSIASTTPGPNQLQQQNQLPPPRSTSLAPTDPNSNAPGAQHKRVYQACIPCRRRKVRCDLGSVDNPHDPPCVRCRRESKECFFSATRRKRKADDGEVSEDEYIVRNGRKRLNNANDSASRTPPPIDPKAYSDVPLTPGGSQGRSKPLRRPDEHGDEQYHGDANQQLENFEAQTVMRRGVYGPHDALDLLYKAATDRSVASEFNKAKNNTHASSTPPQPPGFQHQRHESRSSSAAGGVNGASGGFPKPVARSSSFGGLAGADSRQDRVRRELHRHASDVGGARSSAQQAGRPDEQHPVDPGLMEQDPTTQPGYNDAIRAWQRFRFVRAGWFTPQEAIQYIDYYYKYLSPMTPISPPTFSNPASHINLLTDEPILSVTLLTIASRYMRLEGPGGHCRSYAIHEQLWTYLRGMIERCLWGQEAFGSGFCGSGSATVIEEANQTSSTAPWRGMRKGSLRTLGTIESLLILTEWHPRALHFPPQDATDELMLPDFEAPPVIGSEHGEDGAPRKDSSGFGGKRIESWLEPAWRSDRMCWMLLSTGMGLAYELGVFDDMEEMIREEGADRPEFLDNAYRARANRIKRLLLIYTTQLAGRLGWSSMAPDELRRNDPAFARRSSGKKQPNAQQTQTGTGNPNDEPTPGTTFSALSNVFNYIPDMELDDQIIHCWAGISYAMHMGNDKLFRSRRHTQEIIQSGKYVSLLGDFGPMLKDWAREFELFRLPPFIRCILKIEYEYVRIYVNSLSLQAVVERCTNNATGATGQNGNSGDGEHQQAQQEQAQQQPQPQQPQQPQQGQDHTGPPQLSPQTIMNYGKLPLGQLGGFTVHDQEYVREVVEGSRNLLNEVVTGLLPNGYLKHAPVRTYFRIISGAMFLLKTFALGAPRSDVKASIDLMDSTVEALRNCVVDDVHLGIRFADLLESLTSRLRNRFIQAPTIQQATSGRGQSPVAGADAAGGPVGGDWIGGHAQSLRDGLSGQFRPMSPTMEANNISATPFDLSASSFPYPGGASLGPSTPAAALDLGNHSNGQHHAQNPTPNHAAPNGGIDATLFDEWNNPGNEMWYLPPGPAFFQNVGVGGDSSAVAMTSEGVNIGGLDLLDYMGMDSAQYGGTVMEF

SEQ ID NO: 3063 - protein, 407 aa, Unknown
  Kingdom: Fungi, Phylum: Ascomycota
MSHGTTRSPAAQVASSDPLIPDEEQTSQRPPSPAASASEDEGPRSNTMWQKTKAFYSRNLGLFFVFLAQIFGSIMSMTTRLLETGFDTKFHALQIIFVRMFVTAVIGLFWMWYNKVPDSPWGPPGTRRLLIIRGASGSIGLFGLYYSLSYLPVSDATIITFLVPTLTAFVCWVVLSEPYTLHEACAGLIALGGVLFIARPEFLFRNHLDPGASTASSDLTAAMMRASGGILPPVEATPIERTIAVACAILGAFCAATAYATIRVIGKRAHALVSVNYFAMLATCSSFLIIMIHPDLHFELPQTPMQWFLLALIGISGFLLQILLTEGLQREKAGRATNLIYTQLIFSLLIDYFVWGTTPPASSIVGGILIIGAAVWVTLQKKTPSPKAETGTTEEQRSLLGSADRRE

SEQ ID NO: 3064 - protein, 616 aa, Unknown
  Kingdom: Fungi, Phylum: Ascomycota
MTENAVPEASGINGGHQLILPENCVEYYLFLVDTQVETRKKLSQLESVRQSALKLSQDLTKDYIWQREEFNLELRTEGGLTYLYGITDYGDAVEDEWLIVYIVRQLSRTHSSVWARIADADGEFLLVEAANVLPRWISPEIDRNRVWIHDGQLRIIPIDEESAPKTEDLSLSHAINFIMTKCPSLVHSSFVEEEAFYRLGKYPAQIADSIHHSMVTIPRRLAFVIHSVPRAIAAAVEAFYLRDPISLKPILATSGSLVFPPVDMVTRFDTPPMWESVMKHNEGAGNEVALARLETGMKLTCGFEMLAASAQKSKSRIVRETAIVIEDLEEDGDDALPSDEEIRAWADSQRDDDERWMDINYEDFERELGGEKATSGASKGTGGGFGDAQTQEDLRKIVSRFEAFLNDDKAGLDGAELDDMDYDNDSDDDDDDDLDDESDSEDREVGFDEAEFSKMMREMMGFRPEPTPAHNPAYSKQAPAPRSAAEAEEAQEIEEIRNLTSQMESELKEQGALKLDGRRDMALEDKGKGKERASPSSNNEVAGDSDEEVDIDYNLAKNLLESFKSQGGMAGPTGNLLGLMGVQLPRDEEAGDEEAGDEEAGDEEKTAPNSSRYAKS

SEQ ID NO: 3065 - protein, 806 aa, Unknown
  Kingdom: Fungi, Phylum: Ascomycota
MIIYAIKRWRKSRAKNQATTASSCVHRDDPSSEPCMECEAATKADETAAKAATRYRLKLIAGLFFPFSLAALDATIIASALPWIAKDFGQYSQLNWIVSSFNLTAAAFIPCWAQIANVFGRKIGINAAVILMLIGSALCTAAPTNAFPMLLLGRAIQGIASAGINVLCRTILADKVSLKENAKNWAVFSLVGGTSYALGPLIGGYFTRSDYRWCFAINLPVGAVALVCLWVFLRKDLLGPQPIPQIDNSTTTGRSTRFIARLKVIDYVGQVLFIFGFGLIILGLTWGGVTYSWRSAAVIVSLILGGILVCCFACWERSFVEDRFAARKMPWQKPMVPWSLIVNRDVGLLFFMECISGMSMFAVLYFCNIYFTAVKNFSSDKAGVSLLYFTPGLGVGTIGCALMTSTWPRTTFHPIMLGTILECVGMGLMAWACWTEKVANVYGFMALIGVGFGLRFMAGPLHGIGLFRQHRASVLALMALSIPLGGTLGLTVMSAVFNNTSGLDTHDFNNHGGEASKTASADLSDDATYNAKMGVVWAFVAMVPFTLLALVGACCIGNVKLGQGTGDPDTGGDNIVIHDVYLLTFLRKSKKTDTQTQVTDAKVDEGGTPRSRKARRTSRPERCVGVAAFYNSEWTIGPLIMNGPPAILSIAWSLADIIFLSIRRGIHPAACIVVDTILVLALAALTGVLGFTISKLSDSGYYFAFYPPGEQGVEYLRIILAFGVLGTLFHFFTLILVIYELKHRRKAAKQSSYVAGQYDGSFGEAPPAYVGPSQSTRQQNLAYQPHDEIVAPAQELYELPAKKTRL

SEQ ID NO: 3066 - protein, 969 aa, Unknown
  Kingdom: Fungi, Phylum: Ascomycota
MWIVNWFYDVLSSLGLLNKHAKLLFLGLDNAGKTTLLHMLKNDRVAVLQPTLHPTSEELAIGNVRFTTFDLGGHQQARRIWRDYFPEVNGVVFLIDAKDHERFAEAKAELDALLAMEELSKVPFVILGNKIDHPEAVSEDELRHQLGMYQTTGKGKVQLEGIRPIEMFMCSVVMRQGYGDGIRWLSHARLVSPATMSKSRVPTFPRNDKTYGFPPEAFEPSTLPDIDHEFFEPEELKAFERALQAPDPLQSPTELQSPIDEIGSPRGLRTSSSLDVTKRNSQTGSFLEDDINAIAASAAAAGGELQSPGPGTFITAQNDWAPINSRMYKSSKRGNSKRRRKGGRAAVEGILGTRTKDETREGYLYQLFKWPLLFFVFAWLGGLSIAYLSTRWYIWMYEHFFTWRGERQNLRSNMRRTFSYQDWVTAARELDNHLGRQKWREENDFAYYDSKTVKRVWDQMRKARARAETQEGKKNSLGGDRAVLELRALIEACVKNNFVGVENARLYSQTYYGTKNLVQNFIDEVERSLKFLLRTKQLETEEKRILFKHIYANYGRTALCLSGGAGFAHYHLGVVRGLLDADLLPDVVTGTSGGALVAALVATRTNDELKELLVPALASRIDATSESIAVWIVRWWKTGARFDSVDWAEKCSWWTRGSMTFREAYERTGRILNVSCVPADPHSPTILCNYLTSPDCVIWSAVLASAAVPGILNPVVLMMKTADGTLMPYSFGHKWKDGSLRTDIPIKALNTHFNVNFTIVSQVNPHINLFFFSSRGTVGHPVTHRKGRGWRGGYLMSAFEHYLKLDMNKWLKFIRHAELLPRPLGQDWSQLWLQEFSGTITIWPKSIPSDFWYILSDPDSSRLARMIHEGKQSVFPKLKFVGNRLKIERLIEQGRMETRPWARRGSLQTILSEEDLRSILAEEIVNGATTEEDSADEEASGVGLGMTALVENDEADSEDEGLALREKKD

SEQ ID NO: 3067 - protein, 274 aa, Unknown
  Kingdom: Fungi, Phylum: Ascomycota
MPKIKDVPDAWDDDWESQADRIEANPAPAPATEPEPALTKTERLARHVDTNRKLWESAETPQTFHYLEASNSLPANTTTFRPQVKVLSRKPVLAKRGGGSSGTQTPADDDDEDDKKSPQLTPEQIRAKQKRDLEEKQRRYDEARAKIFGESAPSSGASTPGTVTPPRGADGAHYSPRGRGRGRGGRGNNNNNNNNQNNSGGNNEGRRQNVPQQTTGGNRELFDPNYAQKQPGEGPARMTGTPVKDEQAPIRAPKGPDGTGRGGFGFARGRGRGT

SEQ ID NO: 3068 - protein, 197 aa, Unknown
  Kingdom: Fungi, Phylum: Ascomycota
MARFMGPRPKRLVVAITGATGTPYAIRLLEILKELKVETHLVMSKWALATLKYETPLSEAEIRGLAHTNYTARDMSAPIASGSFQHDGMIVVPCSMKSLSSIRTGFGDDLITRAADVTLKEGRKLTLAVRETPLNDIHLDNMLFLRRAGACIFPPVPAFYTRPKSLEEIIDQSVGRMLDSLGLYVEGFERWEGFKKD

SEQ ID NO: 3069 - protein, 284 aa, Unknown
  Kingdom: Fungi, Phylum: Ascomycota
MLGSIGTKLALKKLGLPKDPFDFSGFYADPDREPNKLRKPRPEDNPDGDDESAWTSWMSLKSLPLAVHPWLSPPPPPVDVARCPRIGDLAPRDGEGRLVFLRGRRTLVVFLRCVGCAFAQKTFINLRALSNKYNGALDCVAVSHSSEQATKKWIDLLGGAWGVRIVIDEDRALYAAWGLGLGNMWYVLNPSTQVQGWKEKGWLGDKVAGAISKNERGQPPRQGAVAVKEVHEDEDDSVNTTMGNKWQEAGSFAVDGRGSVIWGGKALKADDVMDLEEGAKLLMM

SEQ ID NO: 3070 - protein, 588 aa, Unknown
  Kingdom: Fungi, Phylum: Ascomycota
MSLPFRLFIRPSPLRSSVSQPALLASTIDSTTTITLFQLHHTTTAVLPGILSSAAISPSTRVMDKMSKFRRKQKPKPPTIDTSVPRVSSDTTDSFRSDKGPTAVAAAAAVKTTSSSSAPSSPTSKTKRAAAAKAAAKEAKNKKSPFRGLGLGNYRKRARGSPPADLSSSPPQPAVVGQDGTASLKSYRLSTDYDHESRARSAQDAPRMPGFLSLSEQDISRQYDALQGAERGRVPMLAGTREGDESRWTQYKQTDRSRGQMDRYSNIKPWNYNRVRLRVPEDQFDYVNASAIELPSISDPTQGPLRYIAMQGPTEASFAYVWRMIAEQIGSPAVIIQLTSMVENGVLKCNQYFPSEEDEATEWLLNEDDVWDDGWRAKLVLDSVEEVADGAIEKRKLLLHVKDEAHPRVIWHLLYLKWPDFGVPGLEDLDSFLELMRFSRELNINPSNPRVIHCSAGVGRTGTFISLEHLMRELDLGTLHGSTGNSSAEAMEADLIHDTVNLLREQRKAMVQGEQQLRFIYQVMRRLWHDRYGGGGYDSGAEPSAKRLEVGSISTDPFLDGHSNTEAVAAVRPSIGQTGAQNSFQTHR

SEQ ID NO: 3071 - protein, 547 aa, Unknown
  Kingdom: Fungi, Phylum: Ascomycota
MALPLPYSYIQCPCSDQAEAEPDDDSQQEDTVEDEDRTFDPRAPRSNYSLFPLEHLMYCEDCQQIRCPRSTQRSEGNRCTRSCYQCPNCVAPLQVSPLQANNESGLLSADGTSAAAQGPYALICTYCNWASTEVGIEFDRPSGIHSQLAKLQNGGQPRLTAKDVKDRRNKNPDEPMLPDELVDAEMQFANLRDFYQAQLGDAKNPMGGMSLGDNMGFSSPAALSRIMSLYTGRGHQGDRAQHGHPDTMRESRNTEEGMKMAQLDESSSIKKLMAADWDTTLDKEQRSLQMEHTRFQEDMRPIPCLLRTKRSKRCPVCRHIITKPENKVTSTRFKIRLVAKSYIPTTSIRPLHPTAQPIPVTSRPMLPVEELLKPLKTYQYVVTFKNPLFENVKVTLAAPNKTPGRFSSNVTVLCPQFEIDANIDMWDDALRDDAADNKKKNDESNGQAAAGKVWERGRNWVSIIVEVVPPSLRTEHLDLTVGKGEVVDKSPMRDGEDVVEIPMFVRLEWEADAQHEVGSAPGRDKEAREKRELAYWCVLGIGRVSRQ

SEQ ID NO: 3072 - protein, 401 aa, Unknown
  Kingdom: Fungi, Phylum: Ascomycota
MKRLRLAAPATRWSPQHIQRQSRLGLSITNACASRRCLTTESTTASNSEAATSSLLPNTRLPAPAHHLSELNTSPPPSAALSSAKLAALHARLALSKKIPLQTLARCLITPSADQDRRFNNANLALLGSTIVNYHAFEYIICKWPRLPQSVLFNALGAYSGKDSLTQVSKRWGVEEAAAPGKEVDAGLLQWSVKQRDAVDTQWAHTRAENERGDIEYRRGMSSRVVLDDAFGDEMPGVKQGQSAEQHLADSQSVAHSSFAQAVVGAIYAHCGRESAKAFVSSHILSRHLDPAELFQFKQPVRELSMLCAREGFEAPIARLESETGRLSRTPVFVVGIYSGKDKLGEGAGPSLNSARKMAAMNALKAWYVYSPGHKVRVPSDMMEEGAKPWTPPHIDIGEIV

SEQ ID NO: 3073 - protein, 174 aa, Unknown
  Kingdom: Fungi, Phylum: Ascomycota
MKLSSLAVALVSVLGFADASGFARTCKSWKVTGTNNVVLRGCCLDARGYYRISELHLKHCLANIGGLVKKKEGNFHKSCNNCRVQSSPNSKYTCKCFIEGEENDWYDVTYNDLNRIISNLDAKLGCFNAIGGDKGTDSGCKGYGAQLLSANGFASNGTSEGALEGDLEETLEES

SEQ ID NO: 3074 - protein, 142 aa, Unknown
  Kingdom: Fungi, Phylum: Ascomycota
MSSSLFCCQAIQPYRPQRLSHEDKFTAFVAWAGFPQESQIDKSIDSGIISDKGYAIQLVKQVNFGPLESTRYFVPGNGAPVDFIEVDASALIQANFQKVNTYKNYKCGAHNKFFEINVYQRDLVNKHHWRANLARPASEIDL

SEQ ID NO: 3075 - protein, 604 aa, Unknown
  Kingdom: Fungi, Phylum: Ascomycota
MTLIDRNSLIRQDPASLNETSTMASSDVITLQNLEEKLPRWSPNSDSHLHAIVDMGSNGIRFSITSLEPPFTRLLRPLYSCRAAISLFDALTPSDTGLVFPDSIIASVASTLAAFTRQALSYGVPKKNIMVLATEAMRRAANGGRMLEAISKSTDGLGVHILDPAVETLCGAVLGSRSGLGSLPVQGALFLDLGGGSVQMTWVDPSEPSYELRAAESGISLPFGAARLIKVLKQDDVAVCAEQVNKLSTGLAIAFDNLCDKFPRLQALRQAQQRGEGGLVDVFMCGGGFRGYGSMLMHTDEVQPYPFSTVNAYSVSAARFKDTGRMHRMNEEQQEPIFGLSNRRREQFPAIVTVIEAFIKTVPNIRRVTFCGGSNREGALMVKLPLALREGNPLDALAGIDLATEPVFSAVAEILEDTMPSEAGLTIFRAGLTSLVLKEAWSRQGYDADANTSFSLRHSINRDTDTPGLSHSARALLALTLAARWGGSLSPLDAQLSSNLQAIIDRESPSASFWAFYIGGILRILAEVFPVLPQDAKQLRQVISLQSSIIRTQDKRDRLSSTITIHAGRPELNAEKLSKKLKETVRTAEQNSALKFESQVIIKS

SEQ ID NO: 3076 - protein, 954 aa, Unknown
  Kingdom: Fungi, Phylum: Ascomycota
MPDRTSGSSRHVVPPSPSRAPPPPVPSASASRRPSAVARDSAQSNFDSSVFSRSSISTNFTTDSRITSLSSPQYPQPTASYRDSFISIVDDPFFQRFDPAFSAHAPPATRLSSDSEAGDADDDQDEDDEDDEDDEPDSDEQAVSPTAQAAGGHDPKSDRNWPPPRRESLTIGPAQYWAHTAAMESFNIAVIGATGVGKSSFVQRVLGLQRPSMSNTSSVRMAVDNLTHFVTLLELDLEYFELSPSQPIQWPKQMNGHIVPRVDAALILYDVMEKESIRDLPQTVAALTNSGLPAILVACKCENPEDDWEVDAEGMANHKFFKACIGTYQITKDENETARACLQAILKAAIANRREEHGESVSRRRAQSAAHAEPIEGPGGRSYTDQSKHSRASSDLSLLRGFPNAPVKDGFRGQAGRSPRLMHQSLATDGIRLDRAGADSFLDMEESDAESHRYSDDTPILQRNDENPEKPSKENGVTFDALVDRLLAPRLSKPDNNFSEVFLCLYRKFAAPGKLFSAILERLDRVREDKTAHYLSKTANQLRMIEVIAKWVSLYPGDFARPATRRNLEEFIRHLSTEPIFSIAAQQMRRNLHYNVIEDDDTGWANSDETGDKVASQLLSKEMNDLAVGISTMQFDDEHNGRPSASSDASQLDRGSSVSSQFHFHTYDEYEREASSLEPRDHLPMNKTRYHIFMDIPNDEIADELTRIDWIMFSSIRIRDFVRHVSLSASQKEKCKSLKNVNRMIAHFNHIAKWVANMILLRDKPKHRAQMLEKFMHIAVKLRQLNNYNGLAAIVAGINGTAIHRLAQTRTLVPEGVTNRFTRLCILMGTQKSHFAYRLAWENSPLPRIPFIPLHRRDLVSAEEGSKTFVGSKGDRINWKKFEVLGEVLLPVMKSQGAAYPNLARHDNARELILGCRMPTDDEDIYQRSVQVESGASGAGDLVRKKTFPWFATK

SEQ ID NO: 3077 - protein, 882 aa, Unknown
  Kingdom: Fungi, Phylum: Ascomycota
MGAAWSSLSWSQADPQQPDSTKPSVPSTPSATQNLPSKKPGRASNKVQSGRVTKATASQKTGNPAKMAQTRKSRAKAATPSNGVDDQAVKDASQVSKASDGQQNIKNDDEAATSSQPAADAGPTTSKPFKGCAIALSGNMVSVGHNMTSMRKLIRDLGGMTPSSITKSTTHIICTSNEIGRRQSDSVGMNIPAIKPEWIVDCEEQKRRLPEADYLWDFSCTVAGQQVTSADVLARAIANGLIISPANDNASAATSKAPKAGKRARKDSQDAEVKDQDEDDAKPKAKKTKTTAKAAKGKAAAKLEPTPAPAAAAPIAEDAEDGDLAEGQFAKKKDMAIPIDEFCPLQGYQVYIDNDSGMIYDASLNQSNASHNNNKFYRDQVVVDPKSGTYKTWTRWGRVGDVGQSATLGDGSLADAIKLFEKKFKDKSGLSWADRGNNPKPGKYAFVERSYNPDSDDEDDAPKTSKVKKEGDVEEEEEDSKPPECTLEKPVQDLVELIFNTTYMQNAMTSLNYDANKLPLGKLSKNTITRGFQQLKDLAALLNDPNLATTQWQMPFASAKEHLSNTYYSLIPHDFGRRRPPIIDGDILKKEVELLESLSDMKDAADIMKIDRKKAAVHPTDLQYMGLGMKEMTTLDSKSKEFTLLEKYLNATRGSTHNVSYEVQNIWRIERPDEHDRFDKSPFASIKSDRRLLWHGSRCTNYGGILSQGLRIAPPEAPVSGYMFGKGIYLADMSSKSANYCCSYNSNGHALLLLCDAELGQPMQELQNASYNAGDTAKADGKVATHGMGRVGPSKWIDAGAVHPSLKGVKMPDPNHVPGDTKVKNASLYYNEYIAYDVAQVRLRYLLRVKIRGSVFRRNHGSAERNHLGAFFVYEHDIAVDL

SEQ ID NO: 3078 - protein, 329 aa, Unknown
  Kingdom: Fungi, Phylum: Ascomycota
MENPAAEEVQARHRRELKDLQGRITSKKKNANKKTRKGVNDECAAMERDLKEKQAAELAALSAEEGPLDMPAEDVDQPPPEASDGEEKEEGTVKKAVGKAEEKIEKAVEKLHLGGGSSGDGSNSNGLSPQSSQQGAGQKRNRQKERMARRAAEQEEATLRAEQEASTMTDHRAQESASIQKTITSNSLTEHPIAPDGHCLFSAVADQLSQNSIPLTSHGEPAYKTVRRDAAGYMLDHRDDFAPFLEEGIEGYAERMKSTAEWGGQLELMALARRYGVEIRVVQDGRVEKIGEEEGLKDKGTGKVLWLAYYRHGYGLGEHYNSLRKSEKA

SEQ ID NO: 3079 - protein, 468 aa, Unknown
  Kingdom: Fungi, Phylum: Ascomycota
MQLRPGAAALRDVVASRAATRSSVCSSCRRPSPLLSATTISATTLPTSSIPYTHQAALHTSQRRDSAWGAAVQVASNVVGNVVKRATPNDGMTVDPLRAVAKEMQFLTGNIRKLLGSGHPSLDRAAKYYTQAQGKHVRPLIVLLMSRATHLCPKAAATQTPQTARGIDTSISPAQILSDINPSAQPLTSYDTLDNATTSGNPDILPSQRRLAEITELIHTASLLHDDVIDHSVSRRGSPSANLEFGNKMAVLAGDFLLGRASVALARLRNAEVVELLATVIANLVEGEFMQLKNTERDERRPQWSEEALSYYLQKTYLKTASLISKSCRASALLGGADEVTVEAAYSYGRNLGLAFQLVDDMLDYTQTGTSLGKPAGADLELGLATAPLLFAWKNNPELGDLVGRKFEQEGDVARARELVLQSDGIEQTRALAQDYSEKAIAAIADFPASEAKDGLLDMAEKTIKRRK

SEQ ID NO: 3080 - protein, 467 aa, Unknown
  Kingdom: Fungi, Phylum: Ascomycota
MHFSPAFKTSQNCLPSPDGSLLASLTFPSPTSAVVAFRDTDALQTISTVKIAQEASNPVSGLAWSPSSKRILISRADQVRIYNVEDATLHAVVRNAGSGGGKPTFIHFGATDDEVVVFSAFGMKLSVFDLTSSKAVEIANPKFYHPLSAAKSYAFNSRSAHMAVLTRSAGRDALSIHEPHTREVTRSWFPETVDAAGLLWTPDDQWILIWESPAHGHRLLLHTPDDTVNWRVAMTLNHPISVTPVETLQLWQEQIGKSLDGPGTHEFVRATQTISPDNAASQTKSTSDLRAGCSLAVFDASSDLLATRLDESPCTVWIWDVASAELRAVLMFHSTVAFLWHPSIRELLLITSQDEAYRGLSYVWDPLSEGPRCMSLGDQLPAKKPQGKTQAVWLNWSQEAPAVFLSDASHYVLSVVSDSLPYPQAWQHGNQGGSLPGSITKGDVPLLDGPDDDDHSTLEDTFSFKHG

SEQ ID NO: 3081 - protein, 319 aa, Unknown
  Kingdom: Fungi, Phylum: Ascomycota
MAPSPQVQDNFAAFMDGSTQMPGMPHDPAGRLAAHAAALDPINHPRMATPGIPQPQQQHSGQSTPDFAGWAADFNNRFVPQRSPMNPLQNGVLPQQQPQVQQPAQYQGFQSAFGSVAPLYGPSNGGFMEPVAAAAQHPATGADFDQEMSRWMAANGGGNMTDVDAAMDQMAQELELNEAALREAEQAAEREAQEEAQAIAEAQQQQEALEARLTDLETPEIANLSLDERYALQEEIKAQEATQERSAVAEAAEQLLDTVQHEQGDKWQNSVFLSLMRDFRDGRKDIIDGAIKERSAAPSPVVSEGGTLVTDFRKLHDPR

SEQ ID NO: 3082 - protein, 310 aa, Unknown
  Kingdom: Fungi, Phylum: Ascomycota
MHSIASAFKPDASGYSPKQVPYLPTLKLNDGNEIPMLAYGLGTARSNKGAYDEELVKTVETAIKVGYRHLDGAETYGNEKELGAAIKKSKVPRDHFYIVTKVSGTQKKDTKAALDESLEKLGLDYVDLYLIHAPHFADTPEELQQKWADMEAIKESGKAKSIGVSNFLQDHLETILKTAKIKPAINQIEYHPYLQHGELIPFHREHEIAVSCYGPLTPVVRAQGGPVDEIWKQLADKYAVSEGEIGLRWCIDQGLVAITTSANELRMERYLNKVPKIKLTPREVQDVAKAGLEKHYRAFWNNKFDADDRR

SEQ ID NO: 3083 - protein, 544 aa, Unknown
  Kingdom: Fungi, Phylum: Ascomycota
MTEAGDKGGAQRHGEDRGLLASEDQTDYFQDDDLVVYPGETDSGAGDDGPKTPRTPGRVRFDLTPEVVGGPFPNGHTDRAYRDSLDVEEGAGRDSSSHHRTPLLTDMEAPSVTVANSWGGGDDDDEIDHTDRLEAEMRRPKSGLKSAFMNMANSIIGAGIIGQPYAIRQAGLLAGVLLLIGLTILVDWTICLIVINSKLSGTSSFQGTVEHCFGQAGLIAISLAQWVFAFGGMVAFCVIVGDTIPHVLLAVWPGMGDVPVIGLLTDRRIAIFVFVMAVSYPLTLYRDIAKLAKASTMALIGMLVIVVTVLVQGAMVPSSERGSFPTAELTINSGFFQAIGVISFAFVCHHNSLLIYGSLRTPTIDNFSRVTHYSTGISMAACLIMALAGFLTFGDKTLGNVLNNFGPDNTMVNIARLCFGLNMLTTLPLEAFVCREVMITYFWPDDDFNLRRHVVISTGLVASALALSLLTCDLGAVFELVGATSAVAMAYILPPMCYIKLTTRSWRTYLAYATVVFGTAVMIISVIQAIDKMINGSGEAAQCV

SEQ ID NO: 3084 - protein, 861 aa, Unknown
  Kingdom: Fungi, Phylum: Ascomycota
MSTTLTDAQLELIDSLPPDDIPIKLRCAICSKLAVNAYRLPCCEQAICETCHSNLPDACPICEHSPLSAEDCNPNKSLRTTIKVFIRTAEKKREAARAQEAKESVPNTPVEARKPSIAGSLAPEVQANKEPEPLAQPAESAVPEAHQGVQAEPQQDEQQQHDRPQSASAAEAEQGAAGDGHPEDEQQVQRRVGEDEDVGAGDPGAEDHEAEGNTSAVNGDYNADIGGGSGDYNQMQMMMAMQNGMNPNAFGGFPMMNMPGMNMDPMQMQNMYMNGGFQGMGMNGTGGFGGGFGQGSNNWNNGSQQWNFDQNNYNQNGAGMGAGDFGGFNSGFQSGYGNNQGNYGHFNDYRRGFGRGRGRGRGFYGGFGRGGYQQQSQYGGVGNAYFQEQGRFPHQQQGQDQLTQQQQDDRPAAQGTDDLGRDIPRTTEEGQGETGPQDSSALPSHENAGANSSNGASAIPSVLSVPDVPLNAPTGPKAMRQGLPNTSLHNLRARGFQVGGVAGSVGHGSQSGSRPHTPQYGGHDMRQTSESNTPQRHETQGNEVHNDDRGRSASGAYEKQEDSRRTRSRSERSRSRSREHRGSRRHRRHRSESVDDDGASDHQRKKYRSSKRSSHYKEGEDEDEHASRSQEQKPSDISRSQSASADESRRSSHRSRRDRDRDRRDKDRDRHRDRDRDYDDDRKKSSSHRSHRDRDYESSSRRRDRDRDRDGHRDRDRDRRKDRDRRDRHRDEEREDRPTANNSRRPSVIDETSATAQDFKPPSGPRGFDIKGSSSRNTSGTKDVHTLEREARNRERLLKEAQRMAGMAGRRDSAGGSRKRGREDGDEGGGRKSRRSSRRDGGGDEERMRRGEEEREESRWD

SEQ ID NO: 3085 - protein, 399 aa, Unknown
  Kingdom: Fungi, Phylum: Ascomycota
MDGSTHVLGFRDGRLYSRLRPREQPPCSSNDLITFLTRLVPHSLPLLRRLQLSPINGESLIVSVGLPLQRLASGTESECIAEQAKQHAADPATVQPDQLWTLALIHRHGHPSTEIWFFTSLELAHGHASHEKEAQPAEMKPEKLCLPFTKPAQEQATLQLATILSYVPVTSRQDGVDLFQQCKTFGSPGSLAGNVHSTVAALLAHAGLIVYTSPPYGHYVYPAVVDAKGTIPDGSSEGLPDGLMWSTIQPSDHADVMAVNKIVRSAATIAHLPSAAIRRVQLKDDGSPGKAVAFGFASGDGSLRTLHVDQEFRRKGLAKAVVRRLLNSGVFAPPKEGTFSASEQVYEEIEEPQPLAYSSVEKSNVASIKTFEGVGAAWRWDVYWAWLALDKATKMLRSG

SEQ ID NO: 3086 - protein, 395 aa, Unknown
  Kingdom: Fungi, Phylum: Ascomycota
MATNTSHTTSSDDDLIILPDSPPIDRRSINFLLNDPENTDQPRLERSRHHRQQRRNQLPRPVATSAFIDLTEEPDSPEEQRPAAGPSVPGPPTQWAEERPTRSRRPEAWRNPRRTNPTRISPPGLTRSDSTLRDGHSRSIIDLTGDSPEESRPSLQLPRMNRHSNGPPPHLGPHPSLPRHHNRHHHHNHPHRHQRQPTTDEIVEVVTAVGTVGDFVQNSLRHYHGFITGGFSGLARAWNPPSLDVTTNAFAPRPETPQPPMDPVPPARAGFTRNTHAESEPQDEGEIAVCPACRDELAYDPTETTKSANANTTATGKKRKRAPGEHHFWALKKCGHVYCADCFENRKPTKANPGGVGFQLPSNKTGAAAFAEMRCAVDSCETKVAQKGEWVGIFL

SEQ ID NO: 3087 - protein, 432 aa, Unknown
  Kingdom: Fungi, Phylum: Ascomycota
MADSPRGGADNLSVDFEDSNSNKQNEKKKSRRPPNTAFRQQRLKAWQPILTPKTVLPLFFVIGIIFAPIGGLLFWANTQVKEIRIEYTNCADDAPNWASDGSNFTDMADGVSTSFSGGAEEINAQWSAERNITTKLWIGGAEVNTTRCYIRFSLPEDMSPPVLFYYHLTNFYQNHRRYVDSFDTQQLKGDARSYDQIRDSKCTPLYGDGDKKLPYYPCGLIANSMFNDTYTFPVLRNPPGESSGKNETYEMKNNTGISWDSDIDLYSETKYKPDECVPPLDWAERYPGGVYTEERPPPNLKEWQGFQVWMRAAGLPTFSKLYQRNDDDKMIKGDYEVIVDDHFPVKEYRGTKSIVITTRTVMGGRNPFLGIAYIAVGGVCILLGALFTATHLIKPRKLGDHTYLSWNNAPASKGPGPSTAAATGREARPGEA

SEQ ID NO: 3088 - protein, 411 aa, Unknown
  Kingdom: Fungi, Phylum: Ascomycota
MIQLPDLNAFDISPTLGFLSDHRPLPSFSNPHFAQLDELAADLSNLITNGSLRPTINSLPYLDSIQLSSEQEYKRAYVVLGFLIHAYVWGGTTDSGPLETIPPQLAEPYLAVCDKLGTEPVLSYAGLCLWNWASNSTATSSPGGFYELEDLQPVGCFTGTRGEAAFHHVPILIEAEGGPLIPLLLDAVAAIERDDGDQITRALIKSTAIIERMKKHLPKLYTKLEADMFYHTLRPFLAGGKGMEDKGLPRGFVFQRRDGSEKEVQCIGGSAAQSSLFQFLDIVLGVQHEPTAGNKETLFETMRPYMPGKHREFLRTVSTLPSIRPFVEQNASNSALHNAYNECISQLRSWRGSHIAVVSKYVVRPARSALGVSGGATTDNLEDEKDDSLTGTGGSALIPFLRQSKDETAGL

SEQ ID NO: 3089 - protein, 840 aa, Unknown
  Kingdom: Fungi, Phylum: Ascomycota
MEAHTVEYKLRDLATQSVTLFPTRAQICREIKDVPLKAGDNRITVIGLSPTVDEDSVKVEGSGLAIITNISVSKEDNREIFEEIYPEYDDSVESQLPRPLSNEDAYNEDLNNLEEIPELKEARAQFDSLQDEYKAAEEAIANASERLTVLDHFSKNLGSKGENVDIAQYMSTYRAEREKMFGDQQTAEQNKRDLLKKIEEATIKVNLYLAKQTHQRDLQRWEKQQADVEKRKEEERQRRRDQREASQRNARKKELLEFWPKYCYNVTITLDCSPYTPGSSRRNSTTSEAELVKASPAATGGDTVHCDLVLSYITTSAFWAPSYDMQLNSTSASGTLLFDAQLHNSTSETWSNCNVTLSTSQATATSIDEPIPALVPWHIRLIGKSQYTKDTTDDISLSKEEKKRKEQLLQKNNPVTSTKARSEMFRGDESSNHALQDYQMSLMLLEQQNKKRLMMGTQGNQQDQQHMRHRAMQQQAQMQAQAQSAYQPMGQPHAASSPWKSASVQPEDSRARKSAFGGSNSNAGGLFGNSNLASSSSGGFGSVRTIAAPAQAIPPPPGPTSDSLDNKNFSGFMSADDDSFSVANTESEALPALDFKDSLVEETGLTTAYDLPGTKTLAPGATSSKHRVARLSLSNIAFSYTVVARYKPVAYLKAKIRNGSKLTLLRGTLGLTLDGGFMGRTMLPRCSAGETLTLPLGIDPSIRIQYPGPDVRRATTGLFTKEDSSIYSRTITIENTRSSASSKPCHIFVHDQIPVSEDERLKVELITPRSLTANAGAVKAGVAGTSGIENKGWGEADAIMKENGTISWNVRLNPGKATKLDLEYAVTMPGGGGHSAISLA

SEQ ID NO: 3090 - protein, 281 aa, Unknown
  Kingdom: Fungi, Phylum: Ascomycota
MALDDFDRIAAFQVAIWSIYLIGGIYLCTKHGFARSSGWFFLVLLSLMRIIGASMRLATISDPRNANLYIGWAVCSGIGLGMLIAVSIGLMSRLLTSVRRANGGHTIITPMMQRVMKLVAMVAIILFIVGGTQATWGTTSGGQPDVKYPTLSKVGVSIMIALLVYSLIEAVYLTTLKRYIPDGEKRILLAVYLAFPFVAVRLAYSATLVYAGYSPSPWFSLGVEVLMEVIAAGIFEVIGFTLMKETKDVAPEMHRISDPESQQQFGHGKGKQPRGLIRRFL

SEQ ID NO: 3091 - protein, 1411 aa, Unknown
  Kingdom: Fungi, Phylum: Ascomycota
MDEGPGELFGPGVLPDEANFFIDAFTDDTGLQWLQSSFVADRPPSADGACLEQASHCDTELVKDPSKDLSPIIATDKQGDAPEFPANADASTPAQSPELVGAVRKEADDPILVDLVTTEVQELKDIQAPSIPQELSIIRLSPVPDDIVANEVMASLSPHPRLVSSPSLVDSSSESAPERERLSSAQDVRLDIRKDEVTAVTPATSESTIATRPAALGKEHAVGEAVPYAEISSRTPQAIPLSPSPPRSWSTASAAPSLLQCPVQANVSVELPAATLVSPASYYEPFEPPAPELAEWRVVEILLRESRRLRLDQSDYVEFELDNFAVYVDSVHYPNEMRALHFLDTRPGHSRYYFDGCLSVGDVRYFVRRVPIAALPIDGYTDPEIATARGLTWLQSTHNARNTIYYKLGKPAREYARFFEPFVWVADLAKHFVDYLDAMMEDGIKVSIHCFVSAFGQWLLQRHGRAPELLEWGQKHLSGDFRSSIVAHVGFLHKEAYGVLGLKRAHFHPLWNEIMRFERFKPEPVLGPVHDPTIVTDYIRHLFSALPFGNRLESIPLSPETKRLRKKIIRKRRGDAPKDLVTSNIGLSRKIKAGDTISTLRDNAGSGSKWKQQSSHGVPHAERWFARVLKVSRLKQRERDGSRGSSAEVARRGQRVFDVIWYYRPEDTLCGSMKYPWPNELFLSDHCSCTESSKITEDQVMDVHDVDFWGTPTTKKDFFCRQTYVSGDRTWITLKEKHLQCEHINPDHAIIDEPRYRIGETVLVHLDKNSDRTEPCEITELEEDSAHVGLRQLLRRRDIDDSSAPVNELVWSSNFVHTKRSRIQTRCHVRFFPHGMAIPAPYDRSGVGAFFFITHEQNGETCAPLTELPATLRQGFDPYQDIPKLRGLDLFCGGGNFGRGLEDGGAIEMRWLNDYDQHAVHTYMANVADPNIVHPFLGSIDELQRQAIRGNFSEKVPKIGEVDFISAGSPCPGFSNLTNDKTTPQQRKNQSLVAAFGSFVDLYRPQYALLENVRGIVQKKANRDQDVFSQLICAVVGLGYQTRFFFLDASSCGSPQSRGRVFLVIAAPGCHLPNTPQITHSHPPTARALSLGLLPNGEPMAEREMPDATPFKFVSASESCDDLPKLYDAKPDTCILHPDHRVMIGTTKDMRVQTCLIPTQPWGMNFAKAWYGMDKKCAGSGVLTQADRDGFPADAGTRTLGRTLANSSAFGRLMPNRPFITITTRQSPGDAKNGTQLHWREPRPITLMEARRAQGFRDHEVLLGSVSQQYRIVGNSVAREVAVALGLMFREAEYGSLTDGEEDLSRLMEVDAEAWMDTTPDSEEAEDLLSLRETGSRSETVTTNISMRSTPATTKRSRSTSTLLTVEIPSMKRPCRTSVAPSSDGTATPSARRSRSSSRRTLDTADGGSLC

SEQ ID NO: 3092 - protein, 403 aa, Unknown
  Kingdom: Fungi, Phylum: Ascomycota
MYLSKLVVVAAGCLCLSNTVLGHAHDDAGASEEQIRILNEKWGTDWPFSGISTFAHLPHFKCLIEPDKTFDIGIIGAPFDTAVSYRTGARFGPRAIRSSAARQTSFRSFNPRAGINPYKSWADIVDCGDIPIAPFDNKLALRQMSEAYVELGHRAPTSQASGYQGMSKLITLGGDHSVALPALRALKERYGQPISVLHFDAHLDTWHPAKYPSAWVDPSDTDAQSFFNHGSVFWLAGTEGLIGKNGTNVHAGLRTRLSGTDWTDLEDDTEQGWFRISADEIDDIGVAKVIEAIKNHLGTERPVYLSLDIDVIDPGMAPATGTPEPGGWTTREVIRILRGLEDLNLVGADVVEVSPPYDDAGESTSLAAAQVVYEILTSMVKRGRRDEQERLSAGEGGAAKDEL

SEQ ID NO: 3093 - protein, 238 aa, Unknown
  Kingdom: Fungi, Phylum: Ascomycota
MKFSLLTTLASLATFTMAQTQLCDQYGYYAANGYYFNNNRWGQGSGQGDQCLLVFNTAGGGVSWQADWTWSGGQDNVKSYPYSGREFTPKLINSIGSLPSAAQWTYQGNNIRANVAYDLFTASDPNHDKSSGDYELMVWLGRYGNVYPIGSSKGNVNVLGQTWELFDGYNGAMRVFSFVAPSQRGSFSGDLKAFYNHLIQNNGFPGGSQYLITNQFGTEPFTGGPATFQVQNWNAQVN

SEQ ID NO: 3094 - protein, 482 aa, Unknown
  Kingdom: Fungi, Phylum: Ascomycota
MVGKRGIGEEDRKHSYPADQGPDGHLNSSINVRFRRTPTGDLEAGKPPKSSGGDARPRPRLWGYHDSNEHAAEEDARREELKGALLKGIDRNELERYRKSRGEINEIKNNGLRKFYEDQNCRLNDWLEVDAVVMAIADDVLESMNPDPDHDGENERNGELQRVAGNINKLLPEEEQEKRRKAARKANIAIQVNVVANVLLLAGKGFAALTTGSLSLIASLVDSALDLLCTLIVWSTNKIVLWRLNALKRRFPVGRRRLEPLGILVFSIIMVLSFAQILQESVGRLMPPHATAEALSVAAIASLLATIVIKGIIGICCYPIKTTQVQALVQDCKTDAYFNTLSLLFPLIGYKADVWWLDPVGAGLLSLYIIYDWGHTSFENVVHLSGEAADDRTLRKLTYLAYRFSPVVTGFKAITAYHAGDGVWVEFDLLLDEKTPLNRSHDIAETLQYCAEGLAEVDRAFVTTDYAVSGPTGHATDADHSH

SEQ ID NO: 3095 - protein, 328 aa, Unknown
  Kingdom: Fungi, Phylum: Ascomycota
MEPATVIGLVTALVETFADGHDDYSAWKHKRAASNYYVGRGLASAPCALSTLLLISGPQLKDTYDKAVQALGTDFSTGDSSCRSTLWSQLNILSDRVASLHRAAGAAASGVLDLADAVQVCEGVRRASLRALIEQYSRLAAGRPIPKALAVPKPKRAPHRLAQSTEPSLTRDDDRMTTITTLTASTDQLRFQSEPPSPPPTPKVPDSTSEAGRSHRPTNSVFALFCPEALGLQVDTKKPLSAKGECACGYTWRALIADSKDVLGLKEGFRLTIRYLVKSHHSKDSYACVLCTSSGKSEKYHGVEQLRDHINASHTKWQLLHDADCRSA

SEQ ID NO: 3096 - protein, 665 aa, Unknown
  Kingdom: Fungi, Phylum: Ascomycota
MSRSTAPGRDPLDQPVTPAASLGLVVTIVTESPPATSSRYFASELLQAWELFRIHLTYLIAILPFLHRPPTGPSIDGRPTRKRKAAEAEITSDKRDTFPTKKVVSSAVSPISVAAPPTPVTTGSAGMDSDEEFMSNMSSDDGMMNDSNDDMSDFDDDEFEHPDTDFDLSNKDLDKPKRPAHVVPFKVFEPTDIQKQQDDMINEVNMILTMSKEDAAIMLRHFRWNKERLIEDYMDRPEAVLEAAGLSSNSSAMPKIEAIPGFVCDICCEDEPGLQSFAMKCGHRFCLDCYRHYLTQKIREEGEAARIECPSDGCGRIIDSRSLDILVTSELTGRYHELLNRTYVEDKDIFKWCPGPDCPNAIECGVKKKDLNKIVPTVECKCGFRFCFGCPNPDHQPAPCTLVKKWMKKCADDSETANWISANTKECPKCNSTIEKNGGCNHMTCRKCKYEFCWMCMGLWSEHGTSWYNCSRFEEKSGLDARDAQAKSRTSLERYLHYYNRYANHEQSAKLDRDIAAKTEKKMVQLQTASGMSWIEVQYLNSASQALQTCRQTLKWTYAFAFYLSKNNLTEIFEDNQRDLEMAVENLSEMFEKPITELAESKLKVDIMDKTSYCNKRRLILLEDTAENLANGLWTFNSDLTNPTAPQNTQPPTAPVQPVSARTRR

SEQ ID NO: 3097 - protein, 1765 aa, Unknown
  Kingdom: Fungi, Phylum: Ascomycota
MASSLASDKPNLPVPSGDGGGDPFVSSPQPAVHHRYSAFDQDLFAAGPGSSPRQAKRALEAHLAETDRRLDEAGKLGTALVSQRKALAEQLSEVDKLQAEGELGPELRTKLVEIEKEYNDLARESARAFLPKQRVPSNEAPGSPFLPEGRGGRRSVSPSKFESHGSGSPTKLTVPNRKIRNQPSNRVHDIEFAAEISTSLIAQVRNLQALLAEREEEVKELKSNNSALEIESENLQQRLTALDESEHKYKEANWELETRIQDLNAVHREQTEREKKLTQSLETSTAEKASAQKELDEVKLAHTKLTEEHASIVKHHDIELGTAKRNLVMADGERSAMQRKIDDLTNQNTELAKAFSTQRGRSQARDPASGMSDEDFETATDNITPEHSPPPSPIKGTPRHSILETETMKTSLHHAQRTIQSQRGQIHREKTEKLELRRIIQDLRDDLDRVKNDAGGAGANRRSRKVDSKEFKKGKGMLGSFRSSRQEILEDDPEWEDHQGLSPRTSSANVSPISRQAGDPSFPTDSSDHFDTANEASESAFESAFETANERGTETEDFQTVNEEMPDSDGAETETEITSRGFGRMRRPPSLPAGLAKAGNRNSFHSTASTSADEEDLPELKTPTTAMSSQRSRTRLSRGPFSRSSRQFSEEPQLPSSPASFATSTGGTPKAAGQSLFAELQDLGSDDESLGANTPSRRSLRSVTPGSIRRTMSPPPAVPDLPKVVMVDSGTMTDEVRIESPLPEIVAPAGLDVDEADRPRTMQSVVDNRASMLSVASDATISRPLSTSSYSDAGAQHDAEMEEKIAMFPVPPTTPPKIDPPTALELTMAAIHGEMIDPIEERKEPPTPPTLSFTPLLTELVEPVEEVREMPAPPTLSFTPLLAELVEPIEEKRELPEPPVLSFTPLHAERVEPGANPTMPAPALTLSSILGETGVPPSSVEVPPPQLSMVDVMSESVEPVVEPELEALPIPVPIPAPVPRAEPEMPDLVISSIGSENVEPKEGPEVARAHDALGFSGLLMEHVQPIKEADTTRAHDPLVYSSLSMEHVQPIKDAEIARSHDPLAYSSLSTQGIEPIAPAELPIPTFAFSSLAAENVVPVIEEPPLPAPLALSPITSEHVAPWALSKDSLSPVFGFSALDTIETRPISPRSPRRDGFILPRDADSPKSIKPETPNNKGIGLLGWGKKTDSSPVIAEDETRQSPSDTPETQTPESQRPFKEISSNSNARPQRKAAASMLDQGAQTSLTADAIDKLFLVGSRPSLGHEKKLSTGSIGSMGSAGTVRINRPQENLGSPLRNKARMVDDAASDTSSLKRPGSAASGRNSVQDAPPLPPNHRELIEAARTGSSSGGPGSMGPPLWPASAMKNRPRTPSAQSRPMSSQSARGTPTPRAARTGSLTGPGPADMQHPRLGARSRQSSVSSFTSEIETRFNMRAGEMAMDANGFGPNTDPRMIQAITQTMIGEYLWKYTRKTGRGEMSEKRHRRYFWVHPYTRALHWSDDDPSASGRNEVKSKSVPIEAVRVVTDDNPMPPGLHRKSLIVVAPGRTIKFTCQTGQRHETWFNALSYLLLRTNEGQAEADEMATGITSEDVDEFNPQFGQRPANGTRPRAPPSLSSYNSRTTHNESPGPDVMEIPTLTPSGSRRGATTPQQRPSIGTLGRISGYWKSSGPKLSGTFNSFRGRAPSAQNTSIYEASEVHDSAEDLREMIERQDRESDRLENVRACCDGRHDVGGLHQPHLTKRSRTSSTHAHPTPTTTPMASFRSRN

SEQ ID NO: 3098 - protein, 510 aa, Unknown
  Kingdom: Fungi, Phylum: Ascomycota
MASTFAPDPSLQGFRPPMSHVDGSPISPEAQEIFEIRRGVAAMNAAFDWTGPDDPDNPRNFNRSWRFFITASVTLLAFVATTAGAIYAPAQEAVEKEFDCSEIVAVLPLSMYNWGLAFGPLVGAPLSEAYGRKAVFLYATPIFICFQLGGGFSKNIQTFIICRFFSGMFGSPLISNASATILDLTSGSYRGVALGIYYSLPSFGAVLGPLIGGFVVANNDWRWTQWVAVILTAALYIPICFIRETYKKVVIQRRAIRLGLQDSSSQRTSPGRAFRYFVTVLIQRPLHMLFTEPIVTLISFYNAFILSLFYTFVVSVPWIFRTYYGFGQTAETLSFLGLNIGAILVPIPMVLIDLRLYQKKLRQWRSTHAEEEPLPPENRLFSSLAGSFILPAGMFIVAWTAENRVHWAVPIFFQGVVMLSSMLVYAGATLYVLDAYGPLYGASASGALQLSRYMLSAAFPLFALRMFQTLGVGWALSLLGFITLIMAPIPWLFWYYGPQIRARSRYETSL

SEQ ID NO: 3099 - protein, 251 aa, Unknown
  Kingdom: Fungi, Phylum: Ascomycota
MATAVDHAVHSPPGPDAQRPKGILKNSYQKSPPTAPRRERSMSGKEITIENTQINAGERRSSSAARSASRRQSAHNSSDPHESSQRLKWDEANLYLTEQERTSTMKIDEPKTPYAKHYDPAEDPSDEEDNDIAVEGHSPRDKAPRSRTEDDIPGLSLGEPEEDIPEAPARSPGEKTVHVDEDSVGHTSDPDLAGLSAEEREKHRKFEEMRKKHYEMRNVAQLLGHPEDNLEDDDDEQQAVPPMPKLPNGSS

SEQ ID NO: 3100 - protein, 171 aa, Unknown
  Kingdom: Fungi, Phylum: Ascomycota
MDSLINMWFTPYSPPHPSTTPTPTHPLPTPPTTPSNQQDHAKFAVNKLLLRSHIALLYSPHSNSATQALSYADRARDLAVQHDLFRHRGKAQWFRGQALMRMERWREAYEAFVGSARVVEGGWREVGELRERMRVCRREVEVERDEEMGKRVEENEGKMKRRVRKGVRFEV

SEQ ID NO: 3101 - protein, 397 aa, Unknown
  Kingdom: Fungi, Phylum: Ascomycota
MADLKIDDFSPARRPSPSFQDVEKAGFRPRSAAASPLPARRPALDSLPESVTKITNNAPMSILAYCLSSISMTIVNKYVVSGQFWNLTFFYLTVQAVVCIVAIMACKYLGIISHLAPFDKNRARQWFPVSMLLVTMIYTGTKALQYLAVPVFTIFKNLTIIAIAYGEVLWFGGSVSPLTLLSFGLMVFSSIIAAWADIQSAAAGHFDHPDTSAALSHLNAGYAWMGLNIFCSAFYALSMRKVIKKMNFKDFDTMFYNNLLTIPVLLFFSLITEDWSSENFVKNFPIDDRNRKIMGMVYSGLAASFISYCSAWCIRVTSSTTYSMVGALNKLPIAIAGLIFFAAPITFGSVSAIFIGFVAGLVYAVAKVKSSSSASSGLPFTRPTMSASAKSAQDANS

SEQ ID NO: 3102 - protein, 144 aa, Unknown
  Kingdom: Fungi, Phylum: Ascomycota
MFMSTPIVTALAAFAPLAAADFHIGHTRNIVCGPQPVPCVTPGGIQIVPSNDWDSAYRLPNLVGNIDTYGAGVDSHINACGYTDVTITDTQGDQDQKDAFMGNLRGDAGQIIGECYWSDNQSSSKDGMSFVDKIICYSDMCGRS

SEQ ID NO: 3103 - protein, 616 aa, Unknown
  Kingdom: Fungi, Phylum: Ascomycota
MSADLFAEFNELSKSPAPESHPSLDHTPSQNQIQTTNNSQDPSGSLQKNSSGSYGGSQTGQQWSSFADPPPSSALGAWGDSSFSSAPQASTTSTAAVDDDDDWGDFETSGPAVSQLSQPQQPPQRQLPTSTIQWQSSAAVTASQEPLQPGLVRASTLDLMTNSLIHTEDVARPAPAPSIGEERHPAPSRPRLKQQPSDPNVLFDAGDFELEGGGDDYDDEDEDDDFGDFETVAPVSSRAAAPPGPAAKPTPPSLDLLDLSLDDSAATSNAVASKSSSVQASAPGLLNLNFGATVGDYPMAPKSPSFQKRNPFPELAVKTPIATEFEKKDTLRSASPVTAWPSFEAPEPANQGKYQDDEDWGAWDDISSATNKASPKVSTSNAAESWDWDAVDHVQSPPAKTADDEAPPVNVPPPSVILSIFPDLLGSANQLFKPLAGQSASIKARISSDPRTLDFLEGYILLATTAAHVIAGRKQRWHRDKILAKSMSISAAGSKGMKLAGVDKTQSAREDREAADVVAVWRDNVGRLRSAVAAAKAAGKVNLKVPELNETMPIQTAKQAPTAPKACVICGLKRDERVGKVDHEVEDSFGEWWVEHWGHRACKSFWIEHEQKLRQR

SEQ ID NO: 3104 - protein, 903 aa, Unknown
  Kingdom: Fungi, Phylum: Ascomycota
MESPPCHVVYVNRKVGQDRLIAVAPSTDTIVSSHSSTDWTPEQVRETVQPLLDTFGDVHVCQSGASCITKLFELQEGSELDIKPTLVLLDTPNDSTTVDSSSRLSSSTPADPSPTEIHAPDEDVYGMSLLQKLITEAHLRGVSKLVVPVPIIAPIDSLPAAPAEHMTDGAGERAGAPLGFMPATRQLVKRCLDLGAADVILSPLSAKCVTSLEICAYRAHRDAAREQQAILEVRRGRKRSWVGVNEEKPFAYLREAMVSGLMSGICRLSADDESQLISAHIAVSSERQTVIADAVGPWHFDAHVFTDDELVVAAMFMFKHALAVPELESWRIPTDQLISFLVACRAAYNSFVPYHNFRHVIDVLQATFSFLVHVGALPPYPATTTTSSTTPRSPLATLIGPFEALTLLVTAIGHDVGHPGVNNGFLITLNAPLAQLYNDRSVLESFHCAAYSQILRRYWPTVFVDKQMRGLMISSILATDMGLHFDYMKKMGDLQDKLHENNSTDGWTGRQTEEYKALACALLIKCADISNVAREHDTALKWMHILSEEFSRQASMEDELKIQSSLLAPPKKDGASLFRSQLSFMNMFAIPLFQGVADVMPGMQYTVDELEINREIFQNKISEDREKAELQSKNDPVRKRLLHEGTFSPRTMSFAAGASLEDKDKDSSEQDGERFQALAKLTESLRETPTMESSEEILPEQMDKRDSQLSPPRSTPTMKPSHVPSTNDDDYKEVNGAVSPFDAVRELANSDPFRAKHESGESSMDNARSPHTGPRRSGTTEGSASGQTGDWASQATSITTGKMPLSPSTQGTSLVSSESVERQGSSLLGVRMAPSVQNSSSNTTMKKESSHTDGDSNSTASIGKADGKALKKKPSRFRMKDFPFFRKHHKSSSPSASAADAAS

SEQ ID NO: 3105 - protein, 392 aa, Unknown
  Kingdom: Fungi, Phylum: Ascomycota
MAPKPQGQGEMTFQADVGPGDVTGVYYITICNLPFETSWQQLKDWLRPHCEVDHIEVFKTSTSGWVRLRGERNFDKAWRCLDGGVFHGRSIIASDKNRSEAIKIKELLNFGSSSSRERQRSDNGHLTQPVSPTLYGSPAVANKPGQNSERLHAQCCTGGVPQACVPMVSAAIVDYTTVPQYVMPSADLTAFARTQAAAAAAALRPAFQIQYRCNSVANLPTTAQTSSLQRAIAAATEGESSTSASVHEGSLDRCKILLKNLPHRSVAKDIDIWTRRRLGGSEKGLNGVDVPIDDSGVYTRGHAVLRLNSLVDPGWVVKKLHQHTFRGRTVSASKLTDEAAYAKGKYTTSSGDQRGGCEDSSDTSSGSGPSRPRSNGPLVVEGSSHKATGRRR

SEQ ID NO: 3106 - protein, 568 aa, Unknown
  Kingdom: Fungi, Phylum: Ascomycota
MPLGILESRYEHVPGTTRYFDDPLRPQIATEENSNGLKCDTSGKQPIILIPQPSDDPNDPLNWPLWRRDLITFTLCFAGILATSLGSILAANTITISLLFGRNFTDVALLTGYYLLGAGAAAIFFVPSGRVWGKRHLFLIGICICIASSAWAGSVGTNYNSLLGARVVQGVGTAPFESLLVAAVGDLYHVHQRGVRMAFTNLAVFGGAFFTPIVVGKITNTMGWKWTFFLVAIFMAPTLVAVFLFCPEPAYRREARLNTDSLAEEPKVVAGPASDQSNSPPMQADKPRGIRCAGVLVLPTSGAPQPIGNSMTPKKTFIESLSLFDGRKTDDRYWVLLLRPFPLLLNPAFVWGCLVQGTMIGWTVFIGVIIAAIFIGPPYYWGEVKAGYTYTGAFVGALAGFAVAGLLADSSVKWMTRRNNGIFEPEFRILLVIPMFIIGQIGLYGFGLTAGDVIAGEYSYYVPLIFFGFEVAGMVIGTVASSLYIVDAYRDLTIEAFTVMIIFKNFFSFALTFYAYDWIIEGGVRPTLLAISSIQVVVCLSSIPMYIFGKRCRAFYHRHDLLEMTKLR

SEQ ID NO: 3107 - protein, 373 aa, Unknown
  Kingdom: Fungi, Phylum: Ascomycota
MSLSLICDQQSDETEGESLFKHDFDEDKCRNVLVRHCAHIPRNYQYRDGIRLVFLVLRDHLGDEHLGKAGGVLYEMIEVDCHHSDDPGAAFQRWRHDHMHRHANLELPHIPHLTTISTSITPTPTLTEWRMRHPERYHIRLSDHSVGHVRSPSSPLRHRKSWTIDYTTYVSSRDGGTWPMRRLKPQEFHEMHWSPESPQRGRFVKERSVDLRDISFSSLGDAALDAGLLELPQSSETSKKTFRPRSLSEVVIRVFGKVKSHGKRSSKTSAELVTDLQDLQMNSSVRHLIEPRHQPQFSEWEIPNAAFARKFGLLKDGHSLPTSIRELPVAEDKAIVKAEVPAVPDLRLSLGFQGPFTPQLWFDGGLDYRYQRE

SEQ ID NO: 3108 - protein, 662 aa, Unknown
  Kingdom: Fungi, Phylum: Ascomycota
MAANDRFQRHVAFDNVPIGEPTKNNMPSLTLNVRHKGYQARRRSRTFMVGVDENAYSDYALQWLLRELVDDGDEVICVRVMEREARLTDKHYIDEAQDIMKSIISKNEGSRALSFTLEYAVGKLHATFQKLIHMYEPAMLIVGTRGRSLGGLQGLMNTRNSFSKYCLQYSPVPVVVVRPDEKRIKKKTKRANDMTRQTYVGMLQATHGKHEADSEASSTYELEIANSPDEEAHQVAKVLGLPARFDPTIKPISHSTIGRARSPGPSSTLPSPEGTPEATRVVKAPASNAGDSDDGDSDDDEAEFEVITGETMLEQQQKAEQLHKMEAGEAAALKMRMDDSSDDDEETASHSEVQGAGSEPECLARASPKFTTDERELLRIMVDVRPTAIKVFTMSHADDEGAAGDKGPVEESQHTTTSSPPPHVDIDAIEPAPPIAEEAAPSSPHVDIDAIEPAPPIAEEAAKELNGQMSGGTTSAANDSGPSRGEHSSRPDVTRLSRPRAGIFRPSPTTTDTTMADPMTADRTLNRSVGWAPGVLNQGTPSSMIAEFASREEIERSNAQRPRGPPRAPQGHDIHVPRPSRLEVFRQNLSELQKASRPQVQEVSGPEAQELSDTQVPESSVTQTHDNSPRPSPVRRFARWIKRQAQKPAYSWLFKVCRRRRE

SEQ ID NO: 3109 - protein, 592 aa, Unknown
  Kingdom: Fungi, Phylum: Ascomycota
MSSRRREPHVEDSWRIVEGENDSFDTSIVPTSTSDSSDIFLTQQSSSGFPSQQHGAPLGAGSQDSIRDFATHQEDEQVILREPFRPSLPPTPGTGSLRGSEPQFRMPLIDVDGGRDNRSSRNTRSTRTTGRDDGVRRRTGKVPQGSTVPRNRRHGSDDDYFHGHDGAARADKSVRERLFDSLPTALYNILAWSFSVIGLAFRYAQKPLAVMLAIYLSFGSLMIAQNLLTKSLSASLSPLCRIPFASSVLHLPFCPDTSNPFWSSGNGSGPSVEFDDLMGVQSQFEQVLEKSAEGVSLPLEMKKSETSIRDLRTLVRNSQIQGREELVLEFDEYIDIARMTASDLQKFNTHVGGAVDSVISINRWTSRYIDSLDPSDASTAKTSPSTMSNIASWLFYPFTPAIQPFDESLLLEKYIEHTSHISSRIDTLILEAQAVLRLLSKAENHLDLIYDITSRNSDSLSNKREQVLWNLWTLVGANNARLADLSAQLRLLRTVDFQRSTAVAQVSALILELEAIQAGLGDLRERVAEPSLLEGADGPAGKIPLSVHIETIDRGVERLEAARRRIRAAEDDRVREALAKGGLKDEPLLEGR

SEQ ID NO: 3110 - protein, 582 aa, Unknown
  Kingdom: Fungi, Phylum: Ascomycota
MSTVADDLLNDFGSSGDEAEDQEHDGLAQTEDAPVDRDANAMDVDGEQDDDEEGQNGVADLEDAEATKAKVEKMQLGAVKDVRSVASLMQTLEPILEKIKHFQSQPSGQKNVGNIEDHPEYHLLTQSNSLSTQIDGEVALVHKFVRDHYSTRFPELERLVTTPLEYAKVVTIMGNGPMDSETIKAMQTSTNNPLGMGLKSVLDGPSLMIVTVEATTSKGHEMSPEELSRVISACEMVISLHKAKQILTEYVQSRMNIFAPNLTTLIGSLTAAQLLNAAGGLTGLSKTPACNLPSWGSKKRQAGLATNIGVRQQGYLYNSEIIRGIPNDLKKQALRIVAAKLVLAARVDRIHSSPDGSTGEDLKAACLERLEKLTEPPPNKGQRALPVPDDKPARKRGGRRARKAKEAVAMTQLRKEQNRMAFGKEEKEVGFGTGSGTVGMGMIGQNNDGRIRGTQVDQRTRAKLSAKSKGWGTPASGQASSIGGFGQTPGGVDLRGKGLRSSGVGTSINGASTGTASSLAFTPVQGLELVDPKKQAELSRKRKVEEDRWFKGGTFTQAGGSGGGDGVFKVPELPTTKRVKKE

SEQ ID NO: 3111 - protein, 777 aa, Unknown
  Kingdom: Fungi, Phylum: Ascomycota
MPSAAARQAYEDQIPPFMTVFDLDAETMADQDTVTVVDPKMVDLAAKSPELANPSQQTTLRSHALLTDPATHKHTDSTSTQASESADSSPTTTFSTTDSSPLTEPSPSSSPDSPVHLIPLSNYPATMFGTMGNPVLTTSAMASNPSEVNPVLRPMTSPSPRKPRNLKGLSLQPAFGTSAAAPMPLMEPASPSFIKPQIPAMKRKPSQLSLKTNSSDLLKTTLEVPKSPSMPPILQRRALKHSTSSPHMLSTLKSASFGPPGGMSFPKVLERNENGLSEMLRPMKSSMHTNFEVPIAEEDSPIKPQMANRHDYEPYPEPGNNEDLKSPGYPDGPIAIYGDNVYLYLEPSAEEAARFDVVINVAREVKNPFASLRPEETAFCTGSADASPIPDTAITTASFATAFEFQPSDERWVETPTTPKANPLQRPEYIHMEWDHNTDIAPDLKKLCETIDERTKEGKKVLIHCQQGASRSASLIIAYGLYQNPELSVNDAYYAAQARSRWISPNMKLMYSLQDFQKEISKKRTPLRSGRSPTKHRTTLSADAINLSAKEPQTAPLPSTDKEEEDRETQRSPTRPRGNSTPLRLTVSAESASVPRSFEWRAPVEQTTPPPPMPTLNFVDVPQRPKSGLGRTESGGQVEAWFKPPPTPGFNSHGSFGFQTMSFPSFRTSVSSVQNDEVADSPVLGRLPGAFPTDDEALMSPRAETMTSNPLHECPEVAGMRFVESPPTPVDGLFSPRASMFPRDPLIPFGRPEQVADPRSPPTKGETPIVRSIDDIL

SEQ ID NO: 3112 - protein, 251 aa, Unknown
  Kingdom: Fungi, Phylum: Ascomycota
MGAHNSAFDGFTPFHNQFVSVKSQLDLGVRFLQARTQDKKGHPQMCHSHCWALDEGPLEEYLGKISDWLDDNPDEVVTLLITNIDDLPIEKFDDVFKKTGLKDYAFKPEKRPTKEDWPTLQEIIDVGTRLIVFMDYNMDEKKVPYIMDQFKHFWETPFGVTDDSFPTCKVDRPDKGDPEKLMGIMNHMLNYKVLGVTFPNIDSAIKTNSAKSIDAQVKRCVEEHKLQPNVVLLDWINIGQAFRVAKTMNGL

SEQ ID NO: 3113 - protein, 900 aa, Unknown
  Kingdom: Fungi, Phylum: Ascomycota
MPGRQAHGRSLTTGPPKSKSKPGKASKARSQKNALNAFGIAQDNFATKQKLTPRARQLDAELEGRDGGGADDDDEDDLDEDDEPRRKKPKSSRGPAGGDVEYGSDSEGNEWQLGGLAEDDEDSEIDSDEAFGDSDNEKFQGYSLKNNKSAKRDMEEDEDETEDDSNDDEGETLGAEAIDLATALDQYESESAAGEQEGSEDEDSGSEGSDESEENSEDDDEDGSEVDPDQLAALQGMVSGFGNSKDDDDENVDKSSRQKISLGDLGLSSLDDPHMRKSLKLLKKEDKEKRPGVTKKLDVPLTRREQGRLDRKVAYDKTNETLARWNDTVKENRQADHLVFPLPENAANYGLAMNEIRPLAPTEAANELESTIMGIMEQSGLSLEKEKKERPAEYDEEGNLLTHREAQNLKRKQREENAREAKRQKRIKKIKSKAYHRVHRRERERNEADAAEGEEVDSEAEREAQDRRRALERVGQRHKESKWAKQGARAKRAVWDDEFRTGLSEMARRDEELRRRKEGRSGEVDDDSETSSEGSSGEDSDGALRREIDALEQDSNGEGRSRLDNLKFMRNAAARKRAEELELLKGIRRTLDDEDSAELEEKEIAEVGRRQYGNPSGKTPFAPALDTSSRKAPEDTMPMDEDDVEIKTNTNATPEGTRASWSASAKASKKEPTNAENKDSWTLGAPRRKRKHDESASKSAILDISSSNIRQPHTIMLSNSDDSASDADSEDAPRTSNKPQKTKNGKVSRSELLARAFAGDTAIEEDFAREKAETTREEDDKIVDNTLPGWGSWVGDGVSQKDRARNKGRYVVKQEGVKAKDRKDAKLDRVIMNEKHAKKNSKYLATQLPHMYESKQQYERSLRLPVGPEWVTKQTHHEATQPRVRVKQGIITPMSRPKTS

SEQ ID NO: 3114 - protein, 292 aa, Unknown
  Kingdom: Fungi, Phylum: Ascomycota
MMYKVPNGGYVAATILRAAHMHLEPRGQTDTVSAHWQFVNKTSVGPAILLVEDTKMGRGLSVLHITLYQNHLLPQHPWVTDKSVKAATAYITNGNFDREQGVTLPSGWTSGPASPPPVDLIKLPQGDDPNWTEWTPYIKPLVQSLQNVDLFLPRKGHPLAATHDVWARLANGDRWVQDDLGFVLDIGPPLLVESFRPSKGSDSAYEGGYSHDTHMWYPTIVASLEVKKRLPVDGAEWIRYRVVCKNIKNGRYDAEVLMFDVDGDLVALSHHVAMAVGMERNVKPKAKTEGKL

SEQ ID NO: 3115 - protein, 423 aa, Unknown
  Kingdom: Fungi, Phylum: Ascomycota
MGRLHLPLTLILLSTLTTAIPTSSLFTRQDTDTNICPAAQSACPSSLPTGFCCRTDDRCIALAGNTTVLCCPKENKDDCDRINPITCNLEQQSPEKNPLAPIKTSVFDVELETCGEGTCCPFGFSCEDGKICRMNEDQERKPGEKDEPSSTEPGTSEPTSSTTQPSATDARESESPSSLPSDEDENDGSGEAKSSGPDTTTIIGGVVGGIAALLAIAIILFICARRRASRKLPPSTTNNNSPPHDPSRPPGGHTRNFSFSSGPRGNNISEPIMQQNSYRTDFILKNPATASVASTPQIRNSVHPHISTVRDYDDQNPFRSPNPSHRDSIVSTDDRPSSRSSRLAPIRGMRGPRTPRQQDSRESINVFADPGTVERQQQHSNRYSMGTTVSGLMIGLRGDPEPASQPNYSGSNRLNVPGTTPRI

SEQ ID NO: 3116 - protein, 263 aa, Unknown
  Kingdom: Fungi, Phylum: Ascomycota
MDIDDILREVDPSSRHLPLETRDLQALTRLWVAERSAPELLEWPQDGLFERVNDRIKAQIETVETLTGDMDPKTNFSLIVIQTELERFKFLVRSYLRARISKIDKHTLHYLSSPDLRSRLSSTELAYATRHQALLHNHYLSSFLGSLPQGLQNLNDTAGNVSMIDAPDLDTAVFVRMLRSKDVFGRGTDADNTLPSSIGDVLIMRWSSAKDLVDDGSAELQEPIADFGRGLEALKASGRVIAGAREKWWTTRQSARDPRRPSK

SEQ ID NO: 3117 - protein, 569 aa, Unknown
  Kingdom: Fungi, Phylum: Ascomycota
MMLNRFPIRPLGLSRRWYSVRCSALSTNPATKGKTLADLKGWIPDTSETEIQVYGHVRSRKKLGQLAFVNITDGSSMRPLQMVVPRSLTGGLSPGSAVCMKGTWHVNSGETASPAHDDLSTGAAQISAATATGEDGSALPEASKGPDDSTRPHPIPGETASGSDLEAGNQESGELRVSHVEVLGPCNAQTYPIQNKYQSPESLRQIPHLRPRMPLQSTTLRLRSDATAILTDYFYKRSFQQCHPPLITSSDCEGAGEAFSVKAETDPDFFKGTKYLTVSSQLHLEAFSQALGNVWTLSPTFRAEQSDTSRHLSEFYMLEAEMSFVTDMNDVMDLVQDMLRSLALGLRQRSACTELTENRETARDPIERLSFQDLVDSEQLQRRWNGLVSPTQWPRLTYTEAVEVLQSSGRQFEHTPAWGRGLQSEHEKYLAEKVGYDSSQDAYLPVFITNYPRDIKAFYMLQSENNPAEGPTVDCFDLIVPHVGELAGGSMREHRLAQLEENMTSHGLPLPTRSKPETPLSWYLDLRRWGSPPHGGFGLGYDRLLSYLTGVTNVRDVVPFPRYYGRCDC

SEQ ID NO: 3118 - protein, 563 aa, Unknown
  Kingdom: Fungi, Phylum: Ascomycota
MREFMDYVHTAFYDATSWNRDNTYAALNATSDALLNFQTPRGLRLSLSALASPNFATSYQLGSVGVVDGSISYLFSSVPLNQLVTPQSETVHLPELLRSYRPINQPQRIASDETKLKAGPNPWLLYGRMYLPQSLLEALAVRRITPELQIQFSAVSAQHLKNGGTAVAMAQYDAGKYAGEGLVSSDGGLLGLRGIYNFSGEDGAATPTVPEAAAITSGSTSNGNSNGSGKDDRERIYGRFSAGGEIYYGTLNKSGGMSIGTRFATLPTHRGTPLAATLTLNPLMGNIAASYAVVAGRHCSLATRMEFNVFSYESAWAVGMELWRKPFARPPSDAVVTGFPERSFQAKMEWRLDDPEPTAVIPAKDAEVTTSQSVVGDDADKPEQYAGVLKARLDQNLRIGLLWEGRVKSLLFSLGSGIDLRQVDKPFRTLGLEIQFSSSVFGNNGSPYPYCGRSVVTPGTYLNCKDDPNNGWPTGYSWLNLDARKREEEGGEDADEIQCIASVEPRIFVIGDRWFEVGEMIIRSSNSSLSRHEMDDAQEGRRRLPAELDVLETTWRLLQEDEN

SEQ ID NO: 3119 - protein, 611 aa, Unknown
  Kingdom: Fungi, Phylum: Ascomycota
MDAVLRQSKAVCPFLKKASPATLRALSTTARPQASPCGGTMSKLQLYAHRCPVMGKALAVQSSKHGAAAAIRALSTQSKAKIHTSANKEARAVDGPVFDRRDKAHAYANPPPSARRPAPASAQAHPVTSAGKFNYEQFYNNELDKKHKDKSYRYFNNINRLAKEFPRAHMANAEDKVTVWCANDYLGMGRNPVVLQKMHETLDEYGAGAGGTRNISGHNKHAVELEATLAKLHATDSALVFSSCYVANDATLATLGSKMPDCVILSDSLNHASMIQGIRHSGTKKVVFKHNDVEDLEAKLAALPLHVPKIIAFESVYSMCGSIGPIEAICDLADKYGAITFLDEVHAVGMYGPHGAGVAEHLDWEAHKEGMPRGTVMDRIDIFTGTLGKAYGCVGGYIAGSSKLVDMVRSLAPGFIFTTSLPPATMAGAKASIEYQMEYEGDRRLQQLHTRAVKEELKQRDIPVIPNPSHIIPLLVGNAEVAKAASDMLLQDYNIYVQSINYPTVPVGQERLRITPTPGHTKEYRDELVAALEEVWTRLEIKRTSEWAAEGGFIGVGEKDNVQEPLWTDRQLGVEQASRDILASGRAPAGNLTETLLAQEAGHSRAVAGAV

SEQ ID NO: 3120 - protein, 377 aa, Unknown
  Kingdom: Fungi, Phylum: Ascomycota
MELPSLIAALAAFLPLAYGAPVEHAETTLGPLILSALERDLGLSASQATARFDFENEAGNVVKELRTALGDSFAGAWVEDGKVINVAVSDEAAASKVKEAGATPKIVKTDLAKLQKAKKDLDEQFKGVQATSRGSGKSGIALYYVDVVTGKLVIQALPEAVDEAENLAESVGLSDSEFKVEEVDELFKVAELRGGGGYAINFNTACSVGFNVAGGFVSAGHCGTAGSTITYLDGVPVGTMQRSNFPGQDMSYVSTLPSVQGPGYVGAYGVVADVAVRGSNSAPVGSGVCRSGITTGWRCGAIQAYDVTVNYSQGQVFGLVLSSACAQPGDSGGSFISGNQAQGVTSGAGGDCAGGGNTVYQPLPPILSNYGLSLTLG

SEQ ID NO: 3121 - protein, 248 aa, Unknown
  Kingdom: Fungi, Phylum: Ascomycota
MIKGALHAIRHVSCVTQRPAKSMERINDPKQPSAVATQGELFSGLASCRQQQKHQPTAALRWPQLPLISHAYPGNHRLPSCLATRQCEPAHLHFNLLHLHKILDFTWPPLSPLRLPSTQSYKLLKSHYLQSVNMAENGATIPQEATNTETFTEEKGKGKAAAEDQPQAMAEDDDDDSSDDEEDEKEEPAVEEDGMEEIDLNNIVDGGRRTRGAVIDFAKAAEENPAEDDDEEDDDDFKPADEDTAMSG

SEQ ID NO: 3122 - protein, 669 aa, Unknown
  Kingdom: Fungi, Phylum: Ascomycota
MADIEDYLQEGWNPNSVTIPKLRSILVTHNVDYPSTAKKAQLVQLVTDEVLPQAARLRAQRARAHRTSFGIVNAGSAEDDSRWADEPPTPARRSKTPRKSSARVKVEEEEPALSAARPTSKRASRSVSRALSHTDERESVEPEMARGSRRSSRRTVTPQIKAESEEEASEGDGNPFSDDNPFQSGSSPPTGKTPISRRRTGGEEIFQSSRSARRRTDVYTEPSSSRKSFGHIAREERSESPEDELEPGEEFTPDEQLELEVAASKGESSALARQPRRQQSRKTSLTLPIFVLLTALMGAYATWYRQEKLAVGYCGVGRPVQPLIPSDVPVPDVLVPLFEPQCEPCPSHAYCYADMSVRCESDFVLQPHPLSLGGLVPLPPTCEPDGEKVRRVQAVADKAVEELRERRAKFECGDLVDEEGHQAESPAIDEEELKASVSQKRSKRLNSDEFEELWAAAIGEVTKREEIEVIETPERSGSTGSEGRQLSSTSLARLPLTCAAKRSVRLGLARYRLPIGLLILSGLFGIYMRFRYRQHVALSAQVPALVDLVLGRLSNQKVLGEEDVDDPWLFLPNLRDDVLRSVHSLSERDRIWQKVKAVVELNSNVRTSQREGRSGEVGRAWEWIGPVAGDGVRRRKSGRVSWGADVKSESPVPEGPREVKKWDEPRPVY

SEQ ID NO: 3123 - protein, 360 aa, Unknown
  Kingdom: Fungi, Phylum: Ascomycota
MAFSFGFAGDDIDMDPSTATAPVAPKPSSAPAFPVAGKPQLPPTYHDLSALLATLPSKMAYDYLDVELDDSTSLKLPRRELWDVRVQLMAEDDGEGGEGDATEGLGTHDVKTGVYEGGFKSWESSVDLVKTLAADTALFAQEQTQPLRVIELGCGTALPSLALFHWATQAVQTPNKRPCTFIVADYNPTVLQLVTLPNFLLSWALTHSETDVLKDAFSIEGEVELGPEVLQAFQAFLQDHAIDLKFLSGGWSPEFCQLIEEASPLTTERRSLVLGAETIYSPFALHAFTETIFSILEQEKTRQTSTSAATAIIGAKRLYFGVGGSLDDFVAAVQERGARVTSLRDETEGVRRGVVSCMLG

SEQ ID NO: 3124 - protein, 241 aa, Unknown
  Kingdom: Fungi, Phylum: Ascomycota
MASKALIPRFLLPLRGPLWRGVHIPLSQNTVCVRFASTKDKPIVLEKPLKFNPPSHGSRLKRNATPKHYGPILTSTERGQQDKKHYPGMMAPQGSWSHWIWHSRIFHTCITLGTLFCLGIFTFFMNYAFNSPYKALVPPISDLWNRPTYFFVAWKEVITLHEKDKAQKAIDHRNASLDDHAKRQYFMKMHGIEAKDPVTMIFGKGKDDPVDVVEGEDSNSPTAAVVEQPEPEQKKKRFGIF

SEQ ID NO: 3125 - protein, 1208 aa, Unknown
  Kingdom: Fungi, Phylum: Ascomycota
MQQDPTAYSTQQSQTGSHATTSPDHDNGLLSRDASVRGGSGNPASDAGTPRSRSRGSAKADGTRTPSIARDLSDEGRPVKQRLGQRITDYERALSRASRMPQQPLGFRIVKRADGTTDPDGARLMDLPNEVLTRIVTQLRPDARIAASMVCKRLREVVMTPYAWQLAFVQHFPGVSTPQPKEAKQEGVWKGASDVQMSYEQPSSFARITPQATWRSEFLLRSELMQGLSLGKPGIGKESGPGYYYKKARKAQGTLIYFPRRSPTILTHLHVLYGKDTASRAIHGSRQGGFASISDPSTGRVDRWGDEDDWDHLLLPDSSDEELYGMEGRGILHVPNPLDVSAAYGRVGGLGVPGGRAFFLGTHANTQRVSNRLTKYLEGGYLHNDERPDLPDVFDIGDAISCVWLAKSSEVPATTRSMVGILTGTTTGVVTAYALASEGSPNKLVVNGCISARWVLSPGIPIVAFQIDEQYSVRRRRQGRVWAVALNALGEVFYLDAPPRESLQNCSDKPQAQLTVNAWEAGRSAPWQLLENTRRSRKDGVEVQDHELRFGQSAAQINTMGPEDLKHAAEEVNRLCRLPFWHFRETYAGWDMKRRLEVDFSSDDGSGAGELIFVVDSGAASSGPAKVQRFTRSLVNQLADTPPVLAQSGNSARSGGASIFGRIPSELTMSPSSSGTSSPMPKDMVRANGLPHAWTVEEMSLAGHQVEEITASTLDNSTTSVMTLSEDPLLNGVRQDTTDEARSPLRAIPGGRARNLVVGTSAGAVLIWNSRAQASQGQAVQPLRVIQTTSKEITAVAATALYIVHGGSDGLAQAWDPLASTLEPLHTIHSKNSIQPTRHTHPGGRRLTREDMNTVRAISVDPNPLLLRGCLTCGPGIHSWSFRSQDNVVKRKRRMRNIHGRPTNHRTGTEIVDYIAGEEAEVRREQKERAAEFERLHRNFGLGELTEEEAIVYAQMLSQEAAEEERLRDQQLLLLQSESDAELARLSRRLSNDDQISDDSASVDTGYLTSSDVTSSHDPLDQGLISQSPHSSYIVSISDDRGFQGMYSPGGERSTDYPIMVKAKQGKQRRGKKNTRQGSSSASSASGEAAGSSAAASAYPRYGHNATASTGSEGDFSISGLSADEQLALALRLSAVQEEGENMARSGSAVNADENEFPTLISRDMPGKGKGKSATAVPASWDESLATPSGLTEDEELALALEASMQNQ

SEQ ID NO: 3126 - protein, 1820 aa, Unknown
  Kingdom: Fungi, Phylum: Ascomycota
MSAASIAIHANDLLYRLEKAMAKSDNIGLIFIAHGLGGAIVKKALRVRDLATNCSRVRDATTGVVFLGTPHTDTNSDALLQVVKNNVQLLRHDFHVVEDEDIRHFASALATINSTFINTKPTALQTISFWEEEPSTWTSAGGDECSKLVAPKSSRKENLWNNIDITMSCGYRDLPNFCDVFDPRFTSFASDFSALVSRVLKHKTVTIKTPKVTSLAESPTRRGTRSTKRGRRTRSGRAASVATSHSSDSEDDNFVSWQKRKQYEEDRTHLDSFLQSFHGWTHENTGHDVFVLTGTCDWISTSQALSTWIDYTMYGTFFWLAAPGSGKTHRSKALAAHIAKKCPNDVVLTYYCLKNESTPHIWEYFTWSLLQARPSYFSSVPKIYQNRDKSSPRLGFGDFIDLWTGIRLCEGEGDMKDTVWLIIDGLESCGDAVFLSFWKALEQLRKRQIDTSKSSSYLKVLFAGTLTPAMAAVAGGVSRYLVSPEVIKDDISTYVDVRLNKCIHNSTLLDIESNVETVRAEIKELSEDYWPFARDAVSEVELVMARDANKIASFRGRLPSRLEKHVRQTVLTLRQSIGPQRYLYPLLYILLANHPASELTELNVYQLKDALSSLYDAEEIRKIDLEGLIRDHLGGLLAWTAPGSLRFRHAGFATFLGRDVPDSQLNADLAFICLTYLLQEKFGAMPSPEQLKNPLGWLKEVHPFYSFAVCNCQDLVARSGGGDDRLSTLFLRFFLERPPQWKVSREWLKWCSGFNPREERFHDLAIDPFIWDERLLPVLERLCPPPTDSGRLSPIQLVKASWAALRWPQGTKTPQYSLPSGWLSNRGGSWHTPLLGAAKEGNVDMVRYILKWHPNVNERGGLNMRSILMMLYCSTSCGTPEERPTRLTRITEELYQHGVNLNLGDAEGCCPLHVACDQDSLPLVRTLLDHGASIDISDVKGYTAWQTACERGVIDVLREFVDRGVDADSLFDTGETALTYMAHRGQLEQLRTVIRAANLNAVDRKGVAPIHRAVLATQNRYELVAFLVSQPDIDLDILQDRVYGDGGVSALDLAVQQKDRRAVELLLRAGAAAGHLPGRKCVPLLMAVENKSLDIVELLLRHRAPVNAFNYPQKQTALTMAASSCNVEMMRLLLDYGADPTVYDGLKLSNAAYTVLDSDTPDIEALQMLLKCAHPPTLTEERDPEKPIEYAYSNTFIRACRIKDTKFVEALLEGGIELSTWLELPKTCSPVHAAVWAGNIDVCRLLLDKEPRYLDFICCWNNVMHSPLHDACVYGQPEMAKFLLERGADVKLRTPVRQQTPLLLACAHGDAELIKIILAADPSLADVCCYAGMSPLHEASLHGHVKTVEALLKAGASPSTFHNGREGSISRALLTSLGSRAIPLLKLYLQYGLDLNDVSPYWGHTHLSDVIESATPAVVRLMLERGGDPLRTFRLAPSLDQWEHGLSSTWPSHTSEVIDILLAPQRDRLTTLNWMRENALGKFSKGWRPYLARLYWLCEDIHRETSRDVFAELMAEVDVCGLSPVDRALGLKDCRLEFRSELARQTLGYVDLYLQSPSRSLLSGIELLLLEKLAHETPQDLAPILTLAWSIEGVKSLPDERTEVAASALNYLVCCRCYESPFDSFWYCAECAYACCTECAKTEKKCNCSEDKKPKHVEVPLDASATVESPEVQEAFKKLRELLASMMTKQPEDTAGEPGTEIEEPVVIDEKEVPLQTALQLATLHAFDMLAIRRPMGTTFLPLSVRAVNLIAPFESNIAEMRKSRERQALDMEMTTERRIEELNHMSKDMGRSAYVDEQLFRQDMVLAQMTGLFCEEVKS

SEQ ID NO: 3127 - protein, 357 aa, Unknown
  Kingdom: Fungi, Phylum: Ascomycota
MAPPTPTFNLDVEAISGICGSISIACWVVVFSPQIIQNFQRGSADALSIQFIIVWLLGDVFNIIGAVYQGVLPTMIILAIYYTIADIVLLLQCFYYRGFTWKDAPATQPKPSGSAIGEANERTGLLSNNSNNNERRGSADWAGLSPAVPHMSDAPPPAPPTALQTIAWNTTVVVMVCAAGVLGWFLGERATHGKKDGSVPQDDNLTFNVVGQVFGYLCTVAYIASRLPQLILNYRRKTTDGLSMLFFLFACLGNITYVLSIFAYEPHCHAHKGGCAPGESGHIYGRYILVNLSWLAGSLVTLLLDLCVFAQYFIYSRGEEDDDVLNGGHFDTIEEDSGSNDDDERPILQRGDSGSYR

SEQ ID NO: 3128 - protein, 315 aa, Unknown
  Kingdom: Fungi, Phylum: Ascomycota
MRYSNLAVLAAATAVSAQRPEDESICDYYTTALLKNNTAENQATLLTLVVNTAVIGNYTEPNVGIKVAGILAEGEQDGEKVNLLPYFSGGLKSTNRDNKAVAVNFLDGGGAKPLMDNKPADDEKSNQYFLLTHLYQFFGSLLGCSEQGMSGFDAYSADPSMYDVHKFMNLNKAEMDYFITQVGMSAASFGVAESDVKAVGESLNKLFNVRCAPATEVIKGQGAELQSICIAEDCPLAEKATCDKYDKAVEPEEAMTGNSTMTMSGTGTMEATGTQTQATETGTGTGAPGTVETGAAAAKGLSVAALVAGVAAFVL

SEQ ID NO: 3129 - protein, 468 aa, Unknown
  Kingdom: Fungi, Phylum: Ascomycota
MNLLLSDDYLLQDYPENITHTIRSGHATTLRFNRKGDYLASGRVDGRVVIWDLETMGVASKLRGHNKSITFLSWSRCGRYLLSTCQGWKAILWDLQDGSRLREVRFRAPAYMAELHPHNHLQFVAALFEEHPLLVDMTDPVDVKRVLPSAPKRSNTEGGAAYKEKQAKEDAKQMTTSAVWHATGDHILAGTNKGRINIIDTRTLEVIYSEKVCAGVITAMRLTSSGRELLINSQDRIIRTFRMPNLTAEDLDPDTIQIPLEHKFQDVVNRLSWNHVTFSASGEYVSASTYNNHELYVWERNHGSLVCMLKDPKEEQGVIEWHPSRALLAACGIETGRIYIWSVVSPQKWSALAPDFAEVEENVEYIEREDEFDIYGQDEIHRRRLDAEDEDVDVLTDPSRALDDGVAGDAFRMPILFNLGESDSEDEFIAVSTGTMRRRSPGEGQSDMESVAPEKKGAGGKGGRTKKR

SEQ ID NO: 3130 - protein, 362 aa, Unknown
  Kingdom: Fungi, Phylum: Ascomycota
MAGKILNKDELSNNSFFLNKVNDVSFAEIPKPTLQSEHDVLVAVNYTGICGSDVHYYVHGAIGDFVVKDPMVLGHESAGTIVEVGSGVTDLVPGDRVALEPGFPCRRCHDCRAGHYNLCHDMKFAATPPYHGTLTGLWNTPADFCYKLPDNVSLEEGAMIEPLAVAVHITKQASVKPGDSVVVMGAGPVGLLCAAVARAYGASKVISVDIVQSKLDLATSFASTHSYLSQRLPAEENAAALKKSADLGRGADVVIDASGAEPSIQTSLHTVRMGGTYVQGGMGKSDITFPIMQLCMKEVTAKGSFRYGAGDYKLAVELVAQGKVDVKRLISGVVDFKDAESAFNKVKDGEVIKILIKGPNEK

SEQ ID NO: 3131 - protein, 371 aa, Unknown
  Kingdom: Fungi, Phylum: Ascomycota
MKFPSGIVALSALVSQTNAALQQISNWGTNPGGMTLHAYIPNQVASSPAVILALHPCGGSGQQYASSTRYGQLAETYGFIVLYPSSTQDSNCWDVATTKSLTHNGGGQSQGLNTMVNWAKTTYNADSSRIFVTGTSSGCMMTNVMMATYPDVFQAATCYSGVSAGCLAGSPGSSPGSADPTCANGQNQKTGAQWAQIVRNMYPGYTGSYPRLMSFHGLADTFVHWINLGEQMKQWSTIQGVSFNHNNTNTPKQGYTQMVYGDGTKLIGITAQGVGHVVPAIEDEDLKWFGITPGGPGNGGGPSTTATTSRATSTGTTTRTSAAPPTSSSVPPPANCAGLYGQCGGDNWTGAKCCSQGTCKFSNQWYSQCLN

SEQ ID NO: 3132 - protein, 327 aa, Unknown
  Kingdom: Fungi, Phylum: Ascomycota
MGSIPQSTPVADGEDLQMAAYLKSLPAKHLEPLWSQMNAMVPPTPNPTAKAHIWKYEEVLPDLKAAGRMVPEEKAERRVLMLVNPSMESPYTTDTIYGGLQLVDPGEIAPAHRHIAFACRFIIDGDGFTAVEGKKMPLARGDVVVTPIWHWHDHGNESTEPVIWLDMLNLPLFRFAPVHFAEGYSEPRYPSELCDPSEWRHPWGPVEAKLNAQKGDHAVHDYTNSNGTPLSNILTVKAERLNPGAVVESQEQCSYIYHCYEGQGRTEIENPSGQRVTFQWKARDTFAIPTWSKIKHVNESSSEKAYLVACHDGPFLDALGLRRPKAV

SEQ ID NO: 3133 - protein, 1050 aa, Unknown
  Kingdom: Fungi, Phylum: Ascomycota
MAPHASSDGPLVKRQKISTLAQRPKAADNASRIFAPFRTVGLVSPTDVPFTAIPLGKTTYQITTSVGRALQTYDLARGLNLVFVTRPQTPRDITASLAYKKRVYAAWGGSVSGEEQGLWAYERGKKVDSVQLPSDLTQPITQLLIFGSWLIACATTRIEVFKLSTLEHHSTIQTMANTKGGNEISGGIVTMPTILNKIFVGRKDGWVEIWNVKTAKLVYTIVPPSQDCGAVTCLEPTPALSLLAIAYASGALVVKDVLLDKKILEVGAGSPDAPVNFISFRSDGAGAGNDGRKDGVMATATTESGDVTFWDLNAGGRVAGVLRSAHNPPAHDGRTSRGGISKIQFLPGQSVIVTSGRDNSLKTWIFDQTPFSSVPRLLHTRSGHAGSVNCLHFLPSDFDGADAGNKWLLSGGQDRSLWGWSLRRDGQSTELSQGALRKKAKKTGVLSEHSLANGPRSSATALEDLKAPEITCIATSLNRDGGIGALPGKIQQWQKGQQQSKADAELSGSTGWESVVTAHKGDPYARTWFWGRKAAGRWAFSTGDGSNVSTVAISPCGSFALVGSELGSIKMFNLQSGLTRQKFPAPVTPQQAKQIREQLTAATDITTAKPADGRKFWPGTGKHTKAVTGLIVDQMNKNVVSCSRDGTVKFWDFLTGALTDEIDWAPMTAPTLVRYHPGSSLLAFACQAPSGDASVRIVDMETKRTIREFLGGDHSINDLCFSHDGRWIIAASADSVIRIWDLPTSHLIDAIRLEEPCKAVAMSSTGEYLAATLETGLGVMLWTNKSLYKHVPTRQISEKEVATVDGPTLSGEGNQGMLEGAYEEQGDDQEDSNVVAPNIEQLSSDMTTLSLVPKSRWQTLLHLDMIKERNKPTEAPKAPEKAPFFLPSANGSANQAKDEKPVAGTEVDGKSRITTLDNARFEELFATKLRVAAESGNYDEFVEHLKTLSPSSADLELRSLSLGNDDEGSNELLHFIRALTNRLRARKDYELTQVWMTVFIRLHFDTVMARRELLDALKVWKTVQEKECKRLDDLVGYCSGVVGFLRSPRT

SEQ ID NO: 3134 - protein, 411 aa, Unknown
  Kingdom: Fungi, Phylum: Ascomycota
MTTFSISNSYGTFGRIHERKSIDDRRPLSTILNAQDFEDAASENLTEKAWAFFSSAATDCHTHRANNDFFRRIWLRPRIMRDIGSLNTKTTVLGNEMPFPLFASPAAMAKLAHPEGELVIARGTTKAGIAHIISTNASYPLADITAIKKGHPFFLQLYVNKDRSASEKILRNAEACGCKGVFITVDQSHPGKREYDERVKFEDESLMAATPTGAAPKNDSRGSGIGRTMAGFIDCSLSWKDVAWMRKATKMPIVLKGVQTAEDALLAVEYGVDGLLIGNHGGRSLDTSTPSIMILLELRKRCPEIFDRIEIYMDGGVRRGTDIFKALCLGAKAVGMGRHFMYAASYGEEGVSHLIDLMRDEFETTMKLMGCTSLSQLNPGLLNLYDVDHWFSESSSPQRVALSLRPTASKL

SEQ ID NO: 3135 - protein, 377 aa, Unknown
  Kingdom: Fungi, Phylum: Ascomycota
MSLPIDNVDAQTAAMSLDDDAAPSSHEVEPSSGPRNSKGWDGKLRIPKTATLANPEALSDPEYSDDENILDGEEIEPDEDLLDDEDPDTDEIMCAHSRIKSIPSLRLERFQKVVRICLRQNNIQDIEGLAVLASTLEDVDLYDNLIAHIRGLDELTKLTVLDLSFNKIKHIKNIGHMHDLQTLFLVANKISKIEGLEGLTKLTSLELGSNRIREIRNLESLTNLEELWVAKNKITEIEGLGKLSNLRLLSIQSNRITDLSPLQSVPSLEELYISHNALTSLDGLQANSKLRVLDISNNRISSLKGLGPLKTLEELWASYNHIADFADVERELKDKEELTTVYFEGNPLQLRSPALYRNKVRLALPQVSQIDATFVRV

SEQ ID NO: 3136 - protein, 394 aa, Unknown
  Kingdom: Fungi, Phylum: Ascomycota
MSTFGQFLRVTTFGESHCPSVGCIIDNFPPGVPISEEVIQPQVTRRRPGQSAITTPRNEADVVAIQSGVEGGVTLGTPIAMIVKNKDQRPGDYKGDTMKQYPRPSHADFTYLEKYGVRASSGGGRSSARETIGRVAAGALCEHYLKLAHGIEIVAWVSSVGNLHHIPPTTEHPCTSHNPKFLELLAGVTREEVDKTTVRCPDPELAAQMEQYIADLRDGQDSIGGTVTCVIRNVPTGLGEPVFEKLEATLAQGMMSIPATKGFEIGSGFQGTEIRGSKHNDMFIRNPIVDEAIKNGFAKPKLATLTNNSGGIQGGITNGAPIFFRVAFKSPATIGLPQETVTFEGESDGVLEAKGRHDPCVVPRAVPIVESMASICIMDALLQQGGRRQAMLSL

SEQ ID NO: 3137 - protein, 669 aa, Unknown
  Kingdom: Fungi, Phylum: Ascomycota
MTETSSSQPEVSEVNQHTRNVEFYGRSSVAALLSVASRGADDARHRSGNGDDDGQSTAESAGNEDAHGSIVSTLHNPAYSPASNIPGSTSHEQNPTTKENHPDLQNSCGPPFPDYSQCRVFVLNFFSSIHYIHPILNKAEFLKEVTERAGKGVSSSTATTTDSTFDALYFAVLSLGALVGPRDDEPLRGISNVRWSRAFFEEAVRRHIRAGMVTDLNMVQCYFILAKVCQNELNPHLAYMYIGLAVRTALAMGINRQPRSRTTRSPAQMKAETRTWWGLYSLEVEMSFSMGRPDTLGADRYHNRHFPVVELGSNTTSPSSRPDHDAPEPTECAIIRVMVDLSRIMKDISTKIYLSDEINLHTVSLAFRLQSKLDEWVQGVPAAIRPRPNPSDLVSLKFARDPQWMKRQRLVLTLRYLNLRILMFGSLLLPSSSSPNKNSAMVLLESEDAQRGIRICIESARHTIEIIFTMYQHHDFFRTWFYNTTYVSFAASIIVVYVLKLSSRIEPAEVDDLLQVASRAIEVLETMDECIVALKSAKLLRGAMERARRGEENRGLAEPMIRRSSGITPAMSSTRSTRHAVFGDSSSMAVDARAMGAGGCVIDGSGAYQATLDQSANAVSGLSPLTDPGLLLNHYWGPVNFLDMDNAMVMDFCFQFDELNSAHSAAFDM

SEQ ID NO: 3138 - protein, 312 aa, Unknown
  Kingdom: Fungi, Phylum: Ascomycota
MATSHGTSASLAPFLIRDHILNGSSASRLPKLVYGTAWKREATPHLVIKAIQNGFRALDTAAQPKHYEEAFVGDAVRTLDREGFVKRDQLFIQTKFTPLTGQGPIPPYNPNAPLEDQVRQSIQSSLKNFTMDRGEPYLDSLVLHSPLPSPDDTLKVWRVLESYHPTQIRNLGISNTTLPTLQHLHEHATIKPAIVQNRFYTTTHYDADLRKWCRERNMVYQSFWTLQANRTMLSRRPVIALAEKLGIERDEAYFALVLGLGGMTILTGPRTPETMRRDLKGVETVAIWAQGEGREEWDRLVDEFRRIVGDLH

SEQ ID NO: 3139 - protein, 336 aa, Unknown
  Kingdom: Fungi, Phylum: Ascomycota
MKLYGTDSAIEELIVGFDELNPAHVEELYEEPSPLEFMRSVARNTPFVVRGAASNWEATKKWDAEYLRTTLSGQSVRVAVTPHGNADAPTFSPKHDAVVLAKPYEEDKPFDQFLSYVQEQESTSSSHTSNEVWYAQTQNDNLRNEYEDLYADVEKDIAFARIALQRPPDAINLWIGSDKSVTALHKDPMENIYVQIRGMKHFTLLPPLCHPCTNEKLISPATYYRGPNGELSLEIDDGQEPVPLATWNPDEPNKNATRFSHLAKPLKVTLQPGDMLYLPAMWYHKVAQSCEPSGEGFVVAVNYWYDMDFSGPLYPLSSFVRNVGLAGQGATETCQA

SEQ ID NO: 3140 - protein, 378 aa, Unknown
  Kingdom: Fungi, Phylum: Ascomycota
MASSSAETMVKAPKQRGAKSTTPTTAPANETGKQEGHDFFWTYTEEPHRTRRLAIIKAHPEITKLCGPEPLTKYVVAGVVALQIACAWYLRSAPFFSLKFWLVAYVIGATANQNLFLAIHEISHNLAFRSPLANRLFAIFANLPIGVPYSASFRPYHLTHHKSLGVDGLDTDLPTALEAVFLDSILGKAFFCTFQIFFYAVRPMTIYRIQYTWVHHLNIVVQLGFDLSLYLLAGSSIKPILYLLLSSFLAGSLHPLAGHFIAEHYVYESVTPEQRDPKNNIPVPETFSYYGPLNWFTYNVGLHNEHHDFPAVPWTRLPAVREMAKEFYEDLPRHDSWIYVIWKFILDENVGMTCRVKRKEGGRLVGAAADWTDKEVQA

SEQ ID NO: 3141 - protein, 156 aa, Unknown
  Kingdom: Fungi, Phylum: Ascomycota
MEPRARAGKNVGKMNFTHNELAQLLFAHGDVRHPMPETVRVLDEIITDFMQSIAFEATRAANYSGRQKIKYEDFEFAFRKNPAFLGKVQEVFEKQKEIKKARELIKDGEDEIMKEAVDEEEGKKKDKGSSKASRLEEELGEGDDDAEADADIGKKR

SEQ ID NO: 3142 - protein, 439 aa, Unknown
  Kingdom: Fungi, Phylum: Ascomycota
MANQTPAVVMDNGTGFSKLGFAGNDSPSFVFPTAIATKGPTGGAGGSGSGRPAVANKPSFLTGGAGGGGHLGAKRGTEDLDFFIGDEALAASAGPGYGIHYPIRHGQVENWDHMERFWSNSIFKYLRVEPEDHFFLLTEPPLNPPENREATAEIFFESFNCAGMYIAVQAVLALAASWTSSKVSDRSLTGTVIDSGDGVTHVIPVAEGYVIGSSIKSIPIAGRDITYFVQSLLRDRGEPDSSLKTAQEIKESYCYVCPDIVKEFAKYDRDRSRFAKHVVTHPGGRQVSVDIGYERFLAPEIFFNPEIYSSDFLTPIPVVVDNVIQQSPIDVRRGLYKNIVLSGGSTLYKDFGRRLQRDIKQLVDARIRASEVRSGGARSGGLDVQVITHKRQRHGPWFGGSLLGQTPEFRSYCHTKQEYQEYGPSIVRRFSLLGGPGGS

SEQ ID NO: 3143 - protein, 1527 aa, Unknown
  Kingdom: Fungi, Phylum: Ascomycota
MSTRTPIGGQPRPPQRTLSASSLSSIQRPSQQQQHRTLSQQFIPSSPVRRDASADYQMHDATAGGPDSGNPNTPRLVKGSKLRQELSVETGASSGWLPDVSSPLNTATPSRTHVLSDSGDASRHSPAPSRSSILDPDNLPMPMPRRRPRTQPPLHRTQKNDPTPVPLKKDSRPKPYVVEIPSAAPRCPPPHKQDKAPRDPFSKSLYSGFVDFHPWTGKHHEDEWSSEGIQKGIWDRGSQSETSSARVAIYTPLRQQKSGLTALSQLFMTVMNQRRAKGQVTAASTFKPPPRVTLTDTKREVWMKELANPAVSLRRLSRTIPHGIRGRTLLDQCLNKNVPTERAVWLVKCVGANEIRAVKRKGVNGAFIMGGELKWIREWTVLVEAFVESVVSSYTDSDWKAKVVYAIRLATYLYNDQLLERDHYLEWVLTNLESSSQAKIPLWLLVVQNYHHDIMRMRKSGRRLAFVLCMHLNTISNDPDRDIVMQLSDKIAGLLSTLLKLYPESFVNPLNWFKYRHMLRTFFAPAEHNSHASYHHVDARNNKLSTSNTTTAPMGRQQLVAALDAALRDSDHDMLASRCWDTMEDKDEVVRTAIQWATSLHRPGPVKVLVAAKLIRSWTSSLGAAATSQILLELDCIPTSDAVRKELMYHLWLIARGGYHDASEIDRVVGPCGMRLLVELPLDFVSDKWRRERANLLRRAGGFSTTEEQLDTSNALKCVAHALGMPGPPEDPIFQRKPMSVPRLLLRLSKSSRGLRSAVAAYLRDMIVNQASASKEPFLLPMALFSNIRTILESLDEYPMLSEVLLACRQASDVDLLASCVDTINYNLPTLQATDTGDQLLDAYMDRLRMLQAEQPLLARPLLSALALLATRLPKRQTLASELQHQLLQSDRTHPIDACSPVSDNMVTQMHTAESEVSEEIEKLFGSGNIIDQPTMNRLFRTMIPKLDAGWRKLNETRRVFASLLQRLRVYDTKHFDKLMADWISHIRTLKSRPPLSELYPLLVSLGCLPMATLLQTAAATPSGQGDLATPTPDEDIPANATYLQDLLRLLLLDLTAPAVLTAEEAYRFGVHQRSAPLEHSKGLLDLIRNAIAEYAVASGPDLKSPLGEEPLRKQILEVLQSLVIADADAVSNALSIKTLPAAATALVCNLTNSLLKPDNEEGANPSFDEVLGLANELTMPFCQLKLNMDLSMEQPSSPSATDEPQAMSRFDLFAKAMDRAIEADNISWTRMLPCLSNDITLHLKNQAYERFLAMLPSMKSQDVVADAISGERIRMAENLLGVLGVIVSGQPPPNTAQLTQTMVEKLSDLWEIVAARDESLNRAQVIVIESWLPKLLKFITLHSISASEAMPAPSTTASTGKVPPPPAQEARARIIVALCGLLLDLESRPDYTALSTSQHIFDAATSLVDSLPDDLRVQCIKAILFTPGASPSPNLSSDPRLHYLLSNPILSAADGLLLGRRRELPAQPHSSTARLFGNLYGCGPAMLDRFSPFLLKRWELLSEPTPNIGENDTSLSLSLFEAIKIQ

SEQ ID NO: 3144 - protein, 1155 aa, Unknown
  Kingdom: Fungi, Phylum: Ascomycota
MKFGRNLPRNQVPEWASSYINYKGLKKLIKAASQKQKAGEPVDPAEFFFALDRNLEDVDFFYNKKFGDAFRRLTLLRNRYGHDPDVVATLDRDEVEEAMGALLELRSQLRNLQWFGEINRRGFVKITKKLDKKVPGIATQHRYISTKVDPRAFAKDGNTARLLVDINKWLSYLGEAETFDDSTSERSTRSLGRVSNKAMLNLPQAQLDVLDNAVRTDSVEALKNALQEINVQHGSESFQGLLLNLLQRSISGRSKGCIAFLLKNLQDLQESEDINGRNCIHRLVIHIGRVKSAPQHHDASSYPVPVGTQFDHRHPQGTVPNAANRKPDTQVLLGKDDEAIQILMYLLDTLAPRQRTALKARDSFGRLPLHYAAQYGFVVVCQIIMAKMQEWDQFDSKDGIDAPEWHDNDGYAPLHLSVMGGHALATEALLKGENWQGASESKDHIRKTASKSGAVLAMATKSNYKIIVDLLVNAGVDVNWKDGQGECALHVAARFGHNECAAIILRGNGTQKADLEITEKSYAWTPLHVAAVDGQLKIVEMLVEAGADIQKPDSSGWTAREHAALRGHMSIARLLATDSEDEETSAKTSPALGPTNPTGAQSIGERRSNGTSTNGNVRTTAEPVKTFGHRYLTNDSLVLVSLGSMDMRKAVEAVSLDQVPLTEAHNTQLDTALSVVVSANGAQGEPSIVDLPISENISTEPIVFTTTDFSKVKLLFDIVPTYSGSEKNKIGRAVALLSSVKPTIGSQRMNLQGDVCVPIMSSSLDVIGVVNFNFLVITPFHHPNIEITSRQTYWKKMESTMLIGHRGLGKNISSNRSLQLGENTLPSFIAAANLGAQYVEFDVQLTKDHVPVIYHDFLVSETGIDAPVHTLTLEQFLHINSDNTRHGHHPNGHKSGSRIDSVKRNRSSSFTPRRTNSVGFIGEQHAELEERMKHTRDFKEKGFKANSRGNFIQAPFATLEDLFRKLPEDIGFNIEMKYPMLHESEEQEMDTYAVELNSFCDTVLSKVYDLAGERHIIFSSFNPDICLCLSYKQPSIPVLFLSDAGCAPVGDIRASSLQEAIRFASRWNLLGIVSAAEPLINSPRLVKVVKENGLVCVSYGSLNNNSIMVQKQVKEGIDAVIVDSVLAIRKGLTAGATDASSSASETKSDEDSAVI

SEQ ID NO: 3145 - protein, 513 aa, Unknown
  Kingdom: Fungi, Phylum: Ascomycota
MQTAPVDSLPASAASSKPSSLKSQDASAKSPLVTPQNGTVSPANGATSPPPTPDGTLRPLEPKTTVKERFTRMFSNKGDIPKASNPATLQAVSPPATAGEPANRSRGSSVNGSSVPATVVAQREKPQRKESYSDQGSDRSSTPVKSQRFILLTEAQGGGHEHHLKSSRRQEKLSDMWRTLIGKKHEPQPEDNDLSLVSSWVDTLRQEKEAANNEKKNGATATTLVEKYGKCQEVVGKGAFGIVRISHKKLTTGNGEKLFAVKEFRRRPEETEKKYSKRLTAEFCISSSLRHPNVIHTLDLLKDAKGDYCEVMEFCAGGDLYTLVLSSGKLEVQEADCFFKQIMRGVEYLHEMGVAHRDLKPENLLLTTRGGIKITDFGNGECFRMAWETDAHMVSGLCGSAPYISPEEYTDKEFDARAVDVWACGVIYMAMRTGRHLWRVAKKDDDEFYARYLAGRRDEEGYGPIESLHRARCRNVIYSVLDPHPTRRLTAAQVLRSEWVREIKLCKAGEEGL

SEQ ID NO: 3146 - protein, 469 aa, Unknown
  Kingdom: Fungi, Phylum: Ascomycota
MSFGYASGVIGPTTAQPSFVMYFDLATRSNTTSLISAMNSLFFAGAVIFILTVPFFADKWGRKAAVGVSAAIIIIGGAVMAGSVHVAQFIVFRFVSGAGTYMMISAVTLWMTEIAPPSIRGVFVALIGASLLFGYSSSVWVGYGFLFLDSPNAWRAPLVFQGLPSLILLSILYWLPESPRWLMIQGRYDDARENLLKLHTPEEAEVEFIQIRTQVEIDRTLPSSYWAMFANKNYRKRTIIGMGTFASIQTSGILVINNYGPMIYGALGFGLETQILYAAAWLTLGWGGGCVALLVVDKIPRPKFIGYGLIACQVCLIIEAALVANFAGSDNKTALRACVAMLFLFVFIYEFALDSAQFVYLGELFPTHIRAKGVSLGCGTLALMNVMWLSVAPTAFESIGWKFYLCFIIPGFFCAGLILYYCPDTLGLPLEEINAIFEDKPSILGIAEGHVAIQYPEKNPNAKSPDCNA

SEQ ID NO: 3147 - protein, 241 aa, Unknown
  Kingdom: Fungi, Phylum: Ascomycota
MCTYALARFSCRHEIWGRRTKLCTIGEDFRNGHIEADCTFRGSHPLKTMQVPQACYSCFKIKALPILCREKLQAARSVFKERWPEEQPTKAVSLVMPEKPAEEGEEMALKSDKGKQPAEPAIKEQVVDVPENKLDAAKPATLIGKVVKPTRLAKKDPVTPVKRKTSLPTSKITPPKVQAALPSPDSTPPKATLSRLSRLVRSSTTTPEKKKIAAAPKTPAKTPAKAESKLPKPGFLLLENE

SEQ ID NO: 3148 - protein, 326 aa, Unknown
  Kingdom: Fungi, Phylum: Ascomycota
MIDSSAVNRVVLQDILPAISAHRSETSKPFVLGLSGLQGSGKSTWAAALTNVLNEQPNLNARTLSLDDLYLDHPQLVALRNSNPGNALLRTRGQPGTHDEVLAQQFFQSLERQAEAGDMRASQKGQAILWPAFDKSLNSGEGGRVPVSEWEVIPYDQPLHVLIFEGWCLGFQPLSPDAVEDKWRGARLAKESLSVEDSNRAISTQTLGDHQLDHLLAINDNLARYCRSFMGPQIFDAFIHLDTKDLHTVYDWRLGQEAALRESKGSGMTDKQVIDFVRGYMPAYELYLSRLSAGDFFADTGNGEKSKVHIRILLDKQRGVSAVERI

SEQ ID NO: 3149 - protein, 644 aa, Unknown
  Kingdom: Fungi, Phylum: Ascomycota
MPSEIDAWTYGPGGYPAALNRTKIQFGDAPLRPTEVLIRVKAAALNPVDIQLMNYPIIPSLPSWIFPVKGVGEDFAGIIEHAENASGFKPGDEVLGVIFPFPNGTFQEMIRIDTANTDNAIVRKPQDWSWEQAAALPLAWSTACTLIQKVESYVGTNSKVAVLGGSSASGLYAVYLARKRGWDVIATCSSAKAELVKSMGANETIDYRTAKVPASLAEHPLDAIIDCVGGTECIGLAQRYVTIVGDKTSRLSLGGSATYLFYPQMVWRSFKGLLGLGPSYLCINYAIKTPFLEELLDVPKEQIVIDSTYPFQHVREAYERMNSGRATGKVVVTLDGESFPVPTMPFDVAIHCGDLTEESKLEEYAITLKLLQDIQAPLKLAIAGNHDFSLDTNAFQRILQSSALSSQDDEAVVSAYGKYGQAEAMFAAAGVTLLSEETHNFVLQNVLAGGFSTSHLWVVPDTIDVAITHSPPHGLLDRNQDAVRGGAHGLFAAVERARPKLHCFGHIHEGWGAKLVAWRHSNNLGDDTNDNNEPSPTITGHQDTTLGVQKPPSHLTHMDNGASTLIESLATLKPRKFDSDEVKEEKRVKLEWLRAEGRCEARCEGGKTLFVNASIQGDGEALQLPWIVQLSLPRADRTDHRQDA

SEQ ID NO: 3150 - protein, 510 aa, Unknown
  Kingdom: Fungi, Phylum: Ascomycota
MSTLDEKTGPAPAAAPAPESRHDASIDSPSDPLVIDRPAGWMYKGFRIFGKEYWYASPKIQLLVVSFVCFLCPGMFNALSGLGGGGQVNPYAVNIANTSLYSIFAATAFFSGTIANVLGLRITLSVGGLGYAVYAASFLSYNHNENMGFIIFAGAFLGFCAGLLWTAQGAIMVSYPPEKSKGRYISIFWIIFNMGAVIGSLIPLGQNIHKLAGPVTDGTYAAFIVMMSCGLVLGLFICDADKVIREDGTKVIVMKNPTWKTEFIGLYETLKNSWWIVFLFPAFFSSNIFYTYQGNGFNGSHFNTRTRALNNVLYWTAQILGAIITGFGLDHMKARRSMKAKISYACLIVLTFVVWGGGWAWQKQQVPRSRTLEEDWDALKVDWTDDGYVGPLFLYFFYGFFDAVFQTCMYWYMGALSNSSRRSTFYVGFYKGLQSAGAAIYWRLDSFETEFDIMFGSTWGLLGCSLLIGAPIIWLKIRDHIPMEEDLKFSDETVEDVVVGRDIKKGEEAA

SEQ ID NO: 3151 - protein, 721 aa, Unknown
  Kingdom: Fungi, Phylum: Ascomycota
MDRQSVYSTHVFEPSQGESRDTRLQLQAQLETFILDFRLDNNFVYRDQLRENALLKKFYCDVNINDLISFNEELAHRLASEPAEMIPLFENALRKCTHRIVFPHEKQVDLPEHQLLLHSDAENVSIRNLDSMTIARLVRVPGIVIGASVMSSKATELQIQCRNCQHSQYLPVLGGFTGVTLPRQCGRSRVANDQTPKCPLDPYFVMHEKSRFVDQQIIKLQEAPDQVPVGELPRHVLISADRYLTNRVVPGSRCTVMGIFSIYQNKASKNSSTGGAVAIRTPYLRAVGITTSTDQASKGHAAYTEEEEQEFLELSRRPDLYNVMAECIAPSIYGNRDIKRAILCLLLGGSKKILPDGMKLRGDINVLLLGDPGTAKSQLLKFVEKAAPISIYTSGKGSSAAGLTASVQRDQSTREFYLEGGAMVLADGGVVCIDEFDKMRDEDRVAIHEAMEQQTISIAKAGITTILNARTSVLAAANPIFGRYDDMKTPGENIDFQTTILSRFDMIFIVKDEHTREKDERIARHVMGIHMDGRGAEEVAESEISVEKMRRYLTYCKTRCAPRLSPEAAEKLSSHFVSIRRQVHAAEMEANTRSSIPITVRQLEAIVRITESLAKLTLSTIATEQHVDEAIRLFLCSTMDAVNQGSNQGSRELNEEVNRIESELKRRLPIGWSTSLATLRREMVEGKGYTEQGLNRALMVLQRRDTIMFRNQGAQVYRNGA

SEQ ID NO: 3152 - protein, 911 aa, Unknown
  Kingdom: Fungi, Phylum: Ascomycota
MKGFGLVLGLLSTLVSGQEAADLGLEGGVPSSIRVNETFTSRRFIVEFATNSNARVAANGLADKPGLKVLRVFENDIFTGASVQVEEDNLDTLKAADVRIANVWPAHRFVLPPLVPEATWSEQAAGINYSVHSMTGVDKLHAAGIKGKGVNVAIVDTGIDYTHPALGGNFGSGFKVTGGYDLVGDGDYPYGPKVPDDDPMDQLGHGTHVAGIVAGVDDLFTGVAPEANLQAYKVFSTVDGTEEDILIDAFLMAYDDGADIITSSIGGVNGFPDGAWATVASRLVEKGVVVTISAGNDGQAGAFAASSGSSGEYVLAIASVDGDIMPTSSFNATFDLGGDSNTTKVPYRAVVDWFPSEVKDWEIYPLTLDTTVEDDACSPLPEDTRNLTGLVVLVRRGGCDFTTKQLNLEAFGATNILFYTNEMPLVKPTTAQLGAPSVLAMITREAGKAIIETIKSGGEVTADFSGRPIYTIVGVENEETGGMASAFTSIGATNDLMIKPDIAAPGGNILSSYLNKGYAVLSGTSMSCPYVAGVAALYIGEHGGRSTHGPDFAKTLAMRIVSSGDSLPWNTPEGIEEGVPASVAQVGTGLVNATKILDYTTSLSFAKFSLNDTHHFSRYHEVDITNNGKTSVTYKFTLEDAGTMLTMLRDTTVWGTPRIAWYEEVMAVAVKAVPRFSSPGGTFTVKAGETKTAKFSFMYPEGLDASLLPLYSGKVIISGSNGESLSAPYMGLAANLHRDMDVPFQEPIGFPRITSTTKDIPITTKSNFTFNLTTADFPNLYTRETYATTEMRWDIFDENWKERDWKYPPVIGENGYVGSATSWARAGPVWNFDPEVDDPNDLIALPLKDVPRSVAGAYGQYLWWFGTLANGTRIAPGKYNMRFASLTPFGNPHASDNWFKYKTPQITVLDG

SEQ ID NO: 3153 - protein, 415 aa, Unknown
  Kingdom: Fungi, Phylum: Ascomycota
MRPSDDTASKRASSMHWVLATAICTAVLASTTSAQSLPGLEDAGPPWQSKFFPANKRIALPAKRGPPSEDWDGKIPLVITNKCDDTIWPGIVTQSGTGPGTGGFELVAGNSTRLWVAPDWQGRVWGRTNCTVDGDSCSCDTGDCLKKLDCDNSGDVPATLAEFTLEGGLHGGQNFYDISLVDGYNLPMGINYIPAKNTSFIPPNLTNAACIATPGWLYKPNKTGTYYSNTTFPIPLEDSESNESIKNWCPWPYLVFPPTKPGDGVYPYPDDDIQRPAFSPCNSACAATGRDADCCIGKWHDPEKCKPGRYSNNIKAICPDAYSFAFDDQKSTFIIPKGGGWEVVMCPKGRSTNILRQLGQEMDELNNAGNLSEKTLRRLRDVQYITSDRGAASGVRPMLVRLGIVAAAIGTWFVL

SEQ ID NO: 3154 - protein, 198 aa, Unknown
  Kingdom: Fungi, Phylum: Ascomycota
MSPSDYVLKLQTTLKASALVPGPAEVLVPQAFTPTTALNVSYDGRALEYGNLFRARECKLPPAITFAPEANASSTASYLLMLVDPDAPTPEDPKFAFWRHWVIPGLQPTHGTDGQVVAETKRALTEYLGPGPKDDSTPHRYLFLLFREPAGLDLAKEAVGGEEFVQRRSFDPVTFIKEHELKLVSVNWMRGAGDGWTE

SEQ ID NO: 3155 - protein, 377 aa, Unknown
  Kingdom: Fungi, Phylum: Ascomycota
MEAIERLLDWGKDGGVEMNGIAPKPLPGRGIGLVATRRLEIGEAILVVPSPLLRTISNTRKPILRKLKGTTVHGILAASLCLEKDPDFGVWKGVFPTKVEITQSMPFHWPQDLQDLLPEAAKDVLRQQQTKIAKDWKRVSAAYSDIEESDYLYNWHLVNSRTFYHVTPKTEKLHKDDHMVLQPVADLFNHDPNRGCSVAFDANDYTITTKHTHEPGDEVFIQYGNHSNDLLLVEYGFILPAGVNRWDETTLDAHLCPRFSTGEEKKLEEAGFWAGYKLDADTPVCYRTQVALRALFLNDRQWKQVVSGIRSEDMDRETADKELLTVLRSYEKEVRSKLKEVDMSKAGEEHMRETLRSRWLQIKDLVVSAIASIEHER

SEQ ID NO: 3156 - protein, 1060 aa, Unknown
  Kingdom: Fungi, Phylum: Ascomycota
MLFAVVAVCLPLFWTAAAMRADRMAQLRQETVDMFYHGYGNYMEHAFPEDELRPLTCSPLTRDRENPDLIGLNDALGNYSLTLIDSLSTLAILAGGPETDSQSATKALQDFQDGIAQFVLYYGDGRSGVSGQGIRARGFDLDSKVQVFETVIRGLGGLLSAHLFAIGELPISRYAIGPEEGKPTDDPLELSPISWPNGFKYDGQFLRLAFDLGQRLLPAFYTNTGIPYPRVNLRHGIPFYTNSPLHPSPEDESDDTSTRREITETCSAGAGSLTLEFTVLSRLTGDLRFEQAGKRAFWEVWNRRSRIGLIGNGIDAERGSWIGPHAGIGAGMDSFFEYALKSHILLSGHGAPNVSSSHKQSTTGWLDPGSLHEPLAPEMHSSEAFLETWHQAHASVKRYLYTDRGHYPYYSNNHRTTGQPFTMWIDSLGAFYPGLLALAGEVDEAIEANLLYTALWTRYSALPERWSILENNVVSGIGWWPGRPEFIESTYYIYRATQDPWYLYVGEMVLRDIKWRCHTPCGWAGLQDVRSGEKSDRMESFFLGETAKYLYLLFDPDHALNKLDAAYVFTTEGHPLLIPKRTRTRTRERTAAAPPVKAVVPKPYHDESLTYTCPVPAGARSLIGSATAARPNLFAVSRFTGLENAPNVHGPLEMIEVDDKTRGKITKYRALSNHTYFPWTLPPTMLPADGMCVKPNEKTVTWIEFPASDILKSVASQFGSTFTYYEDINGPLVNSIDGLKMQLELQVPEPTGIGTPVWRITHLGGTQLGADEIVHFYAEDVRNLKDGAFTCQRRQDIVQIHALFDDDTLAVLDDLVDNADNADNASIPLPDENSVLVGGDSNGGSEIQDIPSQSLFRHLYRAVSSVFDPEATLIPDTNQASPPILSWTANTPTGPGAFPVPSVADVPTPGSPGWSSSSPSRFPWKTVFAAGQACDSPLPDTAARDHHLILMRRGGCTFSQKLDNIPSFSPSKSALQIVLVIDEFDEDTEAGEEEAGFTRPLLETEQMTPKGMKRPFGVPMVLLQGMKGDYELLKQTKAVGMRRKYTVKSQDVKIENALVL

SEQ ID NO: 3157 - protein, 331 aa, Unknown
  Kingdom: Fungi, Phylum: Ascomycota
MDSPFPKSSSAPGDGKIVAKLLPAGGTGLEAITYQYPLKLISPSSHSDLKSVLVFILSYGGGLVGGDAVNLNVEVHPGAKLSLVTQGHTKIFKSPTADVVTSQTMNVCIGPGGALCLLPDPVQPFEHSVYTQTQIFRLAQGASACVLDWVTQGRTARGEDWDLIKWTGRNEIWSEPAASGPSSKPRLLVRDNVVLSGPDSIALGRPLRETMHELGIFATLILKGDCFTTLGDFFLAEFDVLPRIGERDFRSADAKLQDDSNMSETDKWRVKRTTQERSSGLLWTAARVRSCVVVKFGAASVEGGREWIGSMLSREGSIEAQFGRDALMCLR

SEQ ID NO: 3158 - protein, 836 aa, Unknown
  Kingdom: Fungi, Phylum: Ascomycota
MPQVRRPPIPAVVFFFFIIWLFIPGDEIPGQDLLLSEVAEYRLTRYHDALDVLNQTRWGDFTPRAGSAPDAVVGHGFLNLTGFRGDKDGFIWEDLDYFREKSSALSHYAVPPIDGQQLWDVAAGEAMWTNVSGIVQGDWVRKLGSMKKTYDDYNLTDSAPGLEWMGDKADWARNITGNSGNILLRVDGNKTIEIYEQLAVDDAPLGGGMIRNIKGTATIEDTTGSGHVWEMRLWGVHWPRQGVIIMTTTSEKFEGIFGLPHLTPSADYFQSSQRLLNSTLAGVVARKEENVLLDPNMPWNSDIDNPMYSQYPSPHCEFVVYAQVHSPLPQSPDLSHIESERIINAIESELEHPLGAPIAKVPRLRMSTVIYSPDCGFFLESKGPPEYPPGQTQHLVGLLDDVHVHHIKTWLLMFALVVSGQVFLLKDQMKETFTPSTIGRVSFWTTSIMVVVDGMTFLAAATWVSEAASTFLPTLALMFSAFLSMTIGGSFLGKIHEVQLPESRNRRAAERTSGNTNNTTTPSTVSGDVTPDPGASLLPGPVTAQRSGQSVSLPRDQSGDASAAASGASAVPGVAQTGIEEPPPQTPRQAFQDIIVRYIFTGLCLSALAVSSTTWYPALRSIFFNFCAFCYLSLWIPQIHRNVIRNCRRALRWRFVVGQSLLRVLPIAYFWVYKGNFLFAAIDRRAFAALSGWLWLQLFVLAAQDVVGPRFGVPTGWAPEAWDYHPVLKEDNIEAGGLPIGLVADDNPGLDRSRESNDDPDKRRSSARVIDCAICREVLEVPVINAGDETTSVANAFARRMYMVTPCRHIFHTDCLEGWMKFRLQCPICREELPPL

SEQ ID NO: 3159 - protein, 283 aa, Unknown
  Kingdom: Fungi, Phylum: Ascomycota
MKSEVEPAPQTSKRHPTSLSISVDSPQHDDTSWNELDVEILDSFPVQDDFTYPNLNAACSTLLRGIMAGEIIGAEKTGIQYRDLIEQHGGVTLVVQELLQHVDENIKQLEDRKLTRQALDCVRTKQTEPWPKMVGYMDYITDCRLHAYFRPYVGQSGHGFRRVMQNHVRAILEAQNKSLHYFMMWIGNGARTANFLRLWAFPDNTTQDEWYGAKSDILELLFCIFFNALPERCIAKKTFDRSPGGCWGLNVMTPLYQHKNVSEVEKSDFIRAKAESLDPQIRL

SEQ ID NO: 3160 - protein, 220 aa, Unknown
  Kingdom: Fungi, Phylum: Ascomycota
MNTHATPRPFPVRPIQGGTNQQQQQQQHQQSLHQQHQQHRQSSAPQQQQGSEDEYAMIPEEDRMHIDEVFDLMDMKKKGYLNSYEFRHSLAALGFDLPKPEYCKHLESYGSIPPDWPSSNTTTHCPVNRLIMPLDQFRVCAARLLVDRDPREEAAKVFNMFDYDQDGIISLEDMRRLAQDIKEERAMSDEEIQGMIEYLDHDGKGGVNLEEFIQMMEEAG

SEQ ID NO: 3161 - protein, 180 aa, Unknown
  Kingdom: Fungi, Phylum: Ascomycota
MGIAFAVYSTATRHDATHARILPEARDGSDPITGLPLSWSHGDCGNSPDDAKARGCEYSIVLHSWLPKSCLTNADAEDAEDMYMGRDWPYKTEAGQNLTMEELGGGDYGYFTTTFDWHVTHCMYVWKRLHRILLDPTQELDSYTANYHHTSHCVKMIGGQPEGMKDSGTKIFVKYPKCAR

SEQ ID NO: 3162 - protein, 533 aa, Unknown
  Kingdom: Fungi, Phylum: Ascomycota
MAITLPAQAFGSLQGLALNSAAIVLLLISAYFIQNEIYRWTQRIKSLPGPWGWPVVGNMFQAPDEIPAETYRKWSKTHGDVFQIQLGNRTAVVVNTAEAARKLFVANRTGIMSRPIFYVLHKKVSKNVASIGTSPWDDSCRRRRKLAAAALNRPRVESYAPILNLESREFLGDLLSLYSADKPGDSDFRLPVQKFSLNLSLTLNYGTRVPSAKALHDDPLMAEIIEVESAVSKFRDTSKNYSNYIPLLRYWEPVAQFFHFGSSPRVDAADIGRRRLEYNNVLLNRLRDQVARGEDSPCIQGAVLRDPESATLTREELISVSLSMMAGADSNQPTISWTILLLAHRQDIQEKAYQAVKEAGILNLPSSAYAATNVEYIEALTREISRYFSVLKFALPKATYTDVEWQGATIPANTLVFLNSWAINRDPTLFTDAWDFAPERWLSDSPDHQAHQYAFGIGGRMCVASLLAQNALYTVFLHLVAHFHILPAEGSTSEDIHPLKGLKGRSFVATPRGTRARFVPRDEAALRVFLAGN

SEQ ID NO: 3163 - protein, 409 aa, Unknown
  Kingdom: Fungi, Phylum: Ascomycota
MSSLDAYPSDDGVTQNQSRGNLKPAELLSRARQQVDHLAPHVDLTTALLARYPWGYGPNAVRRSSVSLLATARASLDREITDTEASAIMRVTRAKVSAEGQAQWLSVVVAGAFWWRGIKTFRFPFYTPKIPPLGGGPLAQTMRMIAYSTVTMFVMSPVESVIGTLAASSSAGPDKQALEGLMKEVMNGRRHRGGSHGQQGIGAMGQPSFPDQQQQQQQQQQQDQPSTYTTRWPSDDSSQYNQQQGSTSETARWPADASTQYTPEPAQSSYKPSKSAPTYESSDRWSSSPVLDDASPLAPEESSTQQQPSTTSWARLRQQARVDSQQRQQQQQPGQQQGSWQQVRSSGGDQSGWENDDGAARAQSRDNYTFSAADAERETAKSQAQKEFDAMLEKERRGEGDGAQSSWRK

SEQ ID NO: 3164 - protein, 328 aa, Unknown
  Kingdom: Fungi, Phylum: Ascomycota
MDDNIKVGILSLGEMGTGIAKLLIAHGIPVATNCQGRSQDTVDRARNAKVEVLKSDLELVKQCRLILSVVPPMDAESTAQRVIDALSGGTKTGDVYYADLNAVAPSTCRDIAATIEKARVPVRFIDGCIIGGPPRLKSAPDPGTNQTASDDSHAEWNRPRLPVSGPHSLSDLPGGERIADILNFRLISPAIGAASGLKMCFAAMTKGYTAIATQSFTTAHSLGVADELRTEMAELIPRQLQTAEGSVPSMVPKAYRWVREMEEIAKTMAEDGGWTKSLFTGAAEIYSEVASDMTLKEEKAGKRKRGTTVGEVAGIMSEGLQKKKKKTV

SEQ ID NO: 3165 - protein, 1045 aa, Unknown
  Kingdom: Fungi, Phylum: Ascomycota
MPSQENGFHTHAHARSIRPCTRTNRENNQCWRRGLHASSLRAAAVQAGAPAPPSDGDGNGNGADKPIPGAVQEQQSAIDSHLTHGGRSKLTAGNSLRSRQARRRNASVLPPVDLPARFLEDNVHLCDTQKQPVMPLLIAQHVEKKAKQSRKERKLSAEDRTSWTSFIESRIRVITERLLPKHEAEHLKKINDWSKLILALQSLARLQAVLIDDTTHYIAAISKPTKSKDTKKKTSFWQWDEVEGSLRKTFAFDSKGDLEHAIGRQLQVAIHFDTPLLQTVSDFDPLAFAHLKRHLQTELATKAPTSFEPKTSRRPINVLLTTGYSGSVFSKSIIRNMAHLTPANVVELDAYDLASIIGKYLGQDPAYSRGSLSMLGYRAAELNGRLPVPESKASKSSRNDDDDDDDDDFVESRYITVRGPGNQNDDMPKISAGDFDVFGKWDGLKIDKVLDEIIRSTESKVSPGEIRQQKTIIHLHDYVELSMTLEGSFLISRLRALVDGAWQRGRPVVLMGTSSCNNPSEDYQNMVKEISAQDTVVTRHFNEMFQPDRADIAKADSFLENVTNVKRMVEVMDPEEGHTAFTATEDLVNTALQLGKNSGLYRMYTGIHRFLDGILPAPEIYRIAQVYRSKHMRNNNRDNDVQREINALVEGNSLLPEVPHFNFMQHTVREMDPAEVENILYGSVRMPVKDEPEPEKKKEQDTPTPELKGLNEYEKRIAGGIIAKDKLHVTFGDVHAPAETTSALRLLTSLTLLRPDAFAYGILKRDKINGCLLYGPPGTGKTMLAKAVAKDSGANMLELSGASINDKYVGESEKLIRAVFTLAKRLSPCVIFIDEADALLANRGMGLNRTVHRELINQFLRQWDGIVETNAFIMVATNRPFDLDDAVLRRLPRKLLMDLPTPTDRTAILKLLLREEKLDPEISLEALATRTPFYSGSDLKNLCVAAAMSAVEEENILYSDYLASGGKKEDWRWPEQRTLLQKHFDKGLAQIPASISEDMPSLKAIRKFDEEYGDGKRGKKRKSKGMGFGIVPEEEVPVKEVQVRV

SEQ ID NO: 3166 - protein, 2222 aa, Unknown
  Kingdom: Fungi, Phylum: Ascomycota
MPNTSLRRPQKGTRRGGKSAYHGKSTRTFAASSRNEATSADEKWERTRLAHSIDESMGFARYDAGKKREGWLVNIQPTSIEDDRIPGGRAALDFYFIEESGSTFKATVEYEPYFLIAVKKGHESEVEEWVKRVPGDGTVKGIRRLEKEDLKMPNHLMGYRRTFLELKFANVNDLMGARRDILPLAEKNKKTMTTMDAYAEVATTNGNFDLFDDLRDDERNVNTSISDASDYIVDIREYDVPYHVRVLIDLDIRVGNWYWVEVKHGVTSVLPNPERSLPAEPVVLAFDIETCKAPLKFPDAAVDQIMMISYMIDGQGFLITNREIVSEDIADFDYTPRPEYPGPFMIFNEPDEKSVIERFFLHIKEARPTVIATYNGDFFDWPYVETRASINGIDMYQEIGWKKDSEDQFKCNYSVHMDCFHWVNRDSYLPQGSRGLKAVTVAKLGYDPDELDPELMTPYAVERPQTLAEYSVSDAVATYYLYMKYIHPFVFSLCTVLPLGPDDTLRKGTGTLCEMLLMVQAYQKDIVLPNKHQAPKEAFWDGHLLDSETYVGGHVESIEAGVFRADIPVDFSVDPTAIDELLRDLDAALKFVITVEEQKKFEDVENYEEVKEKIAAQLLKLRDTPKRLEKPLIYHLDVASMYPNIMTTNRLQPDSMIQESDCAACDFNRPGKTCDRRLPWSWRGEYIPAKRDEYNMIRNALENEKFPGKYPESPMRTFQELSYDEQTALARKRLQLYSQKVYHKIHDSTVITREAIICQRENPFYINTVRDFRDRRYDYKGKAKVWKGKTESLKSSGAPGSEVDAAKKMIVLYDSLQLAHKVILNSFYGYVMRKGSRWYSLEMAGVTCLTGATIIQLARQLVERLGRPLELDTDGIWCMLPASFPEDFTFKLKGGKKVKISYPCVMLNHLVHARFTNHQYQTLVDKKNLKYETHSDNSIFFEVDGPYKCMVLPTSKEEDKNLKKRYAVFNDDGSLAELKGFEIKRRGELKLIKIFQQQIFKFFLEGENLEECYTAVAKVANRWLDVLHNKGSTLADEELMELISENRSMSKTLEEYGSQKSTSITTAKRLADFLGEGMVKDKGLNCKFIICSRPRNAPVTERAIPVAIFSADEAIKRTYLRKWLKEEPSDTDPRALLDWDYYLDRLGSVIQKLITIPAALQKVRNPVPRVAHPDWLQRRIAVKDDKMKQKKLTDLFAKNPLEDITNIAGNAMNDMEDYGSKLLKPKAISAAIASTQPASTVQKRKSPEPVENLDPMAALPKVMPNPSDDYPAFLEYQKQKWKIQKQARIRRRQLFGDRRGNTGSNIQNTFMKQAHATFMSTWQLLHLKATDTPGVVMAYVLIDAKIHTMKVNVPRQVFLNLKSKDLPDVEVPGCEVEQVNYTLPNGHPSTHLFKLTVPEDVYFNESEKFSTLFNHPSVEGVYEKQVPLNIRAVLRLGNLCVIDEKQHAVLGKGLEQGFDLSGLKRPTDARTYLDSAGLAYIYISHITAGERQIFGIFSTTGDQANIVILQKSKDSGQDLPNVTKIYSEMRSKRVEEAAGTNWQDCFTYQERVTFKISQVTTRRKAHLEIGDIVKKMRKDESRPQMMVIQSSQRNLLVHDVPILGEFPVLPLRYDAADSSLPPLGWQSVIARRLVGHYLGLGSWILHLTALARYGDVPLCNLERDDPRFLIDIAYARRLQANGVVLWWSPGSRPDHAGYEKDDILGPMDVVKMPAINNPGTFSSVCIDIDVRNLAINTILTSSLINELEGSDSIAFNPSADGSDSLASENSFANAGVLVLREMVKAWWAEACRGSTMADILVQHLVRWVENPDSFMYDRALHYYVQMMSRKAFQQLMADFRRVGSQVVFASANRLILQTTKAEVANAFAYSQYIIKSIKTKPLFHFIDLEIKEYWDYLVWYDEFNYGGRGCQEVIEADEQNLETIMHWQMATFLPTRLQPTFQEWVIEFIQLMHSLKKPHSGDPDATPRLTQLPNRAELGEGEAGQIILGKAFEKPLKKAIIGLINQQKRELLHPELANDYSFPELPGSHLQSRNNQPRNPILELVKSLMQVLSLDKNITLEARLLRKELLALFEVREFSKEGTFANPSESLRLPQISCDSCTMARDLDLCRDEDLVASAGDSSAAWNCTFCGSELDRVSLEERLLCIVEAFAVEWATQDLKCERCGALRVNDFMEHCTCSGQWKEVVNRAEVMKRMGVLRRVAKFYGLRMLGDVVEGMYAAI

SEQ ID NO: 3167 - protein, 497 aa, Unknown
  Kingdom: Fungi, Phylum: Ascomycota
MSLNGTAQADGTPKLKYERTQSQPENPFVALIPDQQFAVIPEYTLESGIKLQNVPVAYTTRGKLNAKGDNAMVICHALTGSADVGDWWGPLLGGPGRVFDTSRFFIVCMNSLGSPYGSASPVTAKNGDPNQGRYGPEFPLTTIRDDVNLHKLLLDDLGVKQVAAVVGGSLGGMYVLEWAYFGKDYIRCVVPIATSSRHSAWGISWGEAQRQSIYADPKYDDGYYPFDDPPTTGLGAARMSALLTYRSRNSFESRFGRNTPDPSKMKTIRERPQPSTASEAHFLSHNDGHRVKRSSISRQNSSGAASLANGAATPIAADPQFHGPQKDAVAGESLTGGDKLPSSTYFSAQSYLRYQGQKFVKRFDSNCYIAITRKMDTHDVSRDRAPSVAEALAQIEQPTLVLGIESDGLFTFAEQEEIAAHVPNARLEKIDSPEGHDAFLLQFEQVNAYVLKFLQDVLPDIMGKEGDPSVAAEEEGVGRVTKSSTFGEAEVEDITAW

SEQ ID NO: 3168 - protein, 761 aa, Unknown
  Kingdom: Fungi, Phylum: Ascomycota
MGVSGLLPLLKSIQRRSELKKYDGLTLGVDAYGWLHRAAHSCAVELGQDKPTTKYISGVMHKVRMLKHFGITPYMVFDGGRLPSKAGTEESRAKSRTEKKKLAMELLRSGKPAQAAQEFQKCIDITPEMASAVIQQLKKMDIPYVVAPFEADSQLVYLEKQGLIHGIISEDSDLLVFGAKRLITKLDQYGNCIEINRKDFCACREVSLTGWSDTEFRRMAIMSGCDYLDGLPSVGLKTAYRLMRKSKDPERCVKMLQFQGKRVSENYLTQFYQAELTFLHQWVFCPTRQEIVHLTELDGTRTAEEMPFIGPYIEPEIARAIAKGDMDPITRLPISHQTTPSKRRHSQMGVSAPAQPPVKPIDTYFKGHGRIPMGAMDPNCFNIDRERVAQLTDGGLVPRVFPLPRPYLDDAQESSTMVAGAHRIVRTSPRLQRRRTEPIGSMLSRVAGESRHPPQNVVQSTTASLTHGRTDLAGRPSKKARLCEEEVNDISPKQSKFFSAGAESTRAKKAKPASRAKSDAMLLLSDDSINEALLSLPDIEGWKEPKTRKWVTIFNDCASKESPTEEASQETSQETTQFSQVGSAVFDTEASTTTVKDTPPSSPEAVMPPPKVLPSLSQKLRTPAPMNIRNFSYTGSSASSSTVASRRDSIFSAVSTPSTGPSTAASSRLTPLQRMGAKAINASPRMPTFSRDPPKRKSFMNNLPVNPAMVALPKVDLDEVEALNRPLEGSEDQIIPDSEGEEDDFADVVPRKLNLSRFAYA

SEQ ID NO: 3169 - protein, 548 aa, Unknown
  Kingdom: Fungi, Phylum: Ascomycota
MSLNRVASIETLADHHARRSSDASIRPRKLSFNPLPQEWDPAIPDTKPGHHQPEQGGISAFDVPQWKRILQIFAAVVYCLFAAGVVFGYAAIKPVLKVQGAYADICHDSATCIEIRLNFMFTVAAVGTNLAALPVGAILDNFGPRVCGLIGAVFLSAGALLLAHATSLPFDGFMLGYLMLALGGPFTFIPSFQLSNAFPRNSGLILALLTGAFDSSSALFLVYRLIYNATDGTYDLQRFFLTYLAVPVVIVVVQLTLMPGSSYKTVGELVDLADEADAAARAQRSRTQPMDDQVDEHTALLQEDGIDAYQHRDAVIADVESILGSVTGGEQLEAEERKNTRSGVWGIMHEKTVLQQLTSPWWILICLFTVVQMTRINYFVATIRPQYEALFGDEAKAIEINNFFDIALPVGGLLSIPFIGMTLDHTSTTVVLSALVSIATLIGVLGVLPYSWAAYLNVALFVLYRPFYYTAVSDYSAKVFGFRTFGTVYGLIICLSGLLNLSQSGLDVLFHNTFKGDPVPVNLMLLFAGLLIGTVLVIFVTVQSRKRQ

SEQ ID NO: 3170 - protein, 333 aa, Unknown
  Kingdom: Fungi, Phylum: Ascomycota
MFNALNRFMSRLDGDPGQQRQQERGSFGFQVLRNTNLEVAIEPWFDFIVGINGRPIDTSDSGLFAQEVRNCAGGSVTLGLWNAKGQRTREMHVSVPADTASLGLSLQYSPISLAANVWHVLDVPANSPADAASLLPYSDYILGSPEGALHGEAALGELVEDFIGRPLRLYVYNNEYDVTREVTITPSRDWGGQGAMGCVLGYGALHRLPAPLSEPVNAPGEMMFDGGVNEKSAADASFEQVAGNPTAGADYLVPAQMVESAPISAPPRGGKKKEKHGASPNKLMDDYFAEEEAKSKEADNAPQSKTAGVPPPPKAGAGPPKAKAQAEEAAEVE

SEQ ID NO: 3171 - protein, 408 aa, Unknown
  Kingdom: Fungi, Phylum: Ascomycota
MKLNNLALSLAFASGVLSAPSNTKRDDSKFDEGQPISADGKGGPISGGTNEQIDLSNPSNLGQQPTDNGIVPNLKWSFSDSKTRLLKGGWVREQVIQDLPASHDIAGAQQHLRKGAIRELHWHRVAEWGIVYEGEVIVSAVDENGVYQAEKLGYGDIWYFPKGVAHTIQGLKDENEYLLVFDDGNFDAAGTTFNIDDWLAHTPKSVLAKNFGVDESVFDTIPAPAPYIVNGTVSDSNVTDAETPYATGNSSFVYHLFDHEPEKIGGDGGSFYKIDSTNFPISKTIAATFVTLKPGALRELHWHPNAEEWLYFHKGKARASVFTGNTNARTFDFTAGDTAVFPDNSGHYIENVGDEDLIWIEIYKSDRVADIPLTQWLALTPPDIVSQVLKVPIEFVEKLKKEKQVLIA

SEQ ID NO: 3172 - protein, 262 aa, Unknown
  Kingdom: Fungi, Phylum: Ascomycota
MANDPVFEWHPAKFLRTQDPSPEFSLLILNQPLRNGNNLRKLWRNSTMRVAADGGANRLHDLSSFQGKFSNLQAIIGDLDSLNPTVRDFYSSQPTPAAIIHDHDQETTDFGKSVNWIRDNQPRGSDIIALGGIGGRVDQGISQLHHLYLFHSDPAYESGRVFLLSGSSLTFLLKAGKHQIHVAEEGEDPVFGKHVGLIPLREPSRITTSGLEWDVTDWETQIGGKLSTSNHVSPDVKCVEVETTKDILFTIALGQLDGEDDS

SEQ ID NO: 3173 - protein, 749 aa, Unknown
  Kingdom: Fungi, Phylum: Ascomycota
MTAVQTQKPAGAGTSSSTRALLRVIILSLIAGAAIASRLFSVIRFESIIHEFDPWFNFRATKYLVANGFYKFWDWFDDRTWHPLGRVTGGTLYPGLMVTSGAIYHALRAVAIPVDIRNICVLLAPAFSGLTALASYLLTNEMTTSPSAGLLAAAFMGIAPGYISRSVAGSYDNEAIAIFLLVYTFYLWIKALKLGSMLWGALCALFYGYMVASWGGYAFITCLLPLHAFVLICMGRYSTRLYVSYTTWYALGTLGSMQIPFVGFLPVKTSEHMPALGIFGFIQLIGFIQYVRSAITGKQFQTFLITVLVAAFGISLAGLVGLTSLGYIAPWGGRFYSLWDTSYAKIHIPIIASVSEHQPTAWPAFFFDLNFLIWLFPAGVFLCFQELRDEHVFVVVYALFGSYFAGVMVRLMLTLTPIVCVAAAMAASQILDNFLLAKTPEAQETTEEASDKPAKKTASSNGLRSASQPFIGVYSIGSKAAIVAAMTVYLVMFVAHCTWVTSNAYSSPSVVLASKMPDGSQHIIDDYREAYQWLRQNTKEDAKIMSWWDYGYQIGGMADRPTLVDNNTWNNTHIATVGKAMSSREEVSYPIMREHEVDYVLVVFGGLLGYSGDDINKFLWMVRIAEGIWPEEVKERSFFTARGEYRVDDGATDTMKNSLMYKMSYYNYHTLFPAGQAADRVRGVRLPDQGPVLDTIEEAYTTENWIIRIYKVKDLDNVGRDLSAAAAFDRGQKKKKGAKKRAARVLRVD

SEQ ID NO: 3174 - protein, 414 aa, Unknown
  Kingdom: Fungi, Phylum: Ascomycota
MRPTSTILARSSANKTTTTSNNSASEPPKRETSRYPPSTTLTRPQTSHVRPGSSGSTAPPKRVTTHTRAKSTTTSVNQSTVLRPPSRDKATGPAARPAPLAHRRNASVEKSNISNAVHTPTKPSAQAPQPRLKPTFSTLQQHYSPAKTLAPKPLTATYLAPPSPSKLPANLAASAEINRLQAEVLQLHLLHRDASIVEKAWRESARSKLGARFEEVDEASREIAALERDRAEVSNFLALRKWAGEDGDLDQKIQVLDAVTNGVWTLSEAGGRYARIVRRFGRWIDLVGEIEEIRKSGTALTQGDGNLFISELESNWKEDRPGLIRRLDNWRLQLRTLGSLPESADDGSLPPSLIRMVRSCDSLIRSMLGELAIMEEIGREALEREDEWIQRSNREDDDDDTPRAGAIWRTFNDR

SEQ ID NO: 3175 - protein, 275 aa, Unknown
  Kingdom: Fungi, Phylum: Ascomycota
MASINPVATNGFAKGALYDQHRPTYPAEAVSSLLTHLGLADKRGGKIVDLGAGTGKFTEALAAREEGFEVVAVEPLDSMRDVLAAKGLKGVVTKDGTATDTGLEAGWADAVIVAQAFHWFATEEALAEIHRVLKPGGKMAVIWNVDEYNRPKDWPATTNWEKEMGDYVANTAVDQLTTRFRDNRWPAVFDVQAKRGKPFFSTPIKSETTSWSINVTRDGLVDRISTLSHIAMMEGEDRKAFEKKVDEILDGDVKKDEQGRIEAHGLTYFAWTERL

SEQ ID NO: 3176 - protein, 358 aa, Unknown
  Kingdom: Fungi, Phylum: Ascomycota
MAPPPEIAIPSTSVSSESSSKPYTLYNISLRLPLRSFVVQKRYSDFASLHSTLVSQVGAAPPVALPGKHWLKSTVKSTDLTHERQVGLEAYLKAIAESPDRRWRDTSAWRAFLNLPSSSTTNSAVSAGGMVANKAAGAADPGTWLDMHRDLKQCLHDARQSLSRRDHASDSGNSSAAAEASTSAKRSIVKAGTSIAMLTDGLRKMQESNRLGDGELRRRRDLIAAARMERDGLDKLSNSMSSSIGGASGSKVQASSSDKAALLQGGRPAGRVLGAPAPETDKTRELDNQGVLLLQRREMDSQDQALDELAAIIRRQKEMGMDINEEVERQNEMLEQLDEDTGRVQGKLKVANKRIKKF

SEQ ID NO: 3177 - protein, 452 aa, Unknown
  Kingdom: Fungi, Phylum: Ascomycota
MPQIRRGSARLNSDPSLAASTPQGPASPTANDLTPLPSTADLEGTKTTTNDLEASSSSNPPAQPVLTSSNSNDPTRPTVTFKTRSADQLASNNQDFHNSSDDVPRRHTLDQGSNSRRSLSYAQRPREPVYYDSRAATRDEYNRRGHTLQEYYENHPELLPQLPFTWHHGRRRWRLWFFAFLVFVDASAVPIALYYGLHYAGHVEGWIIFAVVTTIWGGPTYLELAIRSFRLIKKERFYRPLGTNSRWCFDMTTWASVLTIFVVTTLFIVGSAPHIVWLRVLCMPAPALLYCLGGWLLVLNLYNYYDWPAPCRISSTAKGGKVLPPVYYFMEDVVAVNASAGRPYREALAARYAASPRFRRMLYIQSWFWAIPALVLAVPLTIISVIPQVPATGAYGVAWAVPFLWAVIWGIITVWWCKREMVRERLEWERGETGVAKGAMIARSEENSVIAA

SEQ ID NO: 3178 - protein, 526 aa, Unknown
  Kingdom: Fungi, Phylum: Ascomycota
MDIDTKKTAGGDDIQNIQTADSVQYEKISDVDSATLRRVPDKMPKLALLILAVELGERFTYFGLSGPIQNYINNPYTPDPSVADLPGALGQGQAVATALGNFFKFWAYSSTVIGAIIADQYLGKYRAILLAGGVYIAGLIILVGTSTHAGITSGAGLGGLIAAMITIALGTGGIKANVTPMCAEQYANSRPILKKLKSGEQVIVDPELTVGRLFMWFYWVVNIGALSPLITVTVEKHHSFWLAYLIPLIAIIISLGVFLCGRNKYIKVPPTGSAILDAVRTVRIAISEKSFDSAKPSSLREHGHQDKYPIASQDRYTDEYVGEVRTGLRSCKMFLFFPFYFICWNQMWNNLISQAGQMALHGTPNDLLQNLDPIALCIFIPFLDIVVYPLLRKYKINFDPVTRIFVGFITASLSMVYASVLQHYIYNSPPQSIHVWIQAPSYILVAFSEAFVIITGLELAFTQAPKTLRSVVSALFWLTIGIAAAICIALSAVSQDPYLVWMYGSLAIVGFVAGCAFYWCFYPKKK

SEQ ID NO: 3179 - protein, 348 aa, Unknown
  Kingdom: Fungi, Phylum: Ascomycota
MLPPIDDSLLQVNPNFALLYKRLTATLLNPDASTNDADSPEAKQRDAVRKELDKHRLTAAKHHILTQAIATATPPDPKPSSRSIKPQPSRLQSQQQQDPTLPDPLIDLLLILPPILTPTSTPLPSSALTLLLSSPPLSNLDDLLPSLASTISPTLHSSALTLTRLAHPSTNPSYLHRQIPSLPNHILTNLLNAHTNLQTTLSQSRLQTLCSLLNLLNSHATTITQLIRLLEVKHGIVSRNLELHAADTALNSQRTEVDAEQALWTIRRDVYSPEARQALRNYGAHLKDARMRTEEKLRVLKMELGDYGVGVEGGEAKERTMREMARVYSQMGKQMQDTKGDLDRLQRG

SEQ ID NO: 3180 - protein, 501 aa, Unknown
  Kingdom: Fungi, Phylum: Ascomycota
MRGLLPVVAASWASAVLASKGSSPEANVAFCCSKLAEEFPDQVVATGDSQYATWNHRWADTAELAPSCIFRPQSAEDVSAAVKVLSKGLGDGCHDRCPFSLVSGGHTPWAGANNIDVGVSLELSQLNQVVVADDRSHVKLGAGARWHDAYVQTDGEGLVYPGGRCPDVGISGLTLGGGYSWFSGEMGFVADNVINYEVVLANGSIVNANEKEHTDLWQALKGGSNNFGVVTRFDIRATEHDQQVYGGLVIVPGSLTDEVLPALYNFTDDSSGIHKTAGLTIEYFIDTATGDEQILLWLIDTDVSASHESLQPFFDMEPKYLNQVYQTSIAEYPTSIPAVSRVLMADATFVNDMEALKAVYKVTMEIKDTLSHVPDLIWDFQFEPLPRHIIEASNARGGNVLGLDTVTEDMLIIFIMPLWQDAKYDADINEAAARWVKEVQKVTQALGKGHPFEFANYAAGFQDVIGSYGPANKQFLKDVAKTYDPRGLFQKAVPGGYKLDL

SEQ ID NO: 3181 - protein, 151 aa, Unknown
  Kingdom: Fungi, Phylum: Ascomycota
MSQRLGKLPKLRKLKLTVQGGQPTKDWDGPKSLSVSDIKLLYATQHECLDWARELATVESLEEVEIEVDVRPMPKPETTSTLIYAALSASIGVSLIEFLNEELNVPARLMVKPPPVEEQSDEKMVNGDAGSTPGAEQEAPAAVDGPQSQDA

SEQ ID NO: 3182 - protein, 902 aa, Unknown
  Kingdom: Fungi, Phylum: Ascomycota
MLASPTPAPAGPIRRTSQRQALRRPPSRSLLSRAESQQALASGGNGPGPSNEAMADQSKQYRDDSSEDEIPVPMKLSALTKALLNDPDEPVARGPSPPRTRRQASILNSSTNSAQSAEERRHLRSRSTQPQEYNRDERDNSPGKSRDQSPIRKRVVRLNRDSQGSSQMGPVPTKRRSTSVSRGTRKDSQQPPSRPSSRADSHGDEKADGQRDVNTPSQAPLRVVRISTNSSVKRRLAARRSSGLNADVSAADGSALDPGHEYHTRKEDVDSAARGNSSASKSSGSRYPSSSLRNRSEENPNLHSSMRIKRVGKTPGGFLSGPARRGKRRQSEEDGGEDMGEGEPMLSSHDRERQIGEDGALSYVREFNSGSPVSSNAAARAGHRRQASQADLQRDAKQPSPRGIDLSRKEDPLASFENGFPSPKGIEMPVRTHDKDLANARRPIRPDLPSNHDQENEVPGSWRRSKSSVDPVMEKIHSRPLQAEIPASKPMASPERKPLAAIAKNTPSQAAPPPPPRMSILETATSNAGAAATTQAKQRRNVLRVNGKVYTRLDCIGRGGSAKVYRVSAENGHMFALKRVSLENTDEIVLRGFRGEIDLLTKLNGVERVINLFDHELNSEKKVMEMGELDLGSVLKARHALDESKFDPVFVRFYWKEMLECLQSVHQYAIVHSDLKPANFVLVRGRLKLIDFGIANAIQDYTKNVHRDTQIGTPNYMSPESLLDSNSPSNNPGARINGQAKLMKLGRPSDVWSLGCILYQMVYGTPPFGHIANQMARCQAIINPNHNVEFPLHAPCGTRVPNSVIKTMRSCLIRDPSYRPTVDQLLKETDAFLYPKELPSDSLPVDREMLGRIVQDAVRKYIDGQDHPDPRKRPNREDLRKDFSEDYWHSLRKAAVAKGVMW

SEQ ID NO: 3183 - protein, 320 aa, Unknown
  Kingdom: Fungi, Phylum: Ascomycota
MSSKAPPAGVLAPAVTFIDPKTDTLDLDSQSKYYTYMSKTGLCGLVVLGTNSETFLLTREERKTLLQTARQAVGPEYPIIAGCGGHSTKQVLEFLNDAKDAGADYALVLPPAYFGKQTTPAVIESFFDDVARESPLPIVLYNFPGVCNGIDLDSATIAKLAKKHENIVGVKLTCGAVAKITRLAATFSPEEFTTYGGQSDFLIGGLAAGSQGTIAGFANVFPKTIVKIYNLYQEGKFAEAMELHKKAALAEQPCKAGIAAVKYATGLTTAKAAGIEGAGEKLKPRRPYLEPSEAEKKVIDETVATLLDYENSLLGEDRLE

SEQ ID NO: 3184 - protein, 596 aa, Unknown
  Kingdom: Fungi, Phylum: Ascomycota
MSTKKKDDVQVSSSDETGSGSDLDTQPSKNRVYTKSDNDLTHPTPLDLATRETIRMESALGDAILRFLRIRKGPKGDEYDLDAVATQPSIWDSENLEEYKQLYIHPKWENASAFDPTFRWTFREENQVRRKVDWKIMVWVCVMFAALNIDRGNISNAVSDNMLDDLGLTQVDYNIGQTIARLGFLVAELPSQLISKRIGPDMWIPIQICIFSLISGLQFFLNGSASFYACRYLIATFQGGFIPDTILYLSYWYTGTRLPIRLCWFWMSSKLVDIGVGFAAVGLLSMRGVLGYAGWRWLFLIEGAFTFAIGLASFFLMPQSPARTKSKWFPKGYFSEKEEKIIVNSVIRDDPQKAGMHNRQGLTLGQIWKCSKDYTMWPLYLLGLLFGLPKYPVGQYLTLSFRGLGFNVIETNLLAIPETVFGSITMLLITAFSEIVSNRGFVSMAQDAWLLPCFIALITLPDPIGAWAYFAIATVLLSAPYTHPIQVAWTSRNAGSVQNRTVSAALYNMAVQVSGMIGANIYQPSDSPRYFKANKGLLVICFWMCFAQYPGTYFFYRWRNRTKAKIWDAMTSEEQHQYRTTTTEEGNKRLDFRYAT

SEQ ID NO: 3185 - protein, 804 aa, Unknown
  Kingdom: Fungi, Phylum: Ascomycota
MKLSPSSSTAVLAILLVQLLSFTSAAPKAPWVKQRAKGQARRALSAAMEKRDSNSSTPECAEREALLTTAPKTNVWAGLNGEEASSVVHWLFAQEELNLTVMEDAGSWDNTLLLVELQTPNKTDALSYIDGSGPEPERWVRAVIDHKASEEPYIQDILVGPLPVVNGTTTWSPLEYTHTRKTEGKVRSLEADSEAYEEWLMQVSTSVADITMDLWNASALGLENDTLSVWGIDPYYQEEGRIKRWDTFWGMPEGVFEDMTLLPMGLFFMSDVTGRDPSKWTVEGWYYNGEFYETTDEFRDAYWGGKVEKLKGAVEGAWAQTDRQGKIPPLDTTAPPVMVAPGGARYHVDPESKYVEWMGWSFYVAFNRDSGMSLFDIRYKGQRLVYELGLMEALAHYAGSDPVQSHVAYLDTYYGFGPFAFELLKGFDCPSYASYLNTSFYVDETTHTHLNSICLFEGDADYPMSRHSSSAYVASTKNIYFTVRSVSTVGNYDYMFSYTFFMDGSLAIEVRASGYIQSAYYAKNEDYGFHIHDSLSGSMHDHVLLYKIDVDVLGTSNTVQFMDQVPTTTTYPWSKDKVFDTMKLERSFLENEDQGQFNWKANSQQQVFVVNQEEKNKYGEMRGYRVLPYTGASHLTINNSSILKNAAKWAEHDIMVSVRKDSEPKGTHAFNNQDTENPPVDFSKFFDGESLNQTDLVLWVNLGMHHVPHTGDLPNTVFTTAHSGIQLMPSNYFEVGQNTETVNMVRVDYTDGVVSDVISFGSAEDTCSLDYEPVFVDLWEYKGDVVVRKLPYSPNDPYYDTDSI

SEQ ID NO: 3186 - protein, 211 aa, Unknown
  Kingdom: Fungi, Phylum: Ascomycota
MYGDIGLKLVQHAKRTQNLTHLPPYQTELVRASTREVRDLDKDVSDLLEPFQGSFDPTADQATACTLLVNHLAMRRNKRCLLAYHRTRTDKLEELVWNGTDVGELSGQQVREGAGGSTAPDTATSSLSPQEEDYVRQYSDLLAAYKGQWTDIDLTGSLEPPRDLFIDVRVLKDAGEIQTEYGAITLTKNSQFYVRQGDVERLIAQGYLQKL

SEQ ID NO: 3187 - protein, 444 aa, Unknown
  Kingdom: Fungi, Phylum: Ascomycota
MKSILAASVAALFLGNAFAESMSVLKELKVKQWAKQEAEGAFDLDRYEALQAVTTCTNGRAGEYRCSNVDLVSFLRHQDMGSSTRTGNDVWGWTSSTGREFGAVGQTDGTAFVEVLRDGSLVYLGRLPTQTVNSSWRDMKVIKDFLYVGAESSNHGLQIFDMKKLLTVNPASPRVFSITSDLTAHFRGFGNSHNIVAHEQTNMIYAVGTGTAAGCRGGLFMVDVSNPASPRSPGCLSAGGYVHDAQCVIYTGPDTRYTGREICFNYNEDTLDITDVTSKSNPVTISSTGYNGASYTHQGWLADPEMRFLLLDDELDEQRRSGPAANQRTTTYIVNISDLRRPVFTGTYQSPAIAIDHNQYVHNGLSYQANYGSGLRIIDVRSLSTDSTGRGIREVGYFDCYPEDDSVGGRAAFTGTWSVYPYFKSGFVLLNSIERGIFSLKYTG

SEQ ID NO: 3188 - protein, 261 aa, Unknown
  Kingdom: Fungi, Phylum: Ascomycota
MSWAGFKKNVGRATTQVMMKTGHVEKTNDRDYEVEERRFKTMEAAALKLQKESKGYLDSLRAMTASQMRIAETIDAFYGDSGAKDGVSRSYKQAVEDLDAETIKALDGPYRTTVLDPISRFCAYFPDVNECIKKRSHKLLDYDSLRAKVKRLVEKPDKDATKLPRTEKELEMAKAAYEQLNEQLSTEVPQLIDLRVPYLDPSFEALVKIQLRFCAEAYSRMAQVQQYLDAETRDLYAEGHLDARVEEVLQQIRELSISGTV

SEQ ID NO: 3189 - protein, 902 aa, Unknown
  Kingdom: Fungi, Phylum: Ascomycota
MFSKAAKIPGAPGAQGRDLTVPMGPEEALLMMAQMELATLLEDLETSQDGLTNIEAAHRLQKAGLNVVSFKKAPSWWLLLFMVIPNPFNILLCCLAIISVASPDRNWKTFGVLVAMILISSAVRFVQEYKSITSATKLQNSIVNTVKVRRRQHDKPHTPIGSDTPEENIVVGDVLLLGPGDTVVADCIILEANYFRLSQSSMSGESVPVTKSPRSTAMDEKHSGSLFDTRNIALMGSNVVSGRAVALVLRTGDDCYIASIIKKLSAARGLNAFQKGIRDVSYMLVGFMLVMVPIVLGISGSVSGDWSQAAVFSLSVAVGLVPEMLPAIVNANLARGAHLLSKKKAIVKRLDAVQNIGAMTVLCSDKTGTLTKDQVHLQSYTDCTGLPNADVFQLAYINAICQENQGNTMDAAIIHHQEEADVPVTIPHYTKFAVIPFSFERRRSSCLVKGYTQRNLLICKGAFDEVLALCNHIRRNGKDEPLDATTRYALSQRVNKLAENGLRVLLVAKKQVSTNDIETADSIEDLETAMVLDGLLTFMDPAKEDALESVTSLRAAGVDIKILTGDNLAVAINVCRQIGLVSDLDSDDVQAITGPDLALLEGQAFDDMIARGKVFAKLTPTQKSQVVERLKKAGHCVGMLGDGVNDCVAIRAADVGISVDSGSRAAKDEADVILTEKGLNVIVEAVRIGRITHGNSIKYIKMVASSNFGNVFSILIASSWLPFTPMSSIQLLVQNLLYDISQIAIPWDRMDEEYLQKPKRWASLDLLRFIAVFGPTSSVIDLSTFCIGRYFYRISSTSDNVPLFQTHWFLQGLMTQTIIVHLLRTAKTPIYQSRAARSLVMATCAILLIGFCIPYIPPIRDALGMTRPADTFVGILAALLATYCIEVQVVKMIYIQLFKKWL

SEQ ID NO: 3190 - protein, 609 aa, Unknown
  Kingdom: Fungi, Phylum: Ascomycota
MTRQQGAEALDLDNTKAAYYAPASITPPNTRTIHVSGQPGSSKNGHVPADYESQIHLALLNLRRILLTAGATVRNITKLTLFIVNYDPAQRKHTKHVQRFLAGHRPAITLVPVSQLAVPSWLFEIDAVIVAPEAAASVHRPVANTSAEEVDVVVIGAGIAGLTAATDVRKAGLSCIVLEARDRVGGKMWSQNVVNGEGMVDLGAAWINDVNQTKIFKLAQKYGADILEQNTTGKCVLEDKNGAISSFEYGQLPDFDAATQRDIARIRDMVESDCQSLDLLRPQSTEFDSMTFEAYLRSRGATEDAILTASVWTRAMLGQNPSDISALYFLSYCRSGGGLLTMRSDRKGGGQHLRVRQGMQLMPLGLAKDLPEGTVRLSSPVTSIVQHENSVEVTVKDGKAFRARKVIATIPTPAIRPIEFYPPLPLAKQAWIDSTTYGYYTKAMMVFKTPFWVEKGYCGLIQSFTGPASVIRDTCSEPDKKYVLTCFMGSDAGRAWSALSTPDREKTLVAQIGKLYGAEKEAQRDFVEMVTYEWTKDDFAGWGCPCTALTPGVLDLLGGDALRAPCGNLHWAGTETAGEWKGYMEGALLSGERAAAEVVTGLSHVNSRL

SEQ ID NO: 3191 - protein, 316 aa, Unknown
  Kingdom: Fungi, Phylum: Ascomycota
MPPRLAPSLRFPILRRLYSTAADSGPLIRVTNLPAPGSGHIRILELNRPSARNAISRSLLAALRAELDDLHQQYTPEGNEAPHAVATSNGPTRAVVIASAVDTCFCAGADLKERKTFTQQETADFLSNLRDTFTSLSVLPIPSISAISSIALGGGLELALTTHLRVLSSNAVIGLPETRLGIIPGAGGTHRLPALIGISRARDLILTGRRVAAPEAYFLGIADRLVEAPQPEEKSEGGEKEDGLSLARRAALSEAVRLAQEICEGGPVAIRAGLEAVMWAREQKENEMYERVVATEDRNEALKAFGEKRKPVFKGR

SEQ ID NO: 3192 - protein, 503 aa, Unknown
  Kingdom: Fungi, Phylum: Ascomycota
MSSDLFKELTAPNGRKYTQPIGLFINNEWLKSSDGGTIASVNPTNEETITSVYAATEADVDKAVNAARAALKNPAWRDMPGTERGKLMNKLAHLIEEHKETLATIETWDNGKPYVVARDEDMSESSETIRYYSGFADKIFGQVIDTTPAKFAYTVREPVGVCGQIIPWNYPLSMAAWKLGPALACGNTVVLKPAEQTPLSILFFATLVVKAGFPPGVINIVNGLGSVTGSAIASHPGIDKVAFTGSTATARQIMKTASVNLKNITLETGGKSPLIVFNDADLENAVEWAHIGIMSNQGQICTATSRLLVQSGIFDKFLSAFLAHVKAISKVGDPFDENTFQGPQVTKAQYDRIMSYVDIGKQEGAQLKMGGEPFAPSSKGFFIKPTVFTDVSPQMRIFQEEVFGPFVTITRFETEDEAINLANDSQYGLGSAIFTTDLTRAHSVARQIEAGMVWINSSNDSDYRIPFGGVKQSGIGRELGEAGLSAYSNIKAVHVNMTVRSRI

SEQ ID NO: 3193 - protein, 989 aa, Unknown
  Kingdom: Fungi, Phylum: Ascomycota
MGLRKDVADQRPRKRVDQRYQWLNHFNAVDLKIFARCWVAVWVMMLLVFIQPSLDHIGIAAFLGAIVLFIAPPASTVLIYLLAALSLLLGMCLAWAWGLLTMKAALASRPDSETNTQLGELQQQAVAAANQTGQTPAWEAQILVHKGVMLDTRVTVIYYVMGCVFIYAISRLRCANPKFTLTQIFGIIVTDIFMEVGPSLPNFMGSLASVLVKPGAIGIGIGTACAILLFPQSTSYMALGLMEKLTRMVDSTLITTRKRLDHDPISAQEAKAIRARMIATLKAVQPYLAFLPLDLSRGVWNADEIQSLQDRIRKLVFASVYLIDFHIGRLNADEMLKERTESASEDDDSSATKHEANQVGQRHRKEASKLLAALHRPDQNSIREETQRAMKDSTGDVLQLSSDAVRLAADCIKTANSCRWFAKPKPARFHELIEQLKDTRERLRAAREESVSMSAERVLDAHGNLFDEKGMIKMGPNHEHPFLPSMVIAMVLEERICATATAIEHLLGKLEQLCATRTAPRIWLPTRLQYAFSWLKSGSHEVPGAGTGGETEPDFNKDPDEMFESTEEVRRRLEISRVIRGSVRRNKLSRVLSAAYHWFTNPAGMYSLRMVIVTIALTIPSSLSSSADFFYREKGIWAVISAQTALLVYMSEFTFSLLARTLGTIIGGLMGMVAWYIGAGNGVGNPYGMAAITGVMLVPLIWWRLFLPPAFAYAVIMGGATFALVIGFSWDEGHILQYGLPGRGYVAFWKRVVTVLIGFLAAFIVQIFPKPPSATKHACKTLANSIRSLSDHYALLVSHWGRSDENSHALGSVSSQITLEVAEVLLSLDPTIANLKMELDSGPFDQKTLKEAQEQCQYINQALGGLLQLASELPLEFQARLAQTTGIKDDRGIGDIMAVLGILEQALRTGSPLPERLPAPLVARAVETYLTLGDQDPTTYSEPAGDEHHRRYCIGVTLYLKFLTSVDDMLLVLKSALGERHVVYQWEEA

SEQ ID NO: 3194 - protein, 482 aa, Unknown
  Kingdom: Fungi, Phylum: Ascomycota
MAPKAATAKKPEYEFLGPPGAFAISFLLPVLVYFMTFACNDVSGCPAPSLLSPRSLSLQQLKAEVGWPADGIWGLGSWKALWASLAYIGLSLVLYRVLPAHECEGTELRSGGRLKYRFNTLSSAMTTFALLGAGTLAQGAEFPVWTFISDNYVQLVTVNLLISYALAIFLYVKSFSVKPGNKEKRELAAGGQTGNMLYDWFIGRELNPRVTIPWIGEVDLKEWCELRPGMMGWAIVNWAWCAKQYRTFGYITDSIICISAIQTLYIIDSWWNEPAITTTMDITTDGFGMMLCFADFVWEPFIYSLQTRYLAHHPVTLGPVKLAMMFALIGIGFYIFRSANSQKNTFRTKPDDPSVAHLTYIETKTGSRLITSGWWGLSRHINYFGDWIQSWPYCLPTGVAGYQILAAGTGADGAIVMRDGREVVQGDAKGWAIPIAYFYVVYFAILLLHRERRDDEKCHKKYGKDWEKYRQTVRYRIIPGVY

SEQ ID NO: 3195 - protein, 335 aa, Unknown
  Kingdom: Fungi, Phylum: Ascomycota
MKDSNNQPETMSLDSPSTDSQFQPMSSPTSTHDSPLSHDSDDIPETRKFPRQKKGATSAGPTIRTERIARRSRSLEKANAMGFGANSNSSGTHRVSKKKRSGERSSNNKGNGNRRLKYEGAGISQGEEDSYDGGCGDGKTAPEDLAWVSKVVQRSCDYATNRHSLVALLEPSPLLGKWSPPSRRASPPTPSDAAKLHLAGSGKFGSRELQHRLVALTKQRPETSVSPSATGAPLDNHRGLASLREKRTGVAKMNVAPSALSRVDRQPGKLSTLDAENHAPALHDPAGQCHDLPAFLSALTAWSIRLTICKQATVGWTGARSPISKRTTALGGMAA

SEQ ID NO: 3196 - protein, 475 aa, Unknown
  Kingdom: Fungi, Phylum: Ascomycota
MSGTDMPSGADMPPPEMPLPEMPYLPGTPEFASWAAEDKGPSSVAICWTFTALAIIFTTARCYTRLSMFHSLKSDDFWILLGLLCVILSSIFNTVSVDYGNGQHYQFLSIHEATEARRYTVAAFVPGSLSFVVTKFAVVQLLTRLLNPSRAHRMFLWSMCVLLLVSIIIAYGILFGQCDPVEALWDVTLIPVMECLDPRIYVNWSIWCGSLSAFIDLYLAFYPGFVLWKLQLKTQKKIALTIALSLGCVGGALAIYKTYRLPGGLENPDFSYETADLINWTIVEACAIIIAATIPVLSPLMDKLFRQYNPFASSRRSSHKHSSKGHKYYHGHGGSDNSDHRAMDERAPRHAPRDPYDIDMDLAETVVDNSDEDLTKYKKSDDLEAQRTMGHTRQSSSSSGSTQIADDEHDHGMRQAAGSPTSGIMRTNEVTVSIDPGRDQHMARLDQEIPWETPVQSPIIPPAQARAWGYTRATR

SEQ ID NO: 3197 - protein, 1028 aa, Unknown
  Kingdom: Fungi, Phylum: Ascomycota
MLRHRNQGEGDVEAGHTAPGAPSRSDSTGESPDEKGDALGEYPALDRYISTYRDPRDQLEDDNGKSKKRPKWWQFWKSGPAEAPADPSKKKSDTPDAWLETDLDHGLRASEVEERRKAIGWNELVAENENMFVKFLGFFTGPILFVMEIAALLALGLQDWTDFGVIVGILLLNAFVGFYQEKQAADIVASLKGDIAMRCTVVRDGHESEILARELVPGDIILIQEGDTVPADAHLLCDYERPEDFQIYKRLKAEDKLGSSMSGPEDGEEDDHDDEPPENGKRLSVGGQSRRRSSVAPVSNYRTVPLVATDQSAITGESLAVDKYLGDLVYYTTGCKRGKAYAIVTSTAKGSFVGRTADLVQGAKDQGHFKAIMNNIGTSLLVLVLFFILIAWIGGFFHHIPVTEPGSQNLLHYALVLLIIGVPVGLPVVTTTTLAVGAAYLAQQRAIVQKLTAIESLAGVDILCSDKTGTLTANKLSIRDPYVAEGQDVDWMMAVAALASSHNLKSLDPIDKVTILTLKRYPGAREILQQGWKTESFTPFNPVSKRITSVCRLNGDKYTCAKGAPSAILKLTACSEEERKLYKQQASDFARRGFRSLGVAVKKNDEDWVLLGLLSMFDPPREDTAQTILEAAHLGVPVKMLTGDAIAIAKETCKMLSLGTKVYNSDRLIHGGLAGTVQHDFVERADGFAEVFPEHKYTVVEMLQQRGHLTAMTGDGVNDAPSLKKADCGIAVEGSSEAAQAAADIVFLAPGLSTIVLAIKTSRQIFQRMKAYIQYRIALCLHLEIYLALSMIILNETIRVDLIVFIALFADLATVAVAYDNAHWEPRPVEWQLPKIWLISVVLGCLLALGTWIIRGTMFLPNGGIVHNFGSVQEVLFLEIALTENWLIFVTRGGKTWPSWQLVGAIFAVDVMATLFCLFGWLSGQPEHTSIPDNFKQRSDGWTDVVTVVLIWLYSFGVTVVIAIVYFILNKVSWLNDLGRKKRSKKDTMVENILGQLQKLAIEHEIDEKTGVDRYLLAEKATDEDDDM

SEQ ID NO: 3198 - protein, 309 aa, Unknown
  Kingdom: Fungi, Phylum: Ascomycota
MSSGLLDLITKVDNVPLDFQQNFHPYYRLFVTPNPHPHGYIHPKTISSLSWPPSFAIDHTARTVTLHTPHTAEAINAAFQQVIDQAIESSAFPSLQIHSESFLIPGLSNFPSSIVHIERFASSLFGIATRGAHLTAYLPATASSPLKIWVARRSRNLIAHPSLLDSSVAGGVKATDSPLECILAESHEEASLSREFVANNVRAVGTLTLANRNPKTELFHAEILYVYDLEMPADVIPVPEDGEVEEFMLMESGEVIRRMLAGEFKPNVCGIMIDFFIRHGIITPDNESDYVDICSRLHRILPMPTKPDQ

SEQ ID NO: 3199 - protein, 701 aa, Unknown
  Kingdom: Fungi, Phylum: Ascomycota
MAPTSRNPATWNQYEGRASPTASTTSLTPSARDEESALLDDGDDVSPRRHSSNPDLAGRRRSSVTNHLAAIADIGGVNSLASFARSWQRAVGFQEVIPRRPSFVYADESGPAIPEGIQYGRSHVEPTTPGPETSLLRRHLEASPPQNGTTSSAAEQQLRASIGYGASASENDGFRERESKAFDAEMASGALQTTTSHGSPSTRDSIFNIPPHLSEAPIIGSYGSWRSSHYGTIGGGSLRARSRTSVGDIWPAAAEDEDGEEDAAHGEHEPILVREVKQGDKVILTVEGQSTLPQSVFNSINAIIGVGLLSLPLAFSLSGWIVGLFLLTLTALTTAYTSKLLAKCMDYDASLITYSDLAYVSFGSRARIVVSALFTLELVAACVALVILFADSLYLLLPGVASVNAWKCVCALLVLMLNALPLRFLSYTSVIGIFSTFCIVCIVIIDGLVKPTAPGSLWEPAKTYLLPSNWLAVPLAYGLLASPWGAHSVFPSIYRDMRHPHKWGRAVNVTFSFSYVLDTCLAIIGILMFGDGIKDAITSNILKSGGYPQFLTVLMCICVAIIPLTKIPLNARPLITTADVLAGIHHNQHTHPHNTNNATASRRTEILTSLIRFSIRLTVVAVLLCISILFPAFDSVCAFLGAALCTLISVVLPISFYLKLFWKDVTARETIVLLALLGLFAVFGVVGTIWTFLPKELIGIA

SEQ ID NO: 3200 - protein, 457 aa, Unknown
  Kingdom: Fungi, Phylum: Ascomycota
MTEPNTSTTAAAPAPAPAAAAPKPPVKAPVENPAYRMLGLPKLPKKLPSRNWMIFWTLTGTITTAIIYDKREKNRATAKWRRAVAPLAEEPMPSATHLPRKLTIYLESPPGDGLRIAQDHFIEYVKPVLSASGLDWEFVQGRQQGDVRAAVAEKIRMTRRETERPDEELPQTDDTLLAKMRKRMNVPEYEGAKGDIVIGRHTWKEYMRGLHEGWLGPLDSPAPPVVEDKPAPTETVTPDATSTEGEVQEEKKEEPKKETKPTRPPQPIPYNKPEDYPSAVLPAQIPDEFSPSTQIPFPHRLGFRHTFVRLGWFFNRRKLADDIGREVAAVCFAAARDYRTADGQYEQQLVLQREESDWPKSVWKDEVPEKDEDGNDKPLPPKEKIWISPIVADDRLMQRMRKFEITPEDEAKAAKIKVPEEEIEGWIKGSLRGVWRWGAASWASKPRGPNVGNLDDE

SEQ ID NO: 3201 - protein, 351 aa, Unknown
  Kingdom: Fungi, Phylum: Ascomycota
MPIIVKEKSEYTPLDPNYKPTGKNAHYAELDPIFATLKPAIDSGLDAIWNPESSIEEFRAAWSGNAPSPAGCPVEGEDVVTEKRMIPMRDGVEREICIYKAKEGSGKKAVVLRCHGGGWVIGGPNTEHPESLMLAGKTESIVVVIDYRMAPEYKFPYAVNDCFDALKWCHQNAASIGGDSSKLIINGGSAGAGLATVAALQARDEGIPLIGQVLTWPSVCHPKFQPKDKYELESYQQNHFATILTAPRMEWFLDAYMPEPTDDWRLSPLLAPSLKGLPKTLVTVAGYDILRDEGLAYIERMKSEGVEVEHKVYKGFPHCPYGMAEHPEIIDYYNRIVEFVRKTSETAPGGT

SEQ ID NO: 3202 - protein, 233 aa, Unknown
  Kingdom: Fungi, Phylum: Ascomycota
MVTKEYRGPKRRFYLSPPDPDISTVRRSITTYVPPEPEPIWEPPREPTPPPPPPPIVLPLPPPPPPPPVVEPEPEIEVISVDVEPEKRRRRRRSRSHSRDHHHTREVYVERERVVPMPYPVYRERERRVEVPVEVPVEVPVEVPVEVKVPYAVHHHHETVKYLPPPPPPPRKVIEEEDRTKVIHDRRIREYWEQPGQDNCHRQYYEEPRREHTHHEYWEEPERRERRRYYDRC

SEQ ID NO: 3203 - protein, 735 aa, Unknown
  Kingdom: Fungi, Phylum: Ascomycota
MIEIGDAIKFAELAWVVLDYGWSPDLNATRQYHEFFRDVECLAQSLEHLTSVIEAARQSFSSRRLEPPPPTFGWDRQSLVEIVGDFNATLRECERLIATNESYAAASGPVKNVRWNAMVMPSVERLRRRILMHQSKLQHLLRPFEIDLHIRLHSDLVQRIDNMHEDVRHTQIDVRTIRRQMEALRRFFDPDALLETETGSQDATASTLLMPTTVSETLERMLSLHLDRYLDEDGTSALSDLADAFIRHLDVALPRSPNDEAFAEENDSIVKQYIYLLICQFLMSKMEASEDVLQAPKDSHWPRYVSSLHQQLQNACTIFNQVNGVDFIPNNISLLEIPEIWQEETPAPYIECAAIPAAIDHVLELDIVNETPRRWRKINLFRYRDGADRRFRLDISAGNTGQPAAETRPVDFDLESASLVPRYASPTGEEPLEMTLKKRDEMFRLVFFSRSDLYLFQQALTGYEVADDYMSYRVKTIFSVNSNIRKIKEFAALQLWLPSRLEGVRAPDADSIGEEHVGQVDTQFLGHQKYDCRWVVSNSPRFTKCRFIFVPAQGFNWPRDQTHLPHGLTIIQLDVLNRNHATPERWPPRQLQRTKCQHHGNLHVNSDREERIGSVVGAPMWWDILSLAESMKGRRSSMESSGAAGGGSRAWQRVIRVSMQFETLDERKRFAGQPCTCEKKLQGQLMACLSEGHRGHLGAVREIYRRQMVDWYQRRYQQQVNMVDKPQKLGPENDW

SEQ ID NO: 3204 - protein, 446 aa, Unknown
  Kingdom: Fungi, Phylum: Ascomycota
MPATKNETQPQLLFVDGSFEELAAEMADYLKAEDAKQLLEKDPKKDEVLAKLVASAAGLNTVPEKEFTAASNLMIHLVMQSADPKKYLPSLCSVLAKPLANSPTHGPALSLNALTTVFNLLEPSSPIRARVFMEILKFLKAHALFDALKPYLEKMGGWFEEWDISEEMQQQIYEEVAEVALESGEETQAYEFILRALRTLDADDQEDLTSEDAQRLSLRAVKMALLSPTHFLFQDLRAVPSVQALSDTHPIYSQLLDIFAEQDLEDYNDFNEEHEGWVDQQKLDHERLHRKMRLLTFASLAAATPSRELEYTRISKALQIPSEEVERWAIDVIRAGLVEGKLSQQRGMFLVHKVTYRVFSQTQYRELANRVDHWRSTLQNVLGVLRNEQANAKSQREREVQELERKMNGIGMGGERMGDRRRGNQQREPREPREPREPRERNDNED

SEQ ID NO: 3205 - protein, 392 aa, Unknown
  Kingdom: Fungi, Phylum: Ascomycota
MAATRTLEACLEHLTVSDENESSYSRSKNIVTTTTTALPQADSKPNIFKVALKSQTSNAVASVNRPSQAAQQKAAPPSPSRKLIGSGTTRKSEETIEEYKGISLTAYQPSIPKQFHLGMFEIGRPLGKGKFGRVYLARERTSGFVCGLKVLHKNELQHNNVEKQVRREIEIQSNLRHPNILQMYGHFHDSKRVFLILEFAAKGELYKHLRRENRFPEWKAAGYIAQMASALRYLHRKHVIHRDIKPENILVGVHDEIKISDFGWSVHAPNSRRKTMCGTLDYLPPEMIKPGTKDNYYNEKVDLWSLGVLTYEFLVGEAPFEDTPVMTQRRIARADMSIPSFVSPEASDLIKRLLVLDPEKRIPLEQVAQHPWIVKYCVKGERATNREKLSRS

SEQ ID NO: 3206 - protein, 188 aa, Unknown
  Kingdom: Fungi, Phylum: Ascomycota
MSSQRRGVLSQAWFRWKALRLPWRRRLLVGYDLIGNTYWEFRPRGVERWRRIVDYPRSTHYSAVKVSPLWHQWLRYTREDPPSIEEQQKEVVRQARMKHLASAADARWEAKPKLTDAPGAATGQRAPTIGAGEHTEAASTEPVANTATTAQNTHQDAKKADPWARARQEGPGEKWQPAAWTPSPSKKT

SEQ ID NO: 3207 - protein, 864 aa, Unknown
  Kingdom: Fungi, Phylum: Ascomycota
MPVTQSSRDPMSSRGDHLDGGPGLARKRKASGIGRDDNAKSVLPNATSRAAETPKGDENGTVPEALIPVTPVSGLQPMNTGDTSAWEGAQTVAPPVEQFVPSNLLDQPNNSMILQPGQMDQSMEWFALNWLSPTAATHADGFTQPGLADGPQMFDYNFPPSVPTVDQWVWSAPTAQPPAPEDSNVTAAYAATAPAVRYSNLAAGSSPSDEVTEAIDESQVSGATPATLYVDGGASRAPFKGLSAQRGANVHDEDSDASQSPTSKQTKGSLSPQASVNLLHQLKTLVSIDQLRGGCFPTQHQLETFFRLYFRYFHPSFPFLRPDSVFYDDAVKCPLLLAVCATGAQYCCKPDSALTRELLVDTLRRTVSEGHAFNRGQDYLSSDSDSMQLCMLQARILSLICQFYTTAQPSPNTTSIDIFKLVQSCRDIGLLRGDPSFKSLSRQSSSPDEVWKSLQSKLRTGYMIWLLDSLLSIENGTETLLSLGDIQCSLPCREFAWERPTMRAIAKDLAHPVDFLDAMEMLYIEKKLPKGLDEFGTIIMVHVIIQRTKAVVKQYQTGLASWVPSASSQKRAPSRRVDETWPPCLPILSRWRNSACDCLDVLHWNANSISARDGGWEPFTIFHLHLSRLILLTPCTPLRSVVARSDRMEQKTSSERSRSQILRWAREDQYKARLAVIHAGALLWHVRRYSINSPVEPFGIYMATLVLWGYSMASTTGDQNVVPQEASNDAAAPAHQSASGPSPASAPSNQSVVRSSSPLSGLDEDPEEMQFYVDRPCDDEIVQAYVRYGSKMTGRLSHVGDICHEDAPRKILAEGERILEARQRTGKHHAGSGSCPSGPGGPLAWGITAHYLKILQDFSQLYTA

SEQ ID NO: 3208 - protein, 196 aa, Unknown
  Kingdom: Fungi, Phylum: Ascomycota
MSTTPTGSQHGGNHDTEPTTPRGPPPPDDRAEAAQERHFDARLQQALDDRPSGSAPPDALQRSDKQGLQAAERATSEPARFDMMMPQRQNGRDTPSTTSQLPDFDWEDFEARYERALEDADEHEGEILKEAESLSKYFRAWASAASVQDNERAVKRLQTRQRFVNISEEKMAQKQQHYEEVVKAFESALALLRSHS

SEQ ID NO: 3209 - protein, 165 aa, Unknown
  Kingdom: Fungi, Phylum: Ascomycota
MTNSITSVPFLQREPSWHANVDDVDSTRGRTRVRNLSRSNVSKSINPEESSTLRGRSRRRAASPSGLGSRNASPSVGSILYYKLKESSRREHCPSRPASSSSTRRQNSPRRRQQRTRSTSRNAPRAAVEAKVVEMQLQQQSSSLRNEVLREDPPGQSLAASELQT

SEQ ID NO: 3210 - protein, 943 aa, Unknown
  Kingdom: Fungi, Phylum: Ascomycota
MDAGHDSLVTVRLSEPPILTVDTTLAEAHEQQPLRPATIMSPHDSPMTDTSGADATAETATPRDSLAQLSGADASRTLEEELGSCADEDESRPSFSSEEQDEVNWEQLEKTEDEQTKDEETDNSTALLLARLEQENAKLATNPKSVKVDAVEQLSSSKPRPPSMAQLRLMVTGPTPPSLRYSMLPPPPMTDLEFYAALVKDYQQTAARLPTLLSNKIRKGIPPPLRGVVWQSMSGARDASLEDQYDRFGGESSPYELIIGKDLGRSFPGVDMFRDPDGDGQRMLGRVLKSFSLYDTKIGYCQGLAFLVGPLLMHMPDKQAFCVLVRLMERYDLRSCFLPDLSGLHVRIYQFRELLRQLLPELAAHLEELQVDPAYVSQWFLSFFAVTCPLPMLFRIYDVIFAEGASETLMRVALSLMRKNEARLLACTELEDAMQLLLSRGLWDCYHYDADEFVQDFASLTGEVSREKLSHLEQGYRESLIATANNVRTSAITTAASRFLGRIWATSTVLSPKSTLSPGLAAPSRPLSLLRRSTSKQSIASTLNSMEAGSNSILSSTSTDATHMSRDSVNTEDEPGSRESTPVAPKAVAAIKTADDRHLHSQIEDLLTALSELQRDHALLSSQLQRERENREEDRKAVQTLLGAVKRERDGTAKPTEETEAANDANSDEATPTEPTVDEIVEQVENRFYVDGKRPRSSLMQTKLQLRDELANAKDQLTGAMSQSQELSRRINEQDQELATLKDQVRESHAHVRGLHQDKQRLEKQVHNMRARSSSVSANEVAAREGGADWGAKSASGGLRELKLGRSKSSPSQPAGFNRRISSMPRGHESLVPSVTASSAVAPTSEHDGLLLELVQAKTAEAIAKQEAEEAKQKLEAFRKAYGIAPGDTPNGSSTGPAGAAMGVFGRLTGQGTAIPTSESQPKLAATAGAGNTASGGFWGWRR

SEQ ID NO: 3211 - protein, 416 aa, Unknown
  Kingdom: Fungi, Phylum: Ascomycota
MVPPSTAASSRPVTREGPAPSQFSQPPPTPSVLTKDRERKSSTYSRRASFSSQRRRASTATSSSDAIVTDATAPPALPYYALAAAAKVASQQGREQDVIQSGEALRSPAFPEVPGDGWGPRMLSRTATNTSNGERPPTTPGGSLAPGTGFWAQHEAQVVHQQVVDLANKRINFLDYLRKAHEGRRYWFNTYLFDKPDLARMPLFDPRKMSRKATNYLLLGVSLPVVVDLYASNAQEFLRSMNQLLAEFDSFQQLHSDSASRNRLPNMFRRPGVKSRRSTSNTDVHSVAEESLAGPSPGGLNTAPASVMNFAASESDLLPGEEYTHLLTPALPFEPDYFETFATLCDVLIDCYTRLLNLMPTPRECSSQLAEQFSKMDGKIKKLIFQGVVKEFEDHSRSSIKTEVANIGKVVLSGLM

SEQ ID NO: 3212 - protein, 120 aa, Unknown
  Kingdom: Fungi, Phylum: Ascomycota
MSFFKRLFSGPSPEAMANAAEKAQKLIDENNAIVFSKSYCPYCRSTKGVLNSIGADFKLIELDQESDGSELQDALEKISGQRTVPNVYIGKKHIGGNSDLQALNSKDELVTLLKEAGAIA

SEQ ID NO: 3213 - protein, 544 aa, Unknown
  Kingdom: Fungi, Phylum: Ascomycota
MAAPRPEEKFSSHDDASAEHQPVQHSEYNLANEHDQLARGLKSRHIQFLALGGAIGTGLFIGSGAILHDTGPAPLFMAYLTMMIVVWCVMNVLAEMVTYLPMRGITVPYFVGRFLDPSLAFAAGWNYWYAYAMLVGAEATAAGIIIEYWKPPVGIWLWILIVLLVTLALNIIAVSVFGEAEFWFASIKLITIMGLIILGLCVAFGVRQDGPRGFRYWNDPGAFAEYNASGATGHFLGYWHAVVAAGFAFITSPELIAIAAGETVAPRRNIPKAARRFIYRLAFFYGVTSLIIGFMVPYDDPRLLGGSDASASPFVIGIKNLGISTLDHIINAAVLTSAWSAGNSFLYSGSRVLYSMSLDGNAPKFLARTNKQGVPWVAVLVTWAPGLLAFLNVSNTGAQVFTWFVNISTISGYIAWIVVLATYIRFRKAMEYNKLLDALPYRTILQPYASYFFLGFLCILTLTNGFQIFISGNWDVRNFIAAYITLPIFLVLYLGHKVYARTKWAIPIHEIDVITGKEEMDRLAELDEERVPKNFLQRFWYWVA

SEQ ID NO: 3214 - protein, 589 aa, Unknown
  Kingdom: Fungi, Phylum: Ascomycota
MASPNVSDKEAMSDMKHLGVEKTSSFEQGEVAMPATRRGLSPRHVQLMAIASGIGTGLFIGIGGVLRNAGPLPLLVGYIIYGLGFIWPTGLNVAEMLSWLPIRGSIFELAARYVDPALGFAMGWTYFFAGAMLVCTEYAAVAAVAEFWDTGLNPAIWVAISLVICYFLNMVAVRWYGETEFIMGSTKILLLFGLILATFITMVGGNPRGDAYGFRNWANGDFAHPYYTTGATGYFLSVCISVRYAVFTVAGPDILSLAAGEIRNPRKTIPRTAKLIAARIISFYLLGVLAVGIICNSRDPRLLGAIDSGSAGAAASPWVLGLLNAGISGFLPHLINAIILMSGLSCGNAFLYAASRTLYSLAQDGMAPKVLLKCTKAGVPWVSVTLVTVISLLTFMTASNQASDVFQWFLELTTVALVVNFTAMSVVFIGWCRALKAQGIPRVGRNTLQTSRRCGIFPRKVVEVPDESTGGIIFPYTAPASSWTPYTCLVLGSTVTIFIGFDVFHPFSYRGFITSYFGLAWFVVMFLFWKIVKRTKVVDPAQVDIYAGGLKQQIDEDCAIWEEGLADEAEEERIRKMNFLSRAWVRVWG

SEQ ID NO: 3215 - protein, 725 aa, Unknown
  Kingdom: Fungi, Phylum: Ascomycota
MFLAYIPPPILDPRLKTPQGKVAELRLELNSGGKKDKNYAGKKVALKKIVANMTMSNNDMVALFPDIIGCMHIQSLEIKKMCFLFLVNYARMKPDVAVKAIPVLELDMEDSNPLVRALALRTMSYIHVREFVESTVPIVKHMLRDSDPYVRKTAAYCVAKLYDHDRGMVESSDLIDRLNSLLRDDNPTVVASALAALMDIWERSDAIKLTIDYSNASKMVAILADCSEWGQTYILEALMSYVPQDSGEALLLAERIAPRLSHSNSSVVLTCIRVILYLMNYIADQKQISALCRKLSPPLVTLLAKGPEVQYLALRNALLILQRRPEVLKNDIRVFFCKYNDPIYVKVTKLELIFMLANEKNIDEVLTELREYATEIDVHFVRKAVRAIGKLAIKIEPAARRCINLLLELVATKVTYIVQEATVVIRNIFRKYPNQYESIISVLCEHLDSLDEPEAKAAMIWVIGQYADRIENSDALLEDFLYSFSEEPVEVQLALLTATVKLFIQRPTKGQELVPKVLKWATEETDNPDLRDRAYMYWRLLSTDMNAARQIVMGEKPAITAESERLDPATLEEMCLNVGTLATIYLKPVQTVFRSARPRKLIESPALQKQNIPAADTQKSISMFGNGAKPTDIDTRTRNAAGVENGSGAAGNGALSPQAVNDADAYFSSVGSTQQQMAAMRIDGGDDLFGGGGGGGTGYVVSAHAPQAVMQPAQGAGSNGDLLVL

SEQ ID NO: 3216 - protein, 567 aa, Unknown
  Kingdom: Fungi, Phylum: Ascomycota
MSLSRPALRLGRLPRTSRSTSTSITTTVQRRSAASLTPPHHSSSISRIPTSVDTSSPEYLDNHASMTTTMRNLQELSLRVQKGGSDKAREKHLARNKMLPRDRVTALIDPGTTFLELSPLAGHELYPEADVPAGGIITGVGVVEGVTCVIVANDSTVKGGTYYPITVKKHLRAQAVAQENNLPCIYMVDSGGANLPHQADVFPDRDHFGRIFYNQARMSGAGIPQISIVMGPCTAGGAYVPAMSDESIIVQEQGHIFLAGPPLVKAATGEVVSAEDLGGGKMHSSVSGVTDYLAVDDAHAITLARRSISNLNWPTSSSTTPTFAEPLHDPEELLGIATTNLRKPLPIREVISRIVDGSQFSEFKRDYGSTLVTGFASIYGHKVGIIANDGILFASSAQKGAHFVELCTQRGIPLIFLQNIAGFMVGAASEREGIAKHGAKLVTAVACADVPKFTVVVGGSYGAGNYGMCGRAYSPRFLWMWPNARIGVMGGEQLAAVMETVGKQVDPELKERIEKESDATYSSARLWDDGIIPPQHTRRYLGLGLNAAMGGRNEVKPGETKFGVFRM

SEQ ID NO: 3217 - protein, 610 aa, Unknown
  Kingdom: Fungi, Phylum: Ascomycota
MAAPTIALERILAAVPATTRGQPTPLSTDSKGKRIAYASGKSVFVRSIDDPSDCKEYTGHTAATTVARFAPNGFKVASGDATGMLRVWEPETIESTRGEYGIISGRLTDIAWDGESQRVIAVGDGREQFGRCITADSGNSVGEIIGHSKAVNAVAMKAQRPFRAVTVGDDSNVVFYHGVPYKFNEKTTLHKGFVLGAAYSPDGSSFVTVGADKRIQLYDGKTGEPTKQVGDGEHTGSIFGVAWSQDGKKFATASADQTVKLWEAESGGLLQTWQLGDGADVGNQQVGIVIPYGRTDGLIISINLKGELNYLNEGKDAPVRVVNGHGKGITALSAGSDGSGSTLISGSFDGRVCQWDLKTGLATALDGQAHTNQVTQFAGVSGRTYSTGWDDTLRTVDESAKTFLGDAVKLSGQPKGVAAAGSLLYVATAGGVAAYSDGKLVKETSLSFTPGAIAASGSLVAIGADNNAVKIYTSDSSGALQETKTLTNPTGTISTLAFSKNGEHLAAGNSVGKIYVYATRSWDLVADRWSAHTARVTCIAWDDSGAYAASGSLDTNVFVWCLEKKNQGKRIKAANAHKDGVNGICWVAGGKVASAGGDASVKIWGVQNLP

SEQ ID NO: 3218 - protein, 918 aa, Unknown
  Kingdom: Fungi, Phylum: Ascomycota
MAEYGKMDPFSFAGSRDVDHPISIRIIDLEGDEPPLKASTLFERPDLRHIGSNTSPHSDLYVTVQVWAGSKPLTVPMQTAYKPFRSERRWNEWLHLPIDYDSLPADAALAITIWDLSPTGGPKAIGHAIPFGGTTLPMFDDDNQVQKGRQKCLIHRHNHADGTVDTKTPALVLSSRLGKNAARRGETPAIDKDTEELDRMEKLFKKHEMGEIPRVDWLDQMVFRKFEKKGLQAAKSSMKMQQRQQALSGGDQKASGNGPDDGRPGVSTFLLNVELPRFDLPVVFADHEYKPPPISAFQNLSVSQGNIAQREPQVQYGPGINPTGDAQGDYSSGLIKVYDPEVGQRDNPAEAKHRRLFRSSHRHGILDKDLKPNAKVRDELNLIMSYPPTHVLSPEETDLVWKFRYHLTRDKRAVTKFVKSVNWADQSESKQAIQVLSRWTEIDVDDALELLGPSFSNPGVRSYAVDRLRKSGDSELLLYLLQLVQALKYEHISTDDEQDSTKDSSLARFLIQRAAANFMLGNYFHWYLMVECDDNSPEQGPENQSIYRKVAYEYMVELVKHDDGVEDRKTLLRQAEMIAILSKIGTDVKNSNESIAKKVERVKHFFADPKNELLVFDPPMAMPLDPFVQVTGIVPDQVMVFKSSLNPIKCSFRTTSGALYPIIFKIGDDLRQDQLVIQIITLMDQLLQKENLDLKLSPYKILATSTSAGASQFVQSQSLSSIVGKFRNNPALAYLKHHNPDDRQPLGVRQEALDTYVRSCAGYCVITYILGVGDRHLDNLLLAPDGHFFHADFGFILGRDPKPFAPVMKLSKEMVDCMGGVHSQHYRDFKQYCFLAYTALRKSSNLILNLFSLMVDANIPDIRLEPDKAVLKVRERFHLELTEEEAILHLERVIEDTLTAFAPVVIDKLHEWAQAFRA

SEQ ID NO: 3219 - protein, 536 aa, Unknown
  Kingdom: Fungi, Phylum: Ascomycota
MPPPRGTGLITRFTRPHTSLLPRTTTILTHHQRRLFTNNPKTSASVSSTRVTDSQSPPPPPPPTYSSKDKNASGEAFYPGEPSGPTVRTEIPGPKTKELIEDLETVFDTRSLNMMTDYDSSVGNYIADPDGNVLLDVYAQIASIPLGYNNPELLKACSSDAMHSSIINRPALGNFPPSNWANLLRSGILKVAPPGLPHVFTAMAGSDANETAYKAAFMYRKQQERGGPEVEFTETEMAEAMDNKGVGLSILSFRTGFHGRLFGSLSTTRSKPIHKLDIPAFDWPQATFPLLKYPLEDNIAENEAIEQAALDEVEHLIKTHHLPPAAMIIEPIQSEGGDNHASPAFFRKLRDLALKHNVLFIVDEVQTGVGATGKFWAHEHWNLETPPDMVSFSKKAQAAGYYYRDKALRPNKPYRQFNTWMGDPSRAILFSSIISEIERLDLVNHTARIGSYLYGKIEALSKKYPEQFQNLRGKDRGTFIAFDNPKRDEFLKIAKTLGVNIGGSGAMAVRLRPMLVFKEHHADILVETLEKIAKML

SEQ ID NO: 3220 - protein, 333 aa, Unknown
  Kingdom: Fungi, Phylum: Ascomycota
MATKRPNDEGEEPDPKRQQLDSVSITPGVIHLSAWKPSDISTDLPPLPVPANPKLEQAAFTHISLNNTENYEDLEWLGDAWIQAISTQLIYNTFRGTFKTGRLSQLRESLVCNRTLGSFLRAYGLQTRLKLPHEITESQGPRERAKKKSKDPLRPLEKVHGDCFEAYVGAILESDKENGASIVADWLRKLWARELQGEIRKYARGSDAATASGRPSEQDGDSTSTPADTPKLNPKVLLTQAIACPGVSLNYKDMPGKSKTNNMGHSLFAVGVYYTGWGTRDELLGVGHALKKTEAGTKAAEAALKNTQAIKRLSDKKQAFLKAREEAEANANP

SEQ ID NO: 3221 - protein, 554 aa, Unknown
  Kingdom: Fungi, Phylum: Ascomycota
MTDSKHPQGPQDPAIAPYGDLPPPPPGPPPSQTQQPQVASDSHPNPLNANPALVMDDQQRQQQELLDYYSQQHQQRLQGGVTTQAQPLQVTSDDYRPPQPPRPTQPQDSQQQYTIPQYNPADPAFANSPVNAIPQDTQLNTSAAATGPATGHPTSATPISASPTSLTEDENKGSKWSARFSNLGIKAAAPINQLAHKLGSQSFLPETMNKECDKAASILQSFCKSGVYADPSTNNKMPTSLDPNAKETSDGIIDPTKEKPKERVIVTIPPKVIARALGLAIFTTFRAGFNVTGATGSGILIARLEDGTWGPPSGIQVHSVGGGFTIGVDIYDCVCVINSKEALAAFTNTRVSLGSDLAVTAGPYGAGGAMEVGHGIHERKPSGSRTPPPPAAEPSQTLKPEDKKSHRRSLSANAFKPVFSYVKSRGFYAGIRVDGTVVVERKEANAAFYGARVSVEQIIKGQVPASAQAGPGTWPAGAQALMAALKHVERGAIGGEGSPSLTPVDAPHADTAAAVPGPSVSGGAGPGGPAIGSDGLPEYDERLSKPATGDYKYA

SEQ ID NO: 3222 - protein, 250 aa, Unknown
  Kingdom: Fungi, Phylum: Ascomycota
MYIRAAHAEPSLKVLRQLIRDHPLGLLTTAIQSKEFPFLQSSHIPFLLDVDDETSESETGRLRGHLARQNPHSKAMIESLSSQPDREGVLEHDVVFIFTAQHHYVTPKFYTETKPSTGKVVPTWNYAAAQVYGRAKIYFDSRSEDTSQFLRKQITDLTKHAETHVMGYVGGEQPKDWKVTDAPERYIEILRKNIIGIEIEVDRLEGKFKMSQEMGKGDRDGVASGFNELGTDVARKIGSIVKQRSEEKDG

SEQ ID NO: 3223 - protein, 931 aa, Unknown
  Kingdom: Fungi, Phylum: Ascomycota
MSGQDSSGSQGAASPMTPRREKKKRVGFHAYSTSLGESSNHGALLGVQSPEEEVLSPSVPSSPHLPPGRHPPGAPDAEELRRELTRVISNGEIERVREFSQAIQEDERDQHNPRIIISEPISPSRPRPALRRNTSYDVPQEREEADRMEERASPRQLQSITNARRRADQLAVSLSSHSAPGSRRNSEEMEASFQSVLRGSSDHDDARPVPHVAKADEPSSAQHDFALHHPQPKPTNTLKKRFFSKNYDENESSDRYSRAAKDLVRSHVSSRGRNELYHHHHNESVHGSLASGATTPVMHTEDPYDDYVPRPDKYRGNVLASLLKLYHDKGGMDSGRSTPTSIPGTPIMSPSNSPPTSRSSSPVRKPKHRRSSSFFSYKSGSTSTLSVNELLKSSAMFAAPGSGKQISDSVVDKIKRTSTPKPKKDHAKITVHIAGIIFRHRYLMKLCRALMMYGAPTHRLEEYMSMTARVLEIEGQFLYIPSCMIISFDDMSTHTTEIKIVRVPHGIDLGRLCDVHDIYKNVVHDKLGVEEASKRLDEVMARKPKYNVWFRVFLYGIASVCVAPFAFQGRFIDLGPAFILGCILGVLQLVFAPSNELYAHVFEVTAAIATSFLSRFFGSLQGGNLFCFSALAQSSIALILPGYLVLTGSLELQSHNIVAGSVRMVYAMIYTLFLGYGITIGASLYGMMDKNASSEVTCQNPLNRNWYFLFVPGFTICLALVNQAKWRQLPAMVVIALAAFCVNSYSKAYYDGQGQICNMLGALTVGILANLYSRLGRHFNNAWLDILEFWEFKVRPRLSRLTQKSSEKWPTDDPESRPGSPAPQEKPMRLARKTGYSLAAAAMLPAIFVQVPSGLAAGGSLLAGVNSANQLTGNSTNAAGSGADPNANFDGTAFTVLLSVIQVAIGISVGLFMSALIVYPLGKRRSGLFSF

SEQ ID NO: 3224 - protein, 393 aa, Unknown
  Kingdom: Fungi, Phylum: Ascomycota
MTGPASPGTEGPTYAPPSLPAGWIAQWDGASRKYYFVQLATGVSQWETPTQPVQTGNTPAPPGDPYAPPGRAAQNGSGELITHPDGSQTVKHPDGTMEPIMGDGTRGGPDGPTGDRGMGTMALNALLGGKGGGGNSNALSGLANQFLGGGHGNSNQHHGGGGSGMGGKLVGKLASNLFSSSDKPEQPSNYHGGQSSGSNQNHGMAGSLMGGVASMFGGKHGSDGQNYGYSNSGSPGAGYSGQAPTYNPPGSSSGQGSYNQQGQSSSYSQQSGHQDHGSSYNQHGSGAPAASGGASGMPDHNPYSSQSQSNHSYPPPPPGGPPQGHSSQGGYGQSGGYPSQQSSYGGQPVPGQYPPPPGQGGYGQPYQGGQGGHAPYGGQPSYGGGPPGGYGGY

SEQ ID NO: 3225 - protein, 160 aa, Unknown
  Kingdom: Fungi, Phylum: Ascomycota
MRTYDDTFSGQRIYPGKGKIYVRGDSKVFRFQNGKSESLFLQRKNPRRIAWTVLYRRQHRKGISEEVAKKRTRRTVKQQRAIVGASLDVIKERRTMRPEARSAARAEAIKENKEKKQAAQAAKKAEKAKNAALASKGQTVRNVSKMGAKGAQTRVAKSTK

SEQ ID NO: 3226 - protein, 565 aa, Unknown
  Kingdom: Fungi, Phylum: Ascomycota
MTLDFPPIFLLPAHLQPEQLLELEEQIPSLTYDIHEAEVILGSVSKPERARFELRRVKLDTEPVEHRIGDQDGDGDEPSHKRRKLDAEELGKKSPDTERRNTVKVLRLQWLNDSLEKGQVLPFDGYLVYEGAIREPATELQVSSTTQSILERAAAASASVSPRSSRRYGSDRHEKPSQPQRSSLLHETTSDHDVRLPPIPEFLHTTYSCQRPTFVSPPNSDFVEELKQVRTLRLLQGDQIGVRAYSTSIATLAAYPYALQNAAEVARLPGCGSKIAVLWEQFKETGTLQEVHEAAQDEKLSVLQVFYDIWGLLIVFAGWRDQDDLTEFAWGSLSRVQQIGLKYYDELLLKIPRSEVEAIAATIHSSARELDPGYQMTIVGGYRRGKDQSGDVDVILSHPSEEKTSMLVKKIALRLEKSGHIKWVLSLSTKNSERGQRPLAWRGESGRGSGFDTLDKALVVWKDPDNASAPHRRVDIIVSPWRTVGCAILGWSGGTTFQRDLRRYCKREKNLKFDSSGIRSRADGAWVDFEDGDSEARATTMEEAERRVFQGLNLEYRPPEERCTG

SEQ ID NO: 3227 - protein, 639 aa, Unknown
  Kingdom: Fungi, Phylum: Ascomycota
MSSPQPGVTTRAQALRNLQLPRTPEPMAEGQSYPQSPPRPRFRLKRRNAPHLQAPTQQFLASVAAEDIPIPSIEEPHVVDEEMIDSIYPVIPSLHDLDSMDYVAHSLRGRPFSLPKTPAPGAVPSLSPKRYPDWSLGSTASDLDSSPECDSSRPSTARSTQTSASLFSQYSVTSEELSQCVSPEMERLETLGASPVLGEGKKTLRPVHQPSRPRKAPWTKQMSQHLWFTYMMYLQDPKVTPFRANKSGIPPPGVCSRVAREAKRSWKGSKSQKATIAKSGSSTPTGQSASAFMQWPHTCAATRGHLRELCKLNASSTGLSRQFFAHSPTPFGRTTTATRFLNRRSNNARSPSVFSGTDMAVSLTVSTADSMQLQGPLAQLTSSQDEKTPEAPVTPARNPHAPLLAPQTPPPAIRRLGSPFIAKSYGPSSSSSLGAAFGSPLDGGRQHQTLGPRRSLRSPVRLGEGSSSSQKRPFAQLAAEPRKSKRPSLATDLWTEPQALDSEPEVRCPPLARPAPVETRRSEEINGPRTNLQELFEASVPRAPTGSLAATGKEPSLGSRVRLGSPFSASNASHSFPHRVLSSSGIGLGLVRRPFATVQQASEGVSARPSLATRLAYIDERLRDFRHRDRGPKSTPPSS

SEQ ID NO: 3228 - protein, 633 aa, Unknown
  Kingdom: Fungi, Phylum: Ascomycota
MSTDELQSLFSPNKPLEPDVLSELQSILRLHDLSAEDLFFKWDAYCIKMGTETEAISLSAIRNLKQGIQDSLEKSNNQRHVQVKTERRVQATPRAGAGGGDVFGMLDGLVPSTPASGAKLGKAGSGMKRKIETPAAMSSPAGVSDQLKAMNGLPATSFADRANAGDVLEILNSSLTAADAPIAPFPEPRVKLTAASDVKKMAYKPLAMKLSEASEVLDDRIDDFTNMVQEFHKLEDAAFGSAANQGTTEIVAVGRIASDSPEGGKLNAASVVLETSRRTGMGFRVPLKMDKIRSWSFFPGQIVALKGSNATGNGFVVEEILELPMLPSAASPPSTLEAHRERLRGGPDAMESDSDPAPLSVLIAAGPYTADDNLDYEPLHALCSQAADNYADVLVLSGPFLDADHPLIASGDFDLPEEATFDPDTATMTTVFKYLVSPALNRLASANPSITIILVPSVRDILAKHVSWPQDTIPRKELGLPKTARIVSNPMTLSINEAVFGVSSQDVLYGLRGEEVVSGGGGQKLDLMGRLCRYLVEQRHYYPLFPPMDRSRLPGTGTENGVAMGPGLDLSYLRLGEMVNVRPDVMLTPSLLPPFAKVVESVLAINPASGEGATEGVLSHKVYDRARVEIVKI

SEQ ID NO: 3229 - protein, 2596 aa, Unknown
  Kingdom: Fungi, Phylum: Ascomycota
MAAPAGADRPASAEGSSTRPNPFDDSDATSRKRRRTGSPVDETDPSISELNSSSAQTQNADVASSPEAVANAARERVPRRQPSSSKVTLNLRQNSVTTSSSESSPPGNSVHIGNEANAAANKDIHQSVEAEAGPPQADYIRPETPRTPSRRTSRGSDDVMSVRNDSDVEYVDLAPDADSQLFDLSSDASIPSFPFNNSGDELSDTLRQILNHIQTQDAFPSDVVASVNTWLSLFVPLIQKLDSRALLHVWENGRFWHNLPELMHVIAMQTVSTTVLASHETRNLITDMYRNFTLLTEAFLNFDTGNLTQLATQTEHTNTQVPEIFATDYLFRLQGPLNFAFSSPRLSEVFIEADVGRARHDIALYLLKLFRTQTDGRWERLHRFAKVITELVPSIPKLSNCLSSVCQMLNVLSRYAAILEQHAEGSGGSEKPLDSTHHLWTLLESSLSSTIEKHVSTLTTADAGAQLEALREAFKTYLLGRPSVMLDTHPNGSADNSRLPPGVEADIVAWEWHFDRLLQLIRSSQMQLRVSAASSMCANLVGIWKRFSETSDEEEKQHVLDRIGSYLLRTNIVAYLFGPNCHPEIIVESANIVGFLVINKQYGLEHTEQLWHTITTTQDPRIADALCRMITSITNLFEYDGLLGLCAKLQGCPAQNFTPAIGRLWVSVLRAMMDKVHSDNATMTFHPYQMCLQLLRGASVCANGGAALYPDLHHAAQQGLRDVLEVGNDDLRRQHREQLFLSCLADLEAKSDTTLGSLWALSLAMRPAAVSELSQLAEKHGFTELMVEELYHAVRQNKDAEAPSIMCWPHNQPRREFVAQLIQFEPLTLDGKLGTRLWDVLVGHQAASQADRNAGWQILNDLVRKLGFRNHFLSTCFTDRLPALPRACFCQGVLEFVRAKVLPLVSDITGSFFEEEDSTASRVGLEQLWRMITTSEDDRLAEFAIRTLSGEVYLDSTLIQSFPLSRTRQIHTSVVARCLQLLKESARDLPRQDPPATQSDHFDDVSAVKGEQTRSSQLVFDRTIQLLVCFLGRYKLKPGFAVPDLRSFMPEAPSQVQGDLTHLKYQSFDGASQTDVKPLNIGSMNTAAALLASLREETGFQNYRAFYRGRPFAPTENDICKSLEDLQVREGLILVKKEKDASKSTSRVKAGASPLEVEISAHFDELQSYLNMTQPVARKILNLLTMLPADQYFMRIFEDNHLSHRDVFPPKHPFRTLYAIHAMIPYLDTVQRVVSRREEVQEDGILKDKIPASSPVQDARRCVAWISDATCDADLSSLESLELRFEVQSKLMALFRQSVNVLSTLSARDAGPLMLSESQPSLLDPLATVDVVHPSPEQLLTVLEDVMLHGGLAQSLELVEQTLHAVFSLGLESRSIWEKFSASPGFSTLLQNLIVRDSRQGLRHLLAAMIEGIVNTEAQRLRPHAETHGPIILFLWDTFSSILREAEVHADQSYALLHICALLLTRISAKPCQEALSAILGTTELLSELLLQHESTEVPGRTESADLFTDGVVTILLVCLNEDNISTAMEVLSSDYGALLIDRHLFPRPRRTEGDPVPRVIMHPNTRKGICDIVSRLVQHDRSSLNDVLPALHGLLPFHANREDDAYSYDLPYGNFDRDLHIRAPCGYTGLRNLSNTCYLNSLVNQLFMNVPFRKFLLNAKGRETPSDIGLLNITKRLFSSMQESWRPWIDPEEFVGSLKTFEDTPIDVHNQMDVDEFYNLLFDQLEGYMGSSDEKRRLRSFFGGQLVQQVKSKECEHVSERLEPFSAIQCDIKGKSTLNASLQAYVDGEIMEGDNKYKCSTCDRHVDAVKRACLKDIPDNLIFHLKRFDFNLRTLQRSKINDYFSFPHEIDMAPYTVEHLNDSGKGEADLFELVGVLVHQGTAESGHYYSYIKERPTSTGRSGWFEFNDEAVTPWNVNNLEHATFGGYESRSTDEPSCTKAFSAYMLFYQRASNLKTEQQRMVDRTQMAPLRVKINPQLYNAILDTNTMLLHRYCLFDPSYPVLVSRCIQQARKADDDAMGLVPMQDAGSDSESADSDDDSGHALHRSAMWLALNTFDQVVTRAAGLPHLILYQELLQTAAMGCTDCAVQIVEYFQRRVEAFRSLLQRNADAGVRRFSGDLLLSALQKVAEDRPLVYQPVVPLTPSDSSMDGNSEDNKAVLRQKSVPEDTRVVLRHIWKGFHTSLRSWEETFSFIHGFGRLGQHETAILLGDDWLLKLLRLIASDPATETRPNYQRMLNSLSRRVRPPSFASIVSLLDFLLEALEPVMSADSIVEEASERLAITDLPFPWTSQEVSILLHHPRWTNSSLFVEKLVALEQNAPITEQILCRLMEAGEAMNSAIFSTLKNNIPGDSTSQLMNPFLKAGACFVKNTEDQELARKLVFHITGQAGKLQNGEGLAFVQFFHSIMSSDLTQNAREHDIQEKALQNVPDWAPTLLVSFEPFVRIATTGFLDAQLFNAHAGLVAQAEMEGDDFTESDRALQSRLRDTVQNLGVNCLILLRDSHVMPQAPISRDAAESILRVITACREFCHADEEDSDMEHAAAYRMLYTEVLPALQPQIVEELDADVSDWDASAASSEVGIGDHIPRSITDVV

SEQ ID NO: 3230 - protein, 393 aa, Unknown
  Kingdom: Fungi, Phylum: Ascomycota
MANRNRYIKELETDLGPAHDALTSSSKQNREMSSRNKRGANRNNNGNSGHGEEANIWDNCKPALHDIVAAINADNDNLKHLLDMDKEVGAMDSDQIPGSKLKAMEEACRKGVKSADNCYNQLKAVITQLEIIKGVVDAKETAEAAAAGPTGKRGGRGDSVAAAALYEFDNAGESPGPSPLGGSSSRKYGRNSARDGDREREREKDRARSREREKDRERERDSVPPKADSVEPQGSVGSGVGGSSSSSRKAQAVFTKGESVAFRPVASAEPSSDWILGKVAQVIGEGKARRYKVLDVEPEDPSKQKEYRTTAKSMIAITPASQSKGLKPWEAGQVVLALYPNTTTFYKAEVHSMEDEADIEEGEEPKVNLKFEGENDMDTVQQVERRFVIEYRA

SEQ ID NO: 3231 - protein, 284 aa, Unknown
  Kingdom: Fungi, Phylum: Ascomycota
MSSQDSISPPATRQNDNRYAAENPDQAGSNAHGRKKRVRNWTANDRAAHRVFERSRREAFKGRLTTLANLIPALQATDTNRLSKHVVLDESISLHKVEQQRLQALMQQVDFLVEEREELLTEVNRWRAGAGLGVREGRALEPLPQPNTSPADHTSTDQALHDADDLTAPMHSAPLQHPEGTNSLPPFDSMAPQIPINPTGVVGHTGVTPPNWEVMGMDMSTHGMGTNMGFNDMFSSNMVAYPPVVKPPGDMGEAPYMPDEPHFPQQPINILNPRYAGDPQIYGQ

SEQ ID NO: 3232 - protein, 1523 aa, Unknown
  Kingdom: Fungi, Phylum: Ascomycota
MVMNSSSALRNLTSRPCFIGEPGGQGCILEQFVDWIASMQEPMPRHASSKSWGLGRYMGDNPMQADLALDPELDPNRQLAQPYTDLIATRVSLSSNECRSESTDSRDDTHSSAHSGTRSTANSHTRILSPYSNGLAISEDVSKTSKALETRQGMSAGFPDSLYIRQDPMGGYVVPRDQGIRSVSFEEQRMNVGPALADDVDMPFGSLHADSQQAAIRLEHNWGLSPQALAKTISTMLQIHLDSSAHKLGLIQQSPLVLQFSIMTQTDVVDRGIAASVEILAGCKPSSALNLVCFVHLAYVLSLVVHAEVDAERSRELFSRSMSYSTWLEGYERQAYINMVDALWKPSNMALTDVVGLLQGAERPASLGGTGAAFRSGRSLESRSGDIIFDAFEDALDEFEHAVLLQPTDPELQASNLYNRHMKDLRVDAHHSQPFIVATTLLLQGVSRQFSDVPGLVESIAEMVSRVQHTRYVTARRTELEALRIGRSYLSPSRFLSQYGPLVRRQVDELYARIPDSDSQRNSYSRDAGEAIRSLLKSVARRTQAEGHPSSATGIPSTADSMNEFLGAMTSNIGDISFHDASIGSAPAYVTTYSGLANSQGEGMLDSGMATGRAASSSSAARSPPSPSGSYQASLGSEDPTSASKIESNTTCTLCGYRPKGDPRWFGGSMAKHMKLQHSTTPPKIYRLAPTVALGSTTVVRLALRKIPHHTPSGRPLRLPSLLPPCVHASLLHASSLPSAASINDTPKTWSRPLLYRSNTSDFVRLLLLISLVTRPTIGRRRRENSGTGLRLRDTAVTLHNQNNTTSIGQKKVFACRQRRDWRPDARSSIASCGRRLDHNIMSGLGPAGPNNSGLNFSQAAAIRRGPGFASNHPNQSNKPSPAPHNASPYQPHPYTSQQATPSPYNQQLFTQPQMNGNVPNGPSRSHASHVSVPNGLGSRSRPPPPRQQMQTQPNPPSMMFPGSMGQHVQHDSLLSHQPQQHASHQTHPGHQTHPGHAQHTPHQPHQSPHPGHHTQQQQQQQQQQQQQHQQHPQAQHHHHQTQAQPQSHQHQQPPPPQQQQQQPHHQQHAQPQPQPPTQHSQQQHHAQHPHQQQQHYAQQQLQQPQHPQQVQAPQQQQHQQQQQQQQQQQQQQGKGTPQQQHRQTPQQQQAQLQNQSQQSKQQQKQQAQSTPGSAPQQLAQPPGSAAIQRQRSQASRTPQQQPETIPPQQQNGKQPEDINMDGQDPDDEPSTLDSKMLQDPNYINDGQPLGEMMSAPPEGGSYPTLEAVQKAVLRYCMSVGYAIVIGRSKKTVPGLKKVLFVCDRAGKPPSRVSPEFRKRKTSSRKCDCPFGFFAIEQRTQWTIRYRPDPNHLRHNHGPSDSPTHHPAARKLDSKMVAAVKQLKDNGAGVSETLQILQTENPDCHLLPRDIYNARAAINRNPAKVASGIAENKPAIYTKPNQSSEDRIRADLRRELAKAKEDLKKVEEEKQKEIDALKAKMAEKDEQIQKFEMFIDICNQRVMVQRERLSGSEGAAAAGRNPA

SEQ ID NO: 3233 - protein, 353 aa, Unknown
  Kingdom: Fungi, Phylum: Ascomycota
MDTASPVLVTGGSGFIACSLVKALLEQGHTVHTTVRSLQNQKKLAPLRDLQKTHPNKLHLFEADLLNPNSFDDAMSGCATVHHVASPFRMPEKIKDGQREMVEPALQGVRSVLGSVENTQTVKRVILTSSTGAIFGTYIDVPQKMENATLSEKYFNSSSSVDHEPYHYSKVMAEKEAWKLYEAQESKRWHLVAINPGLVLGPSLTPSSESGSLFLLNELLSGQLFFGVPDLSFLLVDVRDVVAAHCAAAKVNSAHGRYIISHDRTTTFQEIALTVRKHITGFRRYLIPTHTIPTWFLRIVGPLFGLDARFIREHIGIRFVVDNKRSVSELGINYTPLELTLQDHYASWSVNRA

SEQ ID NO: 3234 - protein, 756 aa, Unknown
  Kingdom: Fungi, Phylum: Ascomycota
MGRRGAPQPLRLSDPTAAATTTLTTAASATSNNSNGNLNSATSSQHNNHLHSPDALNSSTVATAASSSVTSPVDSRSPHASPRVSPFTSRFSTRRPQTSRAASDERSHTLHGDENTPPLPDHRPDASCTSVAGKVDTPASTAPVASSRPPPPEGGARLQKAQTEHSKKFSRAGFFHFAKSSKANNSLHGSSNSSLSGARNRSVSRGKDGSEPSASTDATQGDYSVQPVPSYPSTSELSVSTSGDREAQSAPSSARKPKPKPFGLLTRTKSVRDNNNSSPLQHTAPPMPTYSNEHLQRNGNAPRTAPPGGQDRAFREMMNSTARNRSEDRAPSRDAPAAAPREYQHREREHRAPPSAMRENGGSNFFSGLRSSSTKAADLISKGLFGKSNSRSAPVHHAEPVVDDEHYELKVINLPLVEQTRKTRISKRLETSRDKTEFWMPAFPWRAIDYLNYKGCEVEGLYRVPGSGPQIKRWQRKFDEHYDVNLFEAEDLYDINIIGSMLKAWLRELPDELFPKAAQERISRECAGATEVPQMLIDELSSLSPFNYYLLFAITCHLSLLLAHSDKNKMDFRNLCICFQPCMKIDAFCFKFLVCDWRECWKGCINETQYIEEEYRLFDQPPPRGLAEPQGPSNTGVEDNKTPTNSSRVPNVDTEDEFHDSREAPETYRERQMSSSTSSKQSYQSAADAPVKPIKKKPLPLSTSKDSMMSNESSISTNLTIGSEQREQQRDHRENTRGTGDLRPLSPIKPLSPIGF

SEQ ID NO: 3235 - protein, 656 aa, Unknown
  Kingdom: Fungi, Phylum: Ascomycota
MDLAHENNSELGLSGSTYELIEKEESVPNTHHDNTDSESQDDSQHEFDGSLSESIGSLDQNRQDDVQSLGSTDHLEDEEDDGFHHHYEDEHDDASTAPDDEGSHLTSMTVVDNEDGPSAAYGVNDVEELSDAESRSSIEYTRQSLGTPSVLTPEASKILTPMQDDADEVAEPTRLNGTARSVTEKVLDTWDAIKSKALNYIAVVVPPQPPSSDRKACITYQREHWITCEVRHTADVLGRNPKQIVVSTIMVMLASVMLGYADSLRAQSRYHASVPHVDTSTTTTTTTLIEASTLVQAVEPKQARSTSTAVALIPVHESHDDDWFFGYTMPDVRFTTEGENKVLIHVEPAIPTPWTAQRKCLNLHATRGDETIPLLTSFIDKSTLMVVFTKAEAHGIVQIKLSSKCRPKLEKSVKVRFSNMGIMEQVFGCVGELAHVLTGHDSAHVETELCESLKSFSANVDHTLESAKDIGLGLVSSRLDSASRLFAPLGSNVVKASQEAGRCLHRAEAAFKTLSDRTEVPFRDLTHRGAQAVQGSWLTSSNMLGGVLDNVVHSAKSAAQKASASQQHHQANIKKAMSDISMTSVREELHFGVLNAQVAAKTWWLKLTGREDQSKEYGRRAKEFIAELHAYSAQDSRIKDRVKSWSAKSDFRPPRA

SEQ ID NO: 3236 - protein, 603 aa, Unknown
  Kingdom: Fungi, Phylum: Ascomycota
MPHFHSSPGVSSRRRHPNSSLSSTAASSSFLEDMANVGGPTMLKRTLGLQDDRYSQYIGPTTDFEPSLINLSSFDPHDESLLSRGTLRRVGDNDTFLMLPDYNTPGHEHVTQDLDAIEAVVAPHGRKLIDLYFRVVHPGFPIIQKHVFIEKYERSYREFTPPILAAVYILAINWWHHSEELSHSPKPNVRELERIIRSTLSDAMYRPKLSTVQAGLLLSQRPEGDQWAPTAQLVAVAQELGLHLDCSTWKIPPWERGLRKRLAWALYMQDKWGALVHGRPSHIFSSNWAVRSLTANDFPDVEWDENDIEEKQDIERGRLLFTRVVQLSEILAEILDTFYTLNAMQNVNDAGVQGTQMVLSMAKPIQLKLKDWYGGLPQSIRLDSSYGSGNIQNRLSSVGYLHLAYFATEITLHRRIIRSLASPASNVDPYVQHICRSAAKARLISAMDFVNRLTPNHLRAFWYFASKTNFALIGTFGSLLWATSPGKEEADWYRRRLGEYRWTLSVSSKPGESKGLTEFAMTMLDISTGLLKQLPEKPSMSRSESTTSFNPMSAPGSYSGPGSIVGHFSNVPSRDTSNAQSPQSADYDDSSDEEMDDSYATRM

SEQ ID NO: 3237 - protein, 169 aa, Unknown
  Kingdom: Fungi, Phylum: Ascomycota
MASAGEKAQNYLGMLDSELSKYPAINNIEKQSGIPKAYAVIGAGALYFFLVVFNLGGQLLTNVAGFVIPGYYSMAALFTHNTDDDTQWLTYWVVFAFFTVAESFINIVYWFPFYFVFKFLFLLWLSLPMFRGADLIFRSFMVPAFSRYFEKGSTASGLRNRASGFDKTE

SEQ ID NO: 3238 - protein, 719 aa, Unknown
  Kingdom: Fungi, Phylum: Ascomycota
MAEAITAGAAKLQLDEETGEMVSKSELKKRLQKRAKKAANAQRAKDNPPAAKPVKENAASKPVAEAAPVDPDAMFKQGWLAEVYKERPTKDVVTRFPPEPNGYLHIGHAKAIAVNFGFARHHGGKTILRFDDTNPSKEKEEYFLAIEEVIRWLGFKPDAITYTSDNFQKLYDLAEKLIQLERAYVCYCDKTNIQLQRGGKDGKEGPRYRCAHAEQDVETNLKKFRDMKDGKYERQTAFLRMKQDIESGNPMMWDIAAYRMPKDDEPHYRTKDQWKIYPTYDFAHCLCDSFEGISHSLCTTEFILSRESYEWLNTTLGVYEPMQREYGRLNISGAITSKRNIEQLVKEKHVRGWTDPRLYTLVALRRRGIPAGAILSFISELGVTTAKTLIPIPRFEQAVRKYLEFSVPRLMLVLDPIKVVISDMGDLENAEIDAPFSPKDKSMGSHKLKATSVVYIERSDFREVDSKDYFRLAPGKSVGLLNFPCPIKATGFTTDPETKKVIEVQAVPDRELKKAKAYVHWVPEGSRTVEARVHGNLFKSEDPGSVEGGFLNDINPNSETVYPNALIESGFDEIRKQAPWPKTDIEKLSDGPESVRFQGMRVAYFAIDSDSTDDKIVLNRIVSLKEDSGKLTLESSDDLAVLKTPDKTYALRQKNTSNALILLQPKASNGGLEAIGTVHETVELEVVPERAAGGPDAVAGGTKHTGSKGKWHEKFGKGR

SEQ ID NO: 3239 - protein, 355 aa, Unknown
  Kingdom: Fungi, Phylum: Ascomycota
MHRTYSMRQTRAPTASQLQNAPPPPSSTKSGRFFGKSSFGHALRRNAGGAFGPDLAKKLSQLVKMEKNVMRSLETVAKERMDVAQQLSIWGEGGDEDVSDVTDKLGVLLYEIGELEDQYVDRYDQYRITMKSIRNIEASVQPSRDRKQKITDQIAQLKYKEPNSPKIVVLEQELVRAEAESLVAEAQLSNITREKVKAAYTYQFDALREHSEKVAIIAGYGKHLLELIDDTPVTPGETRAAYDGYEASKAIIQDCEDALTNWVEANAVVSSKLSTRSRNLSQRRRTNIRNRNDGLDLSGQDAPLNDGSSWQARDADLESEEDELDIDEKRQSSMLDNDSSLNGETRGRTQEAVVA

SEQ ID NO: 3240 - protein, 511 aa, Unknown
  Kingdom: Fungi, Phylum: Ascomycota
MGDVENPALQVIVLGAGGGPLECNTTAFLVRSIAQEWRKGSVIAVDGGVYLSIITKILEESVPMPLPMQPYTIETGPFAGLTLPHNSIEANAGHITSALIDAHLITHPHLDHISGFVMNTAGLPGTRPKKLAALPNTIHAFKTHIFNEVIWPNLSDENGGAGLVTYLRLVEGGSSVMGDGDGKGYSEISDGLLVKAWSVSHGTCVEKHVVPRRGSVSSTSTRFGSQDTPVQTPRREYGHPHQQSGARRPSLLSQATMPVAGSGSPQAGDAERVSACVVDSSAYFIQDRDSRREVLMFGDVEPDSISLSPRNLNIWQEAAPKIAAGTLTAVFIECSYDDSQSNDRLFGHLKPVFVVEELCALAREVAKARKELKAAESKKRKRTSVTAEGERARSIPRHGLTPMADIPLSPKSTGAKPYPTRGIESTTTSQPETPHIATPTAGLSLGDLEPFSPSLQQQLTGLKVVIIHVKEKLVDGPHRGDLILEQLREHDAEVGLGCEFVIAKQGQSFYL

SEQ ID NO: 3241 - protein, 463 aa, Unknown
  Kingdom: Fungi, Phylum: Ascomycota
MLSAALRRRALAPTHNALRQGFAARVVRCYASFPDHQVVKMPALSPTMQAGNIGAWQKKAGDSIAPGDVLVEIETDKAQMDFEFQEEGVIAKILKDSGSKDIAVGSPIAILVEEGTDISAFEKFSVEDAGGESKAPAAPKKDEKSESSSDSSKSEAETPSTSEPEQYTSAEGRLQPALDREPNAAPAAMRLAREKGIDLTDVKGSGKGGRINEEDVKKLVNSPAITAPGATFEDLPVSSMRKTIASRLVESTTKNPHFFVTSTLSVGKLMKLRQALNATADGKYKLSVNDFLIKAIGVASKKVPAANSSWREGSIRQFNTVDVSVAVSTPNGLITPIVTGVDARGLESISGKVKELAKRARDNKLKPEEYQGGTISISNMGMNPAVDNFTAVINPPQAAILAVGTTKKVAVPVENEDGTTGVEFEEQITVTASFDHKVVDGAVGAEWIRELKKVIENPLELLL

SEQ ID NO: 3242 - protein, 673 aa, Unknown
  Kingdom: Fungi, Phylum: Ascomycota
MDKITDKIAALPADGKYFSLEFFPPKTAMGFSNLRDRLHRMERALRPLFVNVTWGAGGSTSQKSLELAELCQRELGLTTCLHLTCTNMSRRLVDKALEDAKALGIRNILALRGDPPRKDEYRDHAESETDDTDDFTWAVDLVKYIRKNHGDYFCIGVAAYPEGHAEESHPLGQSLEHDLPYLVEKVQAGADFIMTQLFFDIQAYEKFETALREHPSGAFKTIPIMPGLMPIQSYQMIKRTTKLSHANMPENILARLNDVKGDDERVKMVGVDIVSEMVEQIKDIKSRIPGPQGFHFYTLNLEKSVSFIVERTGLIPDVPQDEVAVVDDPIPISVPHLRLNGTNSSRGRGTSHSRTSRRHSSVGSDPHNRVIVSGRATAHPEWEASGEEAAIPAEAINSRANTLAISEGEGVLGREATWDDFPNGRFGDSRSPAYGEIDGYGVSLHMSVTQAIKYWGHPARHQDINDLFVKHIEGQLAAIPWSEEELLPESSTIKPHLLKMNTKGWWTVASQPAVNGERSSHGTYGWGPQHGFVFQKAFVEFFLPTSDWEVLKEKLARPEIRDSVCFYASNAHGDFVTSDGSGGVAGGEESTSTNAVTWGVFPGKEIITPTIIEEVSFRAWSEEAFGIWGEWAKVYGRGSESQKLLDSIRKDYWLVNIIHNDFVERDALWDFLL

SEQ ID NO: 3243 - protein, 521 aa, Unknown
  Kingdom: Fungi, Phylum: Ascomycota
MHLNFSTLALAAGLLATASISTAQDVPADLPVSELLSTAQTHLARGETSEALTFYDAAIARDPSNYLTFFKRATTYLSLGRTNQATDDFNKVLSLKPGFEGAHVQLAKIKAKTGDWDSARAEYVAANKAVESVEISELEAAKGAAKLAEEAANASQWEECVNQAGVAIVVASRAPKLRELRGRCRFERGELEEGMADMQHLLQMKPGDTTPHVVISATAFYGLGDMALGLGQIKKCLHSDPDSKVCKKLHKQEKVIQKALAKAEGQLEKGQTTSAGRTLMGTADDAGLVSSIREQSETLREAGSIPSQAAFGLYNKVIDMTCQAYIESNHRDADKYCTESLQNNPDSFWGLLHKGKSQLRAENYEASINTLEQAKEADPSKRGKVDPILRKAQIALKRSKTKDYYKVIGVAPDADEKQIKSAYRKASKQYHPDKAAKQGISKEDAEKKMASINEAYEVLSDPELRARFDRGDDPNSHEGQQGGGGHPFHGSPFGGFGGGGNPFMFQQGGGGPGGGFKFNFG

SEQ ID NO: 3244 - protein, 492 aa, Unknown
  Kingdom: Fungi, Phylum: Ascomycota
MKTTSVLAAGLAVTGAFASDPLTPEKAVADIKTQELQRNLWNFNKIARDNGGNRAFGLPGYEASGDYILERVQKRFATTIDAHKQYFNHTFAQIRDISVTGPDGKSVEVIALTYNPATPAEGITAPLIDTPVDDVRGSGCFEDQWEGIDATGKLALVKRGACAIADKLKLAAAHGAEGVILYHNVPGSPSAATLGFENLGLLPPVGTIPLAVGESWSAKLAAGEEVVVKLYVDSVFEERETFNIIAETKEGDPNNVIVLGAHLDSVQAGAGVNDDGSGSSTILEIIGSFKKYKGLKNKVRFIWWGAEESGLIGSLYYTRTLPEAEADKIRFYFNYDMIGSINPKFDVYTGDYEEADSYGAKLLEEYLLDEGFPAQRAPFGTGSDYVGFINIGVPSSGLHTGTSAGGYDPCYHLKCDDLENINWEALTANAKAAARAAAIMANSDLKDLPRRRNVTPAKRDAKSIRAEFQRWAALSEEVEHTHSCAHTKQEVV

SEQ ID NO: 3245 - protein, 151 aa, Unknown
  Kingdom: Fungi, Phylum: Ascomycota
MATAVATSSTGLDIIHAYRRVLRSAYQAVQYSSPARYVVRDQVRAAFRESPQSASSSSTSTSASKAPAFDPQVAKRTAWFLEAAARDRGVEHRVVKNLVKIRLARSKGSLKWKGVLTADKNRKMKEHKQGVYDHFDMTVAMMNKSLGIALR

SEQ ID NO: 3246 - protein, 393 aa, Unknown
  Kingdom: Fungi, Phylum: Ascomycota
MGLPSLAKAVISAIGGVLGLYIAFISLLTIPFFQNQVIYLNKVTLTWFMDVSIPEQWGFLHNQVTPFTLQTPDQETLHAWHILPLGLYEQNEDALLLEDDGIASDITTRMSFKLLRDDPESLLVLYLHGAAGTLGSGWRPPSYRAMSAGSPRIHVVAIDYRGFGASTGVPSEEGLLTDALTLANWAMDEAGVPPSRIAIFSQSLGTAVGISLVQHLAKQPDPVFFSGMVVVAPFADVEMLTASYRIAGVVPLLSPVAYFPRVLALLNSFIVSKWPSKERLADFIRHTESLPEKEGHYHITIIHAEDDYDIPWTHSDALFWHAVNASSPTSQTFEELEQEKLSTRNERGEGGWVVEKKTSKGMLREFVCKHGLHDRIMSYPVVSLAMRRAFQGA

SEQ ID NO: 3247 - protein, 307 aa, Unknown
  Kingdom: Fungi, Phylum: Ascomycota
MERIKQTDRESARELASRHEFHQRPSVFADIWVIAVVAENILAHLLMKDLLLAQSVSSEWNELIKGSPRLQELLFMRPMEARATTMSSSGMPVRHLNPLLVEHMSPWFSGKKEDGMDPSVVDCPWMQTAKRPAFLRRGASWRKMLLAQPPFTMFERAKKVHARGGDSLTVKFIEQKDGVRMGLVYDNGVEFKGSGYSALQPNRFYTVLDGKVGCGSAESSVSNDHSDGRTRLFGGMGKFTLCSSRTIGCVLHGYASISEMEAAKEAEQRAQLHFISEEREEVSLEEKVLPERGRRHKWWTEDGYCRF

SEQ ID NO: 3248 - protein, 161 aa, Unknown
  Kingdom: Fungi, Phylum: Ascomycota
MEHHAETEEVIAQRTQHVQSLMDSLRTSSPIYNFTLPTMTLQSVKKGTVLTRLVLDAKHLNSRGGLHGAVSATIIDFTTGLAIASWDLRPATGASVDMNISFLSVAREGDVLEVESCAEKVGGSLSFVRIRIVKVGEDGERTLVTVGQHTKYLRPKPKVEA

SEQ ID NO: 3249 - protein, 169 aa, Unknown
  Kingdom: Fungi, Phylum: Ascomycota
MSELKWKDQYDADADDYEQNEKLKRINDEYYNQRPLLSPKPNAVLPRPRNVDAGEWENNAPVGAIVGGVVGGVVGGIAFLVLISAAWFFWHRRQRRLQPVLQPRPDLGTELDPKAEIVEAPHKLPEALGDGSNAWELQEGQVPAELAAQILKVGQGPFEMPGESQSGQS

SEQ ID NO: 3250 - protein, 431 aa, Unknown
  Kingdom: Fungi, Phylum: Ascomycota
MKISIPSLALALSLASSVSGHYIFQQLSVGSTKYPVFQYIRKNSNYNSPVTDLASNDLRCNEGATGAGTDTVAVKAGDSITFTLDTAVYHQGPISVYMSKAPGSASSYDGSGAWFKIKDMGPTFSGGSSSWPMTLTYQVTLPVCIPNGEYLLRIQSMAIHNPYPAALPQFYISCAQISLNGGGSVTPGNTVSIPGAFKNTDPGYTANIYSNFNSYTIPGPPVFSCNGAGGGDNSSPPTTSAPPGTTLTTSTRPPASTSSQPSANCAAVWAQCGGRDWTGATCCSSGTCKAQNDYYSQAGTCSPAAAHSYLPVSHPANRATVNAIDHIFGGPSDAHHFRLSLIPPSDPVARAMASPAVNIALIVLCISILIVLVGWFFKTQINTFDEPRVWLQLANDQGGVDQIDIDFLIDFLIDFLIDFLIVLFVLFIAAL

SEQ ID NO: 3251 - protein, 327 aa, Unknown
  Kingdom: Fungi, Phylum: Ascomycota
MDTETQVTDLPMAMTPELAAGKTYIVTGSNGGLGYEAVKHLVTMGAATVIMAVRDPSKGEVAKAEIEAATGSKDVIKVWQLDKASYASVKSFAQKAIDELDHVDVLIDNAGVAQSAPNLPEGHRENMTVNTYSSLLLAVLLLPSMSAYANKHNTVSYIVLVSSSASFQVQESWNKMKDNDPLATIDDLNSGTPMVSYPLSKAIQIMATKELARLVPLSRTNVVLNLVDPGICKTNLSRNAPEPFRSTLAALHEKIGRTAEEGSRTLLHGAVAGGASHGVLVDSCELHEKRVPAWLNGEEARPYQKTLWEGIAKELEKVSPGSVKAIM

SEQ ID NO: 3252 - protein, 593 aa, Unknown
  Kingdom: Fungi, Phylum: Ascomycota
MPCFKGIAVSIHANSAPLPEHGMQKQSRLSRISTYIPVPQPDISGEGKPEPAKFAISITLLTPGVPIPYSTPKPTESNPYPKPQFVGSLQPGSDGERGKYNGMVTPYIPMTNSDNETIAAYIYFDGRAKEEVATLLRPGEETWVNSRWVQVPDAEGGGLAEREFLFREVGLEKWLNGLDLQGHDAPEKLEKRRQKFEKRQRRQKAAQEGSTGMDLEGGSSSRSRKDTLTYGADSKTPLEAVMDETDSSSDDDDEPPEATGQIKVAMFRVLASGEIKKGEYSPQFDAHDGDDDYTDGKQGADVEHTTSFAKPKTLDPKTISTQTVTGIDGPDKPYATFTFFYRGERQLQKTGIIQSTKNPQTTPASAKRRSGQLDFSNLGPLKAGGTVGFSTFRDQTTDASHRRKARKKSNGNIADDSDDEDDDDDVPITKMEDTDDKIDTGKLAPEDARFQGELADGVNRIHLKRAHSADPDTSSTTPEAALQPVASDPSVNTSAVNATPTSKTGLAGTSNVPPEALVGSPLKKARPSIDQGAGGEKFSATQSLSAALGSIVGGSNGSGPTGTPPISISAASDAVAATASTTGGAKVEEEEEL

SEQ ID NO: 3253 - protein, 917 aa, Unknown
  Kingdom: Fungi, Phylum: Ascomycota
MPSRSEILAPFASAFGRSETPSPSRASKTSTPTATSQHTLPADNTRVLSEASSASSIMHRDNIDSPAVSSAPTTPPQISALPDHRRLLAKINDSGVDFNSSGRGTATNSGRSSPRSSMDIQRSSLDIIAASRTSLDSGRTAGSADFAVHPNEINTIAQLDRLPVGTEVHFRARIETQRQLSKALDFLLLRDQTHSVQGVLSRENMDMVKWVQKLHPESLVEVGGLIKAPPEPIRSATQSNIEIDIQTIFLVNSATNVPFSNYKPPETLRNRMASRILDLRHPSNQALFRIRSLVTRRFRETMEDRGFVEINTPKLQPAATESGAAVFKVNYFGRRAFLAQSPQLAKQMSVSADFGRVFEVGPVFRAENSNTHRHLTEYTGLDIEMAIENDYHEVIDVLDIFLKSVFESVYAMPEVAVLQKRWPSKEFKWLEETLILNFADGIQMLRDDGRDVEMEDLSTPDEIRLGQLVREQYGTDYYILDKFPASARPFYTHKDPEDPFFTRSFDIFIRGQEICSGGQRIHDVNVLRSNMAAAGMGEDGMEDYLSAFELGAPPHAGAGLGLERIVAWMLELGDVRYASLFHRDPKSLPERAPGLPHPEADTTKPHQPNQLPPLEKLIANYGDATNTSWLDERFQIWQHPTGAIVGYVKQDKFAMITGDPLCDRSQYKEIVRAFVNFVTHDLKLTPVWMLVSYDVQRFLAQDLTWRTLSCTEEQRVDTDKHKSQTEGPKARRVEREGVKIHEVKPDEDFIKRAQEAVDAWKSSRKGKQMHLTEVRPWIDLEHRRFFAAEKEGKVQSMVVLHKLAPRYGWQVKWALDFPGSVNGAIEVLIDFALSSVTGKVTFGVGVSEKLTAGQNLHGIRAKFLATTYNSIVDTLGLRKKADFRNKFGALGESVYICYPKHGVGLRDLQQIIKFFQD

SEQ ID NO: 3254 - protein, 457 aa, Unknown
  Kingdom: Fungi, Phylum: Ascomycota
MDDKTRSKYEAKSIEIKADLKKWEGDWASAHAGSKPGREDIKNNPDIAKKYKDYNKVRDILSGKIPPPSRSDQKKRKPDDVVQTPVKKARHAETPVKSREQDDGLMGTPAISRKLFSPTPVTALGPTPQRDGRVLGLFDLLLEKELGTPKKGERDERQVASTPSRRRSIADPDSGRLGRTPMSSSKRQRLDTFMTPLKNRDGRIGDGGTPSSVSKLQFDTPAFLKRHSFPAADENVGLPAPLKLPRKPMVRGLSEIVASLRQIEEEVVEADDDMEALREMEALEAGDMPPPKPVPTARRIAEEEVLAPDRPQDALPLGGFDDEGVYDSPTEDQKGRDGQPLRVYKKKGQKRTTRRSNMKPVRSKRASSVDLGGKAEADDDYGTDEDEAEVRDSDAESDYGAAAAPKKKQGEKKEGKVKKTARKVNELAHANFQRLKIKNSGAKGGKAGFGSRFRRRR

SEQ ID NO: 3255 - protein, 248 aa, Unknown
  Kingdom: Fungi, Phylum: Ascomycota
MSASSPPQPPKAPSPVQPATPTTTIASASASTTTTSHHQTNPLPSVISATATTNLTSPSSSTLPTSHSVSEARTAVVASLSNMLDRKLQTRASTLHSNAAALSAQEREVEKATQGLRKEREKLEKEAARAERGLREIGSVQNWAEVLEREFLVLEETVRLANEGGGSGSGSGSCSCSECGEDVRMDDGDESDELAKAKTQEEGDDVVMRDGSGWSEASRSLVDGESSTTGTGTGQAKGSETASVSTLA

SEQ ID NO: 3256 - protein, 1280 aa, Unknown
  Kingdom: Fungi, Phylum: Ascomycota
MEPGLLLSVLPPSHADDGTVLPDTPTTKNHPSSEASLVAGDLRPEIVEPVNVQMYNLSVEVAGESWGAGIFSKAKQLTGHATSQTRKTLLKSVTANLEPGSLTAIIGASGSGKSTLLDALSGRLTGGCRISAGSVICKGKSAKSEVRIAYATQRDVLLPTLTVRETLHYAAELRLPQPLSPARRCAIVDNVITELGLQKCADTRIGDDHTRGCSGGEKRRVSLGLQLLANPSLLYLDEPTTGLDAASALALTATVRRLCERDRVVVMTVHQPRPEIWSLFDNAILLAQGSPLFSGPVRDALPWFEALGFTRPMFVNPADFLIDISAIDHRSGELERESKERIAVMRDAWHSELPPQHSQFTTASWYGQQDREWKQGSQCATFWRQLQVLTHRTVKITCRDPLGITACFIEAILMGLAVGYIFYDTGRDQAGIKSREGCLYVAASLQGYLLIIFETYRVTFDMSTFDRERSDGYVQPAAFLLSRRLAKLPLEDLPVPAIFSALIYFMAGLDREPSKVAIFFAISLLNHYLAVMCATLCVVISRDFPTASLIASLIYTLQSLASGFIIQVDSMPVYIRWTRWITYSFYTFSAYIGNEFEDNFYDCPFNGGVQNAACVQYQGNFVIKTLGFPLNWTGRAIACLHFPTPLTSSEPRLQSSGEPVEFCEEDVDHHSRGQVQPIVVKLHQYGLSLRLRRMKTFWRGYSYRTIIQSNSATFEPGMLNIILGASGCGKTTLLNSVCHRLQPTYLAQYVQQGKITFNDLETSADELRAHYAYATQHSEALLPALTVRETLIYAAALRLSGLLTPAERVARVADLICSLGLRGCADTLVGSNAVRGISGGEKRRLALAVQILNDPKVLLVDEPTSGLDAFTANSIMKLLYEIAKEGRTVIVAIHQPRSDLFAYFGNILLLSEGGHTIYSGLARNMITYFAEAGHECPPQMNPADFALDLTTVSQKSLVLSNQDRVRVNRLVHLWRDNELGVARLREQFCEVRQLNNKSLQFRGRDSSFYSQVLHLLCRATTNTIRQPQLVVARIMQSSGVAIIFTIFFAPLGHDYSSIQNRFGLFQQLGGFYIIGMLTNAAVYPFERDNAYNEIQDRIYTVDAFLASYTILELPFEILNSLFLGLLLVFAIGLPRTAPSFFVASLAGFSGLSCGESLGIMFNTVFSHTGFAMNLMGVLLAVANAMAGILSLDMPDLFNIFNYLSPIRYQVRGVAYYSLIDQFFECDQDSNCPLRTGQEALALYNFDGNPKFNIVGMVLCAVIYRVVAWLLLRILRQVRTS

SEQ ID NO: 3257 - protein, 90 aa, Unknown
  Kingdom: Fungi, Phylum: Ascomycota
MAETTLPRPSSAISRPVSESLLNEKWDRCLSNLLVKSTLGLGFGVVFSVLLFKRRAWPAFAGVGFGAGRAYEECNFSLKQAARDLKKQSA

SEQ ID NO: 3258 - protein, 728 aa, Unknown
  Kingdom: Fungi, Phylum: Ascomycota
MLASNTLQPPQSGRSRFSKALPAVPGLATENVLPPLPLATPRKELPASPRPDFASREQQVPFSPLSAIASPTSSASTPTSIKSKMTIPRRPVGGGAGQKGPGLPAKPGPDRAPAPVQVATQTHPQTQISSPPAAKTTTSPAAYVPPPSPSESLSSIFSAYSRSSTGSPVISSEGAASFRDSHRASSPTQFDASPDTTTLLTASSTPITPVTYNPIPPPKASPFTNKANHQQQQQPAYTRPQPALSPIPVDTSAPPPPPAKDTTLTQQPQTTYRNQTATPDLSAPSPPRPQIWRRRSINKSKDLPALNIQSSHGSTASSSSAQAQSKRDEETASILTQSTTETIKPLPPLSATKPLPPIVGLPGRNVRPVPSKQGDSEMTTEMGNEPSKLKRLSAKLHLSRGTTEASSSADATGRPPTPEYQKQDVKTPMLETFVSPVSPASSPEPGKEAPLPVSKDPSPRFPQAATQPLPKLETGSITRKAVVPAPIPELHPTRSVPDLRSATPSTPSAPLPSLPSVTHSFAVNRERRPSDAASLRGRESTDTSRFPPRGSSVKPEGRQKIVSSQSLPQTGSSDNDPRLVRSNSGNMMYRGRDGTLYPEMKDPGTPDPKATHFPTHPQGRIADGTILPAPPIRDSHYLCYQKHRNMGRRVNRQYPLTCQTCDKADVEDRWVCTFCQLRTCTPCFEKLKSNDRDLKRLLQSVKSPEIPSVLTLSSSERPGSALGLQINF

SEQ ID NO: 3259 - protein, 985 aa, Unknown
  Kingdom: Fungi, Phylum: Ascomycota
MVPATLKYRRAGVKPPVFVAGSFGHPEWVPREMDWVLDEQGENLYTKEIEVDENREYQYKFKVGHGNNWDLDEQSPTTYDNAGNVNNLLSIASKESTSPMKQTWAANDGKSTRKSTTSEHTEPIKSRVFSTIEVDETRHDAPELKLTTDDNDRETTPKKVPATPLFAHESLGAYDFEVVDDGFDHSLSPSVSRGLSTSSFAALESHPATTDVDDPTIEQFPCDKSSVMSTLRKLSTSVGETPVGLEDGLASPELVSRRASVDSNADSQPSPGSLSPTSTRKRDMEEPSRAVRTNKTRNKADDVAIGSASDDEGPQMKGFKVHLAQTIRETRESQASSVALSPKSPEKMTGESSKSIRKTSWQPDGGDMPIEARWFVTGGLVLLALGITWWKSCRDWVASYTSRNLDKQEIVTVAQPWLNQRFFTRGIKEKPSRMVLSDQVHRAPAHRGGRRESAGPFGSMNRTTANIDPARKAARAEAFARKTDKPGRRNSKQGLEERKALKMQRALAAVSYGRRNLTKERMAEYDDFDQFDLLPELKSAITDELFKGMTDIKPTPVQRLAIPAILGQQKPGEPSKEYAGHRSFLLAAETGSGKTLSYLLPAVNAVKIEEAEDPDIKAYKERYETEKARMESSKGKGKLMDEPHPTMARPKVIVLVPTAELAQQIGKVSKKLSHVVKYKTEMLSSDLKPQQIQRNLYSPRGLDVVISTPHLLASIADSDPNILSRVSHLIVDEADSLLDRSFSSVTTSIIERAMPSLKALVCCSATIPRKLNNYLAVTYPKMHRITTPNLHAIPRRVQLGVIDVSKEPYRNKKDLACADALYSIGKEGMAHEGMNKDLVDLRRVLVFVNEREKTEQLAEYLRTWGIDAQALHRDTTEKRHDEILETFTTKDTITVPATPIKGRGKLGNVKVLVVTDLASRGIDTLAVRHVILYDVPHTTIDFIHRLGRAGRMGRRGRGIVLVGNDDRKDVVADVKRSMFEGQALI

SEQ ID NO: 3260 - protein, 463 aa, Unknown
  Kingdom: Fungi, Phylum: Ascomycota
MDFNSSSPFPEGVISFLDTDLYKLTMQCAVFKFFKEIPVTYAFTNRTPEKRLSRAAFVWLQEQIRKLGNISLSTDEYRFLKQHCDYLTADYLEFLKDFQLRPREQVELTFTAIGVDTGSDNDIGDVDIKIKGAWVDTILYEIPLLALTSEAYFRFMDTDWNYDGQEEQAYEKGMQLLEAGCITSEFGTRRRRDYHTQALVFRGLVKASKAAAEKGMPGKLSGTSNVHLAMRFNIPPVGTVAHEWFMGIAAIVGDYKSATETALRHWVACFGPKLAIALTDTFGTREFLSAFRSPIQTIEGGFSAETFQKSDGTMKTYAEMFTGVRQDSGDPADYVKLLRKYYDESGVKEKKTIVFSDSLNIERCLEYKKLSEDYGFQPTFGVGTFLTNDFTHLKTGTKSVPLNIVIKLSSAAGRPAIKISDNAGKNTGDKDTVEKVKKELGYVEREWSEGDETARWGRDEGKS

SEQ ID NO: 3261 - protein, 481 aa, Unknown
  Kingdom: Fungi, Phylum: Ascomycota
MANSSLPSSDDLDKEKTVLPPDSMTSHAMVADDALPAEQDSDSDSTQHDGQSRGDGRQSAETMSVASRIMSRITTRSSVAPSPPPDGGFTAWMVVVAGHLVVMCTWGVINSFGAFQAYYLSALDRPPSDISWIGSFQVFLLFFIGTFTGRATDAGFLRPCLITGVVLVALGVFSAAQCTQYWQLFLAQGVCVGLGNGFLFCPTIAVTSTYWQKNRALAIGLGACGSATGGLIFPSMVRQLLPSIGFAWTMRSIGFIQIGCLLIALIFLKARIPPRKTGSIVDFASFKELDYTCYAIGAFLCFWGVYVPFFYLSSYAREVRGMSYSTALDLLLLMNGVGIIGRLVPSFLADKLGAVNMYLPMAIGSAILLYSWSAVDNSAGLYGWACIYGIFAGGIQAMFPAALSSLTLDPRKQGTRIGMTFTIVSFAVLTGPPLAGVLISKFGYLAAQMFAGSSIALGSGFMWVAREVRRKRSGQKMVSKV

SEQ ID NO: 3262 - protein, 440 aa, Unknown
  Kingdom: Fungi, Phylum: Ascomycota
MADPLLSDLCAICHVSTPKYKCPRCNLRTCSLACIKKHKAWSECSGERDATAYVRPSKLRTPAGVDHDYNFLHGIERAVERSERVLIGDRGIIQAEELRPLTMQEVRWKTGRDGRKRKVVTTRVLKEAKGRSFERFLAQRLKKLNVRILCAPMGMARQKENNTTLNRRSGRINWQVEWFALDQNGAAEHTNTKAKRLLSKVMDDTPLYQAYHDLLEEKSCETPAVAKTTSRAKTHQSQSSSDSRWTADMDGLQDALTGMWLSPAEVDAEEDERRRKQYQFFLGSTSRRSDLPTKMAKLDSGDCLREILRNGQVLEFPTIYVLAGGESATLPAGFVLGRKESALPAEQEGHGTKRKGGPNNQGRGGARSAKKHKQNEGGAGAREEGEVGSDVENGNEAGTGDKSSGVGLEAGEVIGEESFGEEDEVMDENDETSSSGSDSD

SEQ ID NO: 3263 - protein, 1823 aa, Unknown
  Kingdom: Fungi, Phylum: Ascomycota
MADPTPEQRKLQLVEKLEFRILGVANQEKKLHDLLQTFLPPLILEVGSEYAAVRTRVIQVLGRLKTFIQPPSIVLPVPKLLDQYKSIDSQLAKQLDLSFILHSIERIDDDDRRDLIPKALAGSAAERSRPSGPGFLQVIFRLLLDARIPPRGSKEDGAFRKAIGLEDEADAAFLAEMIGIFLRLKLPTATQDWRQSNPGLTSAEIALFSVDDPKKLKIYQRLSELKTKLVTLLASGAFTDDEKFLPALYGSSSFDGRVATTAEEVIKRSSVSLEDETLVFKLFAAHGKLPAAYRTKILGMLSKSSTSTTMSDQILKVVHLDFMEEGLDASAQGLAPASALERTKLHKALFQYISWVARIGPTKEGFSIGPQLIDVMKSYIESQGWPQPTSTSHDDIALRSRAYETIGMLARSAKMPIAKRLDLAEWLFRSLSEDPINDAVVNIDGALSSLTANVSPEDGAKEVALRPMLLKYMSLADEPPAARSTRHAVVKWANQCLPLSDIHGRWIDILAIGGQPTERNDVIEQGHKGLDPWSYFVHLEGQPPLPQWKDMVQTFFGPEITAESTKPDSNTDKRPFSETGPFENFKGPRLAAFPVALRYCKQMMFLAALKDFKIEPSWMQSLDALVKTDIQTREQIREYLRSSDEDTLVYYLSACLAGAFQEDSPIAEDCIRCFVEVASLSSRAMIGQLTAQSTSLLPLIRSNNKEKRSLASRALGIIAAHPSNTGDSIRNWFQTLLALAANAETAIGPDLNAAEGALLAYSHLSTRVTYYGVDTVSDSDVAYPQGLLVAAGLFPSLQDAVYDTFSQFWSARRGVPTSEGSYKLNEVITKLETFAKTGNEKAIQALGRLAMAIDAEPSADADASLVDRWGTVGAILTKLFALHEIKQVEVHFTVGEAITAAIARWDSDSVKLTLDVDTPTKAYFVGARETLVDEVLTKLFKDCKATKPSLLKASGIWLFSIVQYCSHLEQVQSRLREAQAAFMRLLSARDELVQETASRGLSLVYERGDEDLKSALVKDLVSAFTGTGTQLKVEQDTELFEPGALPTGEGSSVTSYKDIVNLANEVGDQRLVYKFMSLAANAATWSTRSAFGRFGLSNILGDSEVDPKLYPKLFRYRFDPNTNVQRSMDDIWKALVKDSAAVIDTHFDAIIEDLLKSILGREWRMREASCAAVSDLLQGRPYVQYEKHYRDVWTAALKVLDDVKGSVREAALKLCMTLSNGLVRQLEESNNVAAAKAMMKEALPFLLSDKGVESSVEDVQLFATITVLKIAKQGGKSLKPFIPDMVQQLLGLLSTIEPQQINYQYQRAGEDSRDKIDRLRSQMVNRSPISEAIENALRFVDADVMQELAPRLENTIKTAIGMPTKIGCSRVLSTLFTRHAQDIEQVSGRFLQLMEKQIIDKNDEVSQAYARASAYMIRTVPEASKERFFAKLMDLYFNAEEDARRQKVSDVIMAVSKVSSDHFSAYQTQLLPFAYLGSHDPDDYTSKMFKEVWEQHAGSSRTVTRYVPEVSSLVERCMDTAQWALRNGGAFTVAAMAADVASTSTATAHISEANLKLIWPVFEKALAMKSFAGKEKVLASFPGFVEKGQALWKSDDKIAAQMKKIAIREAKRNNEEYRVHAFTSLWKFAKAREDIDMLQDIAEIVVPYLDELKEENADKMDVDSKEDLAIKTAKHGFEAVARGYNREKMSKTLEAVLLEILKILGPYLASAKFAQIKREIWYACVKDMMNDATKKTSATPAASKTSVAVDLLQTLDLDQAEAGIESHRTRRAEAALSVIKGAATGIFDFGPQKGEVESAVRAALEKERAQDVQKVWKQCLEHL

SEQ ID NO: 3264 - protein, 343 aa, Unknown
  Kingdom: Fungi, Phylum: Ascomycota
MSHHEQSQDSISETSVSKQVHEKHERHKVTQGGHVMHEEPSPTHHAPYAPNPPKWVSIRETMQDAFSEFLGTMILILFGDGVVAQVVLSGGEKGDYQSISWGWGIGVMLGVYASGKSGGHINPAVTFTNCVFRGHPWRKFPIYMLAQVLGAMAGAAIVYGNYKSAIDMFEGGAGIRTVTGDTATAGVFCTYPAPFMTRTGMFFSEVVASSILMMCIYAMADDNNIGAGKLMPLGLFFLIFGIGACFGWETGYAINLARDFGPRLVSYMLGYGHEVWSAGGYYFWIPMVAPFFGCLLGAFIYDLLIYTGADSPINEPWLGLQRLTRPRRDVWSNTHRSAAGSSA

SEQ ID NO: 3265 - protein, 550 aa, Unknown
  Kingdom: Fungi, Phylum: Ascomycota
MTSPAKRTPVRRPSSGSDDTGIASFSIRRGTLASLIRSRSNQTLSGSYLPLTAGNASDDEESLLARHRDGEDITKLLQDERRLTQLLNGPGDRSMSLLGKSNPRYRWERYWKPESELKNMKKPLRQYYERTNELIQQYMYIDCLLDSSIPHDLLNEYSAELEASAFRPVNVPVTIQEESSTQPSSLSSTPGPAYGSITPTSNGPTSNNLPQKRTPKDIFRSSESMPLLLQQQEAEDAHEEDDHPPSIHSDGSGPRPYLPWLEDAEVDSDDPVVTLAIWVNLVANTILLADAVLDFLSTAIVWLTTRLISAGQKDQFRYPVGRKRLEPVGVLVFSIIMITSFVQVGLECISRLMSPEHEILQLGVPAIVIMVTTIIIKGLCWIWCRLVRNSSVRALAEDAKTDVIFNAGSILFPIVGFYGRVWWLDAFGGLLLSLVVIFNWSQTSAHHVRNLTGFSAQPDERNLLLYLTMRFATSIRQIQNLRAYHAGDKLFVEADIVLPAHMPLKDSHDLSEVLTYFLESVPIVDRAFVHVDYTSYNAPTHIVKTSAAAS

SEQ ID NO: 3266 - protein, 604 aa, Unknown
  Kingdom: Fungi, Phylum: Ascomycota
MHSPALSQGPIPRDNGTPVNGTQHQKPVGEVKAVVGTDGYTELAGLIKSSKPEIVRQVVRDLWQRCLTGSDFHIGFILNTALHHASTQVLDQAVQDFGGKFASRTKHKWVEHLSTEDVDDLADVLFQKGSDRFLDRALARRFETISGRALVNALARAERLGYDTRDIVEEKDSNKSEQVIPSMHPSRPAGYAPSAPVISQQAPSQTFTPQYSQQPRQQQQPPQMAYRPPPPPPLYPVTHPTPAEEVDAAKQGIVFCDTCGRPCSGPVAVENHLRKRACANHVIKLERLGSDTCLHCGVFFSSNGGLLYHNKSNVCGLYGESVQQKMMALLTERAKVPAVKPVPITSSQPSQAPMYHTSGGQQYPPPTSLRSSPARVDFADAYNALTPDQQSRFDADMKAAEDMYGGQMRDAMALPPAEAELELAKIKNRLNSRQSNLRKRYGIKLRDRRTKAQIDADNARIAANSPQPPLSQGVKRPFPSQDDSPRKRVPLHAMSGLNGAAASAQMTDPTLGTAPAQSRAPLEQRPQPAVQAPEAPAASVTPTAAPQRSAAAPEAHIHGGGSLTDPVTIDDEQSTAATSSGRPSPPATENDTAGKSRPPSAGAA

SEQ ID NO: 3267 - protein, 505 aa, Unknown
  Kingdom: Fungi, Phylum: Ascomycota
MTMSPTVLKTSTGSITGVTDDRFDSPIEHYRGIQYGSIGKRFARPELLSLTGDLNATQFGPQCPQARVDVGHLLRIPPQIETTRVDEDEFKCLNLNVSRPAAETIRDKGLLPVLVWIHGGSQCVTFPSAATAVGDPTRLVADSATLRKPAIIVTFNYRLNIFAFGDGEGERNLALQDQRLAIEWVYKHIEEFGGDPEQITLAGESAGAVYVHAHLLSKTPLTYIRRAALASGSLHLSPPLPLDAGSGLVARIEADLSSRGDGLQDAPAASLVQAVENCSINSMWLQNDPELDGWEDRTEKTEALLISDVEYESAIWKTGVEKMKAEEIASIIEECCEKSSKLQELYHIYPDRPASCYYGALDLINDARFAFPAFDISEKWRKTSPGNVYQCIVDEPNPWQPSSRAHHAVDLIFLFGGIDLSFNPAAERSAAKLRESWLTFVHGERPWASDAIWGFGPFGRCSEVDEAEYKTRRRVQCFEHLRSLGIEKCRQVSGRLAAGRVSLLN

SEQ ID NO: 3268 - protein, 1116 aa, Unknown
  Kingdom: Fungi, Phylum: Ascomycota
MAIPRKRLVVIGLGMVGIAFIEKVLKYDARDREYDITVLGEEAHLAYNRVGLTTFFSHRKVEELYLNPSEWYTDLPEGALGYHVNSKVIAIDSEAKTVACENGDVVSYDILVLATGSDAILPRHTPGHDATGVFVYRTIDDLMNLISFAEERKGTTGLVVGGGLLGLEAAKAMMDLECYGKVGLIERNGWVMNRQLDGEAGTMVVNQIRDLGLEVNLKKRVGEIKVDETNHVTGVVYEDGEHMDCSTICFAIGVSARDDLAKASGIACEERGNGIIVQDDLSTNISDIYAIGECASWKNQTFGLIAPGIEMADVLAFNLTQAKLHAPRVYNRPDISTKLKLLGVDVASFGDYFADRDGPKYLPPKYKRAKTNGINGTNGHNGTNGVNGASKEPSTSNVKSLTYKDPFQNIYKKYIFTQDGKYLLGGMMIGDTKDYSKLVQMIKKNQELEVPPGELILGAKKDGDEGDDLDDDAQVCSCQNVTKGDIVGCVKDGSCTDVGAIKACTKAGTGCGGCMPLVTTIFNKTMLSMGNEVKNHVCSHFNYSRAELYHIVMVKRLKTFPDVMRDAGNDASSDGCEFCKPAIGSIFASLWNRHVMDKPTHGLQDTNDRYLGNIQRDGTYSVVPRVSGGEITPDKLVVIGEVAQKYNLYTKITGGQRIDLFGAKKQDLLDIWGRLVEGGMESGHAYAKSLRTVKSCVGSSWCRYGIGDSVGMAVRVEERYKSIRAPHKLKGGVSGCVRECAEAQSKDFGLIATEKGFNIFVGGNGGAKPRHAELFARDVPPSEVIPILDRYLMFYIRTADRLQRTARWMEALPGGLKYLQEVILEDKLGICESLESQMQELVDSFFDEWAEAINTPSIAKKFRQFHNTTEETQNMEIEPERGQVRPVFWPTESAEADFKGLREKWSSMAWEPVIEVKHFDGADDMPNGISANIKRGDTQLAVWRYRGKFYATQQMCPHKRAFVLSDGLLGQDPNKSCDKEKPGSGEGPQPSAAPWVSCPHHKRNFDLSSGACKTDTALSIATFPVEVRPEDGMLYLQLPPVEELDAELGTKKWKVKKGDDNGEGMDKFKELDKKINFVGRRGKKPGVKPTINGAAGTMMKRPVELMAGGCGSAPDW

SEQ ID NO: 3269 - protein, 536 aa, Unknown
  Kingdom: Fungi, Phylum: Ascomycota
MESIDKRPSEGISHAEAERGSTMLKKLETHSDADRLAQLGYQAELKRTFSLPSLIALCLCLMATWEATCAVVAQALAGGGAPCLFYNFVITFICTVALALSMAEIASIYPTAGGQYHWVAALHPARGRRTMAWLTGWISVGGQLVLSASAAFAAALMIQGLIILNNPDYEATRWQGMLLYWAILCYSAAINTFGERILPTANLVAGGFHVLGFVIIFIILGVKSDKNSADFVFTETYNQTGWSNSGIAWLTGLISSLYPFLGYDATCHLAEELPHASRNVPLAMIGAVVANGLMGLIFVVMLLFSTGPLEEILDTATGLPFIRIFLDATKSRVGTNLMVLFPLIIAITANVAGVTSTSRTLWAFARDDATPFSKYFSRISKSRDVPVRAIFLITGLMACLGLIYIGNTTAYNAILAMAVIGMYISYAVPIACMLFNGRPYVLAASDYGWFKLPKWLGITVNSISLAWWLLCLVFMTFPSLMPVTEFNMNYSSVVIVGWCAFGVLYYAIWGRKKFVMPVVEASVVTGIGNSMIEVGR

SEQ ID NO: 3270 - protein, 442 aa, Unknown
  Kingdom: Fungi, Phylum: Ascomycota
MGSNKADHAEGEFRKFLPDLSKPRFIALQKQNAYEYATQFKEKGNPPWLHALYLKWLELYKEPFKGITNDGVLRLKLFDLADEQVPVSAIADAANSLLAALTEADCAKILNHIDSPEWRTWSNPEFLLSPKGIRLDETDFTIRELILDVLRKTLSPEGFEKAMGAMRINGFLGELVNARSVCNEFSYNFCIFGLPSKSKPWGFSFYGHHLCLNIFLYKSQMVISPWFTGAEPNEIDHGPYSGTRILQREDRLGLRLMQSLNPSQQQKAQIYKLLRDPSMAWGRWNHDDQRHLCGAYRDNRVVPYEGITVSLMTNEQKQLVEDIIAEFLLYLPYRSRELRLAQVRKYFEETYFCWIGGFGDSDAFYYRIQSPVIIVEFDHHSGVFLDNEEPAKFHIHTLLRTPNGGDYGKALMPLLPGEDQAFVWEEDGTSQVESSKQGFQDK

SEQ ID NO: 3271 - protein, 164 aa, Unknown
  Kingdom: Fungi, Phylum: Ascomycota
MADHIHPHPQGQSHEWHNGLMTCTPIGDCCLGTWCPCILYGRTLHRERDPTLANYEKTNDDCKRMGHLQCWTSCGFIYVKRHRTELREKYGIPGTTKNDCWATFCCLPCAQIQMDKEVALREAHRINKDGYRPQDGMTMPNQEPKAPVGQKPMSAAPQPGANGV

SEQ ID NO: 3272 - protein, 467 aa, Unknown
  Kingdom: Fungi, Phylum: Ascomycota
MASVARLAGRGAKRLCLRPAPFTARTISTTAQRRYATPEMGTRLLPTDSDFGELKDPYGLASEAIKAAKRKNDNSVEDRKVRHYTVNFGPQHPAAHGVLRLILELNGEEIVRADPHVGLLHRGTEKLIEYKTYLQALPYFDRLDYVSMMTNEQCFSLAVEKLLNIEIPERAKFIRTMFGELTRILNHLMAVLTHAMDVGALTPFLWGFEEREKLMEFYERVSGARMHAAYVRPGGVHQDIPAGLLDDIYQWATQFGDRLDETEEMLTDNRIWIERLRGVGVVSAAEALNLSFTGVMLRGSGVPWDIRKSQPYDAYDQVEFDVPVGVNGDCYDRYLCRMEEFRQSLRIVHQCLNKMPAGPVRVEDYKISPPPRAAMKENMEALIHHFLLYTKGYAVPPGETYSAIEAPKGEMGVYVVSDGSERPYRCHIRAPGFANLSGFDHVAKGHLLADAVACIGTMDLVFGEVDR

SEQ ID NO: 3273 - protein, 371 aa, Unknown
  Kingdom: Fungi, Phylum: Ascomycota
MSYSKQAEARQEAQRNQDDAPPPAYENADDAALAEPSMPPSFATTVQPSSSQSQTHISDNIASPEQFTDEKRAPATPSNPASRSNTNTTTAGPSTSEAIPTIDSPFNFPPAYTLNSTPSASGLTARPIAIPQISPSPTSRFLSVYPPLLLSYGITSPTFTSFLDTISAFLTAKVSDRAISHAGDMAKTIGEQHKNSFKNVVSHAKAVGKDIGKNAKKGNVIGAALGVVGGAVTIPLFTVGGIIGSAASLPGMTIAAAVKKPKTPRQRAVAYIAVAIEKWFTPRGLYAVLLDSQELAEVLKVPVSTIATKAADDEGAAQVQLQKLEPHIEALEVQGKESVLELGTQTMWLVLSKAVVAEEEVEDGQASEVRR

SEQ ID NO: 3274 - protein, 973 aa, Unknown
  Kingdom: Fungi, Phylum: Ascomycota
MATNGAPDAFAPSDVLAAVMTMRSGEQESKKKAHEYLEQFQKSKGSWGTIIGILQSAEAAPEATLFAAITLRGKVITYDLATQVPSSELPSLRNQILLLLKHFAAGPKPIRVQLCVCLAILAIQMKEWDDVLPSVVQALSDSPQSHACILDFLRVLPEEVTEGRKITLSEEDLAARTQALLGDNTTQVVQLLINYAQSSPSAAKDPQLMECITSWLREVPVGDVVSSPLLNIIFEGVTSDECSQEASECLCTILRETRDVDESQDVIEVLYPKTLGLKSQIAAADEEEDTDKLKALTKVFSNAAESWVVAIARQPTQFRPLVEAVLECAARDKERDVIEHTFNFWYELKQYLVLERYIQSRVELNDIYAELVDIFLRHLRFPQPDSGSETDLFDGDREQEEKFREFRHQMGDTLKDACEVLGVTDCLTKVLHSIQLWMQKHASQVKDTQVPNWQELEAPLFAMRALGRMVDKEENIVLPQLMPLLVQIPSHEKLRFATIMVLGRYTEWTAEHPEYLEPQFNYIVSSFQSDSKEIIRAAALSIKYFCTDCKHLLSGQVLQLQKFYDEVLDKLPDVSKEEITEGVANVVAVQPAEETYQLLKLYCDPLIQRLMTKANNATDEESKLALADHLQLITKFVQVVMPAVAAGQENPAVKYWQETFPVLSTVLDNFLNFSPICERICRCWRSMIISYRTAMAPLLPDMANKLAIGFNNSREGCFLWVTSSILREFSEDREHVDQGTTDNIYTFFEAQATTFLRVMTELEPKELPDVIDDFFRLLIDALLYFSTKLMPSHLMGSIFEASIYALTLEQRDPLSSTLHFLRDLLSYGGDNPATGEGLPEASAAELRGIVKNLLSAHGGSLVKQVMAGMMITFPRDCFADGSGVLLALFELLPQQTTEWVASTIQMLPEGTVSPAEADRLMTKIREKLQSNDAGGVRGVRTLLQDFTNTYRRRNVAPRDGLGQLEATRFQFGG

SEQ ID NO: 3275 - protein, 602 aa, Unknown
  Kingdom: Fungi, Phylum: Ascomycota
MADTADMSILASAGLLQTSLIWIAYAVAVGLCLIAAVITTFTWQTPRERSAIVSIVAIISLTSLLATVLLLPVDIALVSATSSASRGAKKDWATPERVESILFTLKVVYYCLYSFDALLCLLVIPFSYFWYEEYDEIEFEEEGRTWTSRFLAAAKYTTFFLALVVVLFLLGFFVPAAGDSSKDNWDLDYYKKLISQNHGEKALTFALGLLITLGTILYVVYTGTGLALLPISLIKSAPSISAPQLSENTASQLDANRERQRQLEMRNTGNPDGMPRKERRELDALIREEQTLVRRERLAAEAQGEGRSKLYQTWLKLCALFRPIKMIGGILLLLLSLLIWVSMLITGIDKAKNSVCKARCGYILGQIHVFQPINFIFVRTAKVFPVDYIIMALLVLFLFSSSITGVATVGIRFLWVRIFQIRRGRTAPQALLIATVMLALIILAINYSVAMLMAPQYATYGTQMFCSNEPRHGGEQPDCSGHEDLILPCSEALKFNHAKDICTPSVMSTFLNRITITWPFFGIVDFWAQFAFLGLFLVVFITALFRTPKLNMADIDEDAEADEEESLLASTGRRFGATWQDVRGKTGSASRGERNGSGSSEA

SEQ ID NO: 3276 - protein, 3970 aa, Unknown
  Kingdom: Fungi, Phylum: Ascomycota
MGKITKPMQAKHRDTLSPWLDAFVQSAAQTPIPQLPEKLSRFPSRWPFGRGDLYHWTPLLNRFDTILEHFSKTYQLNEGPQTRDFGCELLLGHPQIEDFGEKKHWTQSELTEIGFPVDGDRELIEAVLKFTRMLVDNCGNRSIYASSAHLNDLLNTTSLSILIATLEVGSELAQRYQASVKRISHQQSRHISSQLLANHYNIELERVQQLALPFVKTPLIRLSETTSSVSPVVSSKGKEKAVVPSSKSAAVTHANDLIAISTSDDIAWKGWGDVKVIYYPDSSASGTEFLEFGRPSAPSTPTPLRRSTTMTPQQGSRSRNFSADDSSPVAPRTPAHQDDSSGSGQKSFEVPQSVVVNASIYDLLERLPKDMPAAARYEAFHRLRVAKALTSSREQRQRLLATRLLAITNLAYIHPEASFIEKVLRHDIDETRRYQLVYQLAELIHPPSESVSNIPLWLQTIGLGLIEAVAGFQAKSGDVLSALNANVNHGVLLYVIRKAVAGMKEDAPEQHGDAVTETDAWRTKLFSLTLFLAMMTRVGSDLVHAGLMEVLVEMLRLRSKVAQRHHSMVLAFLDSLIWTYQSAFTCFFNAEGLDAISDLIVDTVKESKALREAGKGTTVDQQSGAVDYRIPYYQQQTLKWLLKFVHHIMSNSFSFSGNTDRLLRNLADKSELLGSLRLTIEDKESFGSIVWTHSVTILSDFINNDPTSFAAISESGMIRTFLEAITGNKITETNTEALSQTDEPDENATSPASDEGGSIVADGDAHPPPEDSLRQSKRGGLAQGILPSSDAISVVPAVLNSISLNATGMKLVVDSRALEGFLEIFESPAHVKCMQEDHDQDLAGNIGGSFDELARHHPRLRKAISNAVIDMVARLRVLGIDNANKLGWGARLHRVTDVPGEKDDATEADSTSAVQVTRPPTSDSDVPMEDATPQPVNQEHTKSQNNKQIKKDDFTPYIYALANFLVHYLSNTVLRETFIEQGGIELLLDLVESPSLPDNFGSVYASKAMVTVVKEAIDASPIRGLPSLLNRTQAALDLLRPLAAQTEQSAPYFANYILPKSEQNSDQRGPGSLEEATQLVKAFLNSQQLLRILAECFVNNRNGLAFYPVNAYDLYLRVIDTIGPLVRGILAEEMVEMKAVPLHWNFGREGGSELRNGNRAALDLEGASLPDVITATEDLSARGGPDADIKSLDPTPEEQASPQYRNYKVLRALQHLMVPQVFPLFQSAGKALFPKRDSQNLPFNRARQLDVAKAIGHAILSHLEPSLSAAGPGTNQFHYWTIMLHTIQELLVDRSPARDRGPATTLILPVLLSFKEQNGFTVLNSMLSSFAAAIKPTGTVEEDATSKIAIFGLKKVLDLYFVLVNGKMIHDACNSFNLLKSRDSRNGSIGLVPQFVLEIRGSVLPAVTQLWQSAVVDNLPDPVVRRLLEILKAIAQADYETPPVPREAREKEPFCLLKYDDTRFDWQQYRGVMLELRPQLNDTELLAEAMFRASGDPGLARQYYESHKDGKAGARNPVPEVDAVTSSFYDDATMASESSEAQGDSSAQNDEMSLDAADVADILTNVLSAPREHNEIASSPSSPYHAEITFSKEKLDEYRTTLKANLIDRCLDVTRAHPDVVIEVSDLIQSLVLRGQKQDAQQEDVGSTLASALSSLGFDEEDKNRNAKCIASYAHLLAMLMRDEKFLERNVDTLRANVGEYVGYLKVISDSNESLPPWVPYILLILEILLCRDARPFEVEWNAPKSLDDEVREPVLKERTPYINDSERLSILEHVLDLLPRVGQEEVLATAVLRMLVILTRNRQLAKVVGNKRNLQRLFLMAKQLSGFGSDRMRQMKASSHTLTILRHVIEDEETIKQVMRNEILNDFPHIRHNTSRQQLDLTTFMRAMVPTALREPEIFLEVMGELFEFSRWVAPGSESSRSHYLVPKVDVNATGESKTSTAHLEDIKPSTEVVDKDMTDAPKPSELKRPVVDNPDGVVHFLLCELLTYREVDDLVVSTESKSDSKADPKSEGGQAGPSTEGSPSSAGDGEKKSSRPVFKPDENPLFIYRCFLLSCLTELLQSYNKAKVEFINFKRSAPPVLATGTPVKPRSSVLNYLIYDLLCQGNLSGTTDTVDSKKRAAVSQHAQKVLVALVSKPKERTRGQNQDKFAYDDEPDLLFVRKFVLDIILKAYEKEPSSDVSLEIRYSRMQCLAELMNHMIGDRDKDAVTSTRGAHGNTSHSHSQMRRLMYEKGFLDKLTSSIAEINLNFPGVKRAIKYILRVLRILTDTAKELSQLNILPSDSAVDDVDEDLASSSSLSSLDDTDREETPDLYRNSALGMLEPREDEYSDADEDEDEEMYGEEYDEEMDYGEEEFSDREDNVSDEEELTHMGEIEGLHGEPGVVEVIMDDDDEEDEDESGSSDDDDDDDMDSDEIDDDDVEIIDEADEEGNSEWESDSDADHDDDGDEEIDYEAEVQDGDEAEHFDPSVAPQLNRLARAMMGEPGPELMDDLDEHYIDDDDHDEEDEDEDEDEAEDEYIYDDYPDLAEFDGQIPPSFLGWDGENPEVDDRHRHFFVSINDGRSRPLRVGPRSFMPVPGSGLTVHRDGGVGDFRSFFTRAHRPGGPPPPEDGVNPLLRRMAPPADAQQRRRAHHAHDWNVLDDNVRRGFDGTMAILGELAQSLPPFGGERGRDVALQFRIRGPNGLREADFPPLLGRSRGDRREGLISEPQQAVAFPIETTLDRYQEEVRMVFGHSQGTEILKLVTRITAKLTPAAMELERKAKAEEAEKRKKEEEERQKREEERARQQAREAEEKAERQRKEEEEREAAERAAREAAANDPTSVDNGPMEGIETARSPSPTAGSGEQATAPTSNEPRVMTMIDGQEVDVTDLGIDPDYLAALPEEFRAEVIAQTVSSRRAEARQQASSSGETSEEFREFLEALPDELRMEIEQQERQDQRRRAREDSRRLVPLPGTLDHSADMDTASILATFPPALRDQVLMDHGSELMDQLPPEMAAQARALSQHFRENLTEGSPAHPQGSGNTARQGNEPMEVTKPQGRVVVQMLDKAGVATLLRLMFMTQPLTIRNYLFSVFADVCENRQNRLEVISTVLQILQEGSIDMHAVERSFGQLSLKARKQKEKERDAEQRTPQSIKRTLTSLSVASSGPANSDTSPLLIIQQCLDLLVDLSTKNPHVPYLFLTEHEAVGATLKRAMNRKGKNKDSRAHKFAVNSLLTLLDRDLVMESSVVMTHLADLLNRVTLPLLSLERRRREAGGLKDRKAELPETEAVTASEQPTAEVSTNESADNAAAADAGAAGTAQSEKPEASTQNNKKKPREMQPPIIPPQNLTLVVRIFVARECSSKTFQNTISTIKNLSAIEGAKSIFGKELVHQARVLSKNIVSDLDELLPQIEKAVTGTEIQGVALAKFSPGASEQNKLLRVLTALDHLFETKKKSDDQEEQQREKDDLLMALYHNSTFSTMWEKLSACLRAIHQRENMINVATILLPLIESLMVVCKNTTSNDEPSQPSGGKDAETAMVHPSVSVTTPISETRPIIESRTANLFFGFTEEHRRILNELVRNNPKLMSGTFSLLVKNPKVLEFDNKRNYFNRSVHLRSGSHHNRPSYPTLQLSVRREHVFLDSFKHLYFKSGEEMKFGKLNIRFNGEEGVDAGGVSREWFQAMARQMFDPNYALFVPVSSDRTTFHPNNLSGINEEHLLFFKFIGRIIGKALYEGRLLDCYFSRAVYKRILGKSVSVKDMESFDPDYYKSLCWMLDNDITGIITESFSVDDDVFGVVNTVDLKPGGRDIPVTQENKEEYVRLVVEHKLLSSVKDQMEHFLKGFHDIIPAELISIFNEQELELLISGLPDIDIDDWKSNTEYQNYTPSSQQIQWFWRAVRSFDKEELAKLLQFVTGTSKVPLNGFKELEGMNGVNRFNIHRAYGDKNRLPTSHTCFNQLDLPEYDSYDSLRAQIVQAITAGSDYFGFA

SEQ ID NO: 3277 - protein, 733 aa, Unknown
  Kingdom: Fungi, Phylum: Ascomycota
MSAEIRWQSTFEVIPPEILPQGQLLGDKISLPQSALEGLLAAASSTTNNNSYLYTGQPVDQTSLPSPLTFRLKSSKTQKEVYAGILEFSAPDGTVAISPLIADALGIASTTKPVADDASGTAHQERITIEVCHVSKGDYVRLRPLEAGYDVDDWKALLERQLRNGHTTLTRGTTLSVRGLRNEEFRFLVDKLSPDEPAICVVDTDLEVDIEALDEEQARETLRQLVSKGHGSSAQASQDGGQLDIWKPREGKVTPGSYVDYILPSWDRSQPLGISITTVDDTDAELIDFFVSPKSSRQRALPRETEHVFGSFSSAANGPRAIQLAPTNVELDGAESLMISVHGTVSSDPTQSRTGNGIPFSIRAQTVKSDDIGSTSRKLAQPSPDDEECQNCKQWVPKRSMVLHQNFCLRNNIRCPQCDAVFKKGSPEFEQHWHCELDDASGASAQSKEKHDSIYHTTQQCPSCEFSTNSIPDLARHRTSVCPGKLILCRFCHLEVPQEGDPFNPSPEVIMSGLTAHELADGARTTNCHLCGKIVRLRDMDAHMKHHELDKTNRDLPPICRNINCGRTLHGVGPKGQIRYIPPQGEDTRTGLGLCAVCFGPLYVSMHDPENKALKRRMERRYLGQMMTGCGKSHCHNEWCKTGRANSGQEAKPSTAQGVLPLVKPLLAEATDSSAPLYFCVDESSHKQRQTAEMVAAEGVWDLHWTLAAAEAEGGDPAKMRDWLQAWAPSKFS

SEQ ID NO: 3278 - protein, 1316 aa, Unknown
  Kingdom: Fungi, Phylum: Ascomycota
MSSEAELEDELAVQRTILSSLNGHSFDGVEAERAEIRATILELQRRLRQSQGNAHAHGRQAQQNGEVEHRPSTPSAPARPRDQPGMALPQYANDIWSDPGSGSLASHSRKRSYDTTTLGVKSEKQNKSRRPTPTPPSGGYKSPFSTQGSEVIDLTGLDDGDDARDYLARQKREEDRRAQERRDREYALSISGNGGAPAFQSSSSGSPSRDAFSRLMDVQRANAASQAPPDDGASSLQPSSAAHQHLPPRRVVSPFAFDENLRLPGAYDPSWDEVRTAGPSGVAPVSASPYGSVSSSRLRDLHSHTSGGSSHGPVGPLRVVPEGHTGGSGGPYNQFTYPWMAPTVPNLSPRTQGSGNPFANSGQNHAVMTSPGSASLGITNSPQNQALTGRSPRTRANMPAWGSFRQQMQTGALNGTLSNIINSTSQYDFANRTDGMGNSLPSHLHRLLDDTELGADPEMTARELEELLQNIEPDIEVPKNLQGVKPDALKTPLYKHQEVALTWMKKMEDGTNKGGILADDMGLGKTISTLALIHERKSSSRPKVRSPIDGQQYDANDYQTNLIIAPVALMRQWEEEIKMKTESRYKLSVFVYHGKKASVDHLLGYDVVLTTYGTVAAQLKRLEKWHEDRKDRALDYNDRDLAVKCPLLHPQKSRFHRVILDEAQCIKNKDTQTAKACHQIDAKFRWCLTGTPMMNGVSELYSLLKFLRIRPYNSWVEFRQAFGTLFGKKGDSKSMAMRRLQGLLKAILLRRKKDSLIDGKPIVELPKKTEEVSYAVLSTDERDFYTQLESKAQVIFNKYLREGSIGKNYANVLVLLLRLRQACCHPHLNLDVDDAVPAVDDDMLERVRRLEPSTVDRIKQIDAFECPVCYDAVTSPSFFFPCGHDCCRPCLAQLVDNAAQSNIQAGNESGKARCIACRAEFSPKDCFSFEAFQEVHMPVEFARRQAETEAARDSDTDGSDSDESHYDSDAQRDADDEGDADANGNLRDFVVPDSSEELDEPLPPMSSISKFSKSLGKERASSESSAEGQVKPKTEVKTEVKREIKGELKNEGEALTSLDSIPQASTAEPDENATTSEAPKLINKEAGKKNRKTKDKGKGKGKKKAKTSDIKPSMLKSLRQESFKNRKAYKKYMAYLRHTWLPSAKVDECVRLLKEFKQGGQKTIIFSQWTLLLDLIEVAMDRELEQKPLRYDGSMSATERAIAAQSFRDKKECGVLLVSLRAGNAGLNLTAASRVIIMDPFWNPYIEMQAVDRAYRIGQKNEVKVYRILTQETVEDRIVELQERKKEMVEAALDETAGKALGRLSVQELKYLFMGR

SEQ ID NO: 3279 - protein, 549 aa, Unknown
  Kingdom: Fungi, Phylum: Ascomycota
MTVFVDSVMPIWKRMMDILPQKPVCDRLVAQYMDVSEAICRILHFPTFREQYNLFWEGKLHSEYFLPQLLAVLAIVSRFTTKSQGFSHERIEGVHTPTAFALVRTWLDSLKGKQLTDLAVLQVELLLMVCRRALMFRPQELWIHLGSIVRMAMAMGLHRDPSEFGTRISPFMGEIRRRLWFAVFELDVQNSFDNDMPCAIREGDYTCEAPRNLHDEDLHPDMKELPPGKPVEEHTRMQAQVLAAFSLPTRSRVSHLICRIDTLRDYQEVLELGGKLEDLLEDTNQITPRYGIADHSRMSRVWRERVSSDSHVRRALLALYRPFVLNAPTCPPQITKSFLRSCMIVLGYSEEPDPSLPHHVDVMGILHQVFRNDILPAAFSACYFIQTALPPHSNGILYEGQRSMRQVSETPSDTPPTANRFMWSPERLVQAVERAIGYFIQSIVRNTGTKDIVSLVVTLEMVRTPEPTTENMSRILRSTLDACLKAANSSRGKLAMVKLSSPQPGSAGFGADTFTGAQAGAYAYGDPSMSHRNTHRPQEDSWTLWSGWD

SEQ ID NO: 3280 - protein, 574 aa, Unknown
  Kingdom: Fungi, Phylum: Ascomycota
  misc_feature (253)..(253): Xaa can be any naturally occurring amino acid
MTKSNPNLRVLNALRSNAKPVLTFMGLPSLRTAQVVAATGLDGIIIDCEHGNISDDNMHVATSAIAAMGVSPLVRLRMTHGDLIKRALDAGAHGIVVPQVNTAEEARSVVEASRFPPLGRRGQGSAFPGFAFGVDVQTYVKTANDTVIVCLQIETKEGVANVDEICAVPGVADRSGDMLFIGPNDLALSVLGYVPARGDEPEFKDAIDKIVAAARKHGKWVARLSNSGALCKEHLEVFDTVALSYDVRAIQNXPILPPRSESLRTAIARSGVEGNDPSTLQQEWKQNWTSGDLVNTTLNGTIWLYNVDIITRDGHAISRKSLRAHVIAADEWIVGFPNGDTQNASIGTLGLLGAPGSFIEPDTDVDWPQSLLEQLKDSQNISSRFFGLHMGSVQHDQVGSLILGGYEKNRVIGDVGVFNILGNLPFLVDIKLGNEAGRSPFERTGSVWQGIGDNEIAKDFTKVGGGKKRSAGIMVNPVAPYIYLPKGNCEAVAKEPPVSLDKGLGLWLWDTDDPQYERIMTSPAYLAFILADKDAKDITIKVPVALLNLTLEEPLVDKPTPYFPCQSLDSTSGY

SEQ ID NO: 3281 - protein, 810 aa, Unknown
  Kingdom: Fungi, Phylum: Ascomycota
MTGFRPRSRSPSTPLFRNRRSGSTAGQEPAAPRNADILFPQVYEDAWGRTTDPAGALTTDRSEIERARIFLLRFTNMNPDQMVNAELRAITMNPQVGTVPQIAAAVQTRVFGGRHASFEATPLLQAIRFMLIKAKIPDAIFTDRTRSIIDFYFDPTMARNLNPPPADPSAYPYPAGRLKVVIVGGGPTALASAISLAEKGREKVEVHLWERRWVWKQGPNGPYADYPPTAKRRDQVVTLQNSVTELMTERTLHALFGGRPEPVWPGSANIQIRKVEDRLLKRCQEPEFSSIIHLHCEGVWREDVSKVGDFHVLLGADGAASWVRKSYFHGYENERGRSYALGLAFDRPTGLPWSQPLNVFLTLGQTRYLLNASDYDGRGYLNMQLTEEEWHKMVDITGRPVTFGNPGCLRVNGVPPEGFDESQIFAPSEDRESPLWQTIEDGLKLFGFKESEVINVVRIPIVVQAVQEGVQYFPGPEAPQLCRPHALTAVAGDAAMTVHFWPGRGLNSGIKSGMALGDELVHALNNGKFEGLDINAMKEYNDFIMKLQDREHDKRSIPILNQSGTPETLGWLLEKAHSIPDGVAVDWLVGAMTQIAERLQRRADWPFEVVENVEPQIRIVLRQLRSLTLREMAVSFPWPTREMGGAEVLPIRSMKQEEKEKWLRSLWRMLKDDKEPAPAKTQSRFDGEARGGAPKARFEAARGASERPIKEISNKDQATPSGMLSPTNGNGNSGGMLRRSSATRWTRDRGGSIDERFGGMSLGLPEDGSSRGRSPSPGGDVGLTRLLSVKKPNQQVLSDALSLALFRVDE

SEQ ID NO: 3282 - protein, 377 aa, Unknown
  Kingdom: Fungi, Phylum: Ascomycota
MGTSPRKMPVRLTIPDPLHQVLIDFSYLPVHSQPGPPTAASWTNFPVSLQNRNHPRSTTPQPAPAPTSPSLGHHHHHHHHRASPIPFAKPHATAATMSNPNQLFLLADHIKLSLLERKRALSLNLDNTSTSGTGSQDGHISRSLEQFRDGLSALSEEKARLEQEGDASAASSIADSLTPLQKQLDDLTAQFHGFTSPSTANTLTSPNDASLAADFAHAASISPTSSTRKPSKTVRFTDTDASEEREPHHTDALFGSSGRYRDDPSDSAGYRDQAASLDNQQLHAYHSQILEDQDEQLDRLGESIGRQRELSMQIGDELDSHVAMLDEVEGITDRHISRLDRARKTLGKVSRAAGENKQMTAIVVLIIILVLLIAILK

SEQ ID NO: 3283 - protein, 587 aa, Unknown
  Kingdom: Fungi, Phylum: Ascomycota
MDRDRGRRYDDGEVVRYGAGESWRPTPRGGPPSDRSPRKPRSRSPPPRAARSPPPRAARSPPPRDRDRSPPPPRRDSRPPRSPRARSPPIGNSDSYVPGGRYVPRRRSRSPPFGGPRRGGDGPRRSRSRSPPPPAHLPMRRRSPGPMRRSLSRRRSPPPPMGRDDRFDGRARSPRRDDRFDGRPRSPPPRRDDRFDGRARSPPRRDWERERDLDRRDDRRDDRRDDRRDNRTPNRRRSRSPFRRDRSPPPRSPLAPKPPQAGYRPRSRSPPRRPLNNDNFNSYRRPSPRDSAPPSGRTSPRTVPSRARSPLPRDRSPPPLNSKDNWSTPAAKSPPRGPSALRQPPTGPAASRTFSGSSAGPSGGALGPQGRSGSPTAPPSGPRGYVPPSGRGSFSSRGGSGPGGRGGWSNAPPLSRHASAGVSPSPSTPTGPSNIPTGPRGSISNSTNNGPSSSQGPSSRPFNPPTGPSSTNPPTPIMSSAPLPRPTIAQNVLASLPPLIPGGKLDPITHPLITLGVSRDLEAHTRKLKEEEERLREEIKQKQDRTRKSLYMWQRLERDSKAWEVRSDLSERSMNNLAGDGIGGAAF

SEQ ID NO: 3284 - protein, 636 aa, Unknown
  Kingdom: Fungi, Phylum: Ascomycota
MASAKTAPTKKNPRAWDALTPALPEWIRDAVSTMGFAQMTPVQTATLPHFMGNKDVVVEAVTGSGKTLAFLIPLVQRLLRLEEPTKKHHVNAIIISPTRELAAQIHTVLLSLLEFHAPTAEILPHLKEDEKRPSTTVPVVVPQLLVGGVTTTAQDLSFFMRHSPNVLISSPGRLVELLASPYVHCPQSSFEMLVLDEADRLLDLGFKADLQKILSSLPKQRRTGLFSASVSEAVGELIRVGLRNPVKIEVKVKMKGGGVLEDRRTPASLQMSYLVKPASQKLPALAKLLENLSVRPQRSIVFLSACASVDYFQHVLPLLLPPGFSLVPLHGKHPAKVREKNFNKFLTSVSPTILLTTDLAARGLDIPQVDLVVQIDAPSDPKVFIHRNGRAGRAGRKGLAVVMLHPGREEDYARFLEVRKTPMKLLERPEVPTSEEDADAAAEKIRELVKTDRALYDKAQKGFVSWARSYNAHQATSIFRVADLDWASLGKGWGLLRMPKMPELKKWDGDKHLGQEIDWDSYAYADKAREEARQEAMAADPSIYAEKKAMELKRKKRNNEAWSQKHEAEDVRSDKREKRRKKRDAERTSKMTEEEKDEEMKLQDMIRAIRAKNQANVATAAKETKKGDDDFEGFDD

SEQ ID NO: 3285 - protein, 471 aa, Unknown
  Kingdom: Fungi, Phylum: Ascomycota
MGDFEAPQQQTLTVNTEEDADKIEKRQVHSIEIPLSQVRSPQSPGIPVTPMPYQRPSSLDLDDYFTGPRDIQKHSKWPLFMRVHGSILPKLIIPLSLIACIATAITCVNELVHPIGVNSVLLTILGFVVGLGLSFRSSTAYERYAEGRRFWASTIMASHCLGRVFWIHAKDAPSQGARESTLRKVSAMNMVVAFAISLKHQLRYEPFTSYADLQHLVGHLNTFAKQASEVSPPTAAKKNFFKEVGTYLGVSFAESNPRKSIKKAEAPLGNLPLEILSHLALCIDDMITKEQLTIPMQQTLAYNNLAILNDCLNGCERVLSTPLPIAYTICISQITIVYVVLLPFQLVGLLSWIAIPATVFAAYIILGLLFIGQEIENPFGNDVNDLPLEVYCEQIAHDMDIIAAFDKKEADFMMNPNNMPLYPVSTAPIGTWMMRSEDKLREALRTKPVSTFQWRRTRAPDGGVKSADYMA

SEQ ID NO: 3286 - protein, 262 aa, Unknown
  Kingdom: Fungi, Phylum: Ascomycota
MAQQQNNPSIASASPTYPYPQHSPYGPNPDMAHGYSHPSGGMYPQTRPDWAGYGGHGASPITPGHMYGSPANAPQQRPNQVYSFVPIPGAQQHKRPRRRYEEIERMYKCGWNGCEKAYGTLNHLNAHVTMQSHGQKRTPEEFKEIRKEWKQRKKEEEAQRKQDEERQRQAAAQAAAQNGGDPQGPDGTPTSYPGSRTVQLPPIGYQPAQYPAPPGSAGVPQQPLPDYGPSHMYSNYPPHSPYGQPPGQGMYSQSNGQQPPSH

SEQ ID NO: 3287 - protein, 1379 aa, Unknown
  Kingdom: Fungi, Phylum: Ascomycota
MATPNHTNHPSSQAPSGRPSLDRDGSGLQPPFNASSRNLSTSAAAYAHRGGGGASFNPSVGPGSFSSELRSQTMLNSNGRLNAGSVYPSSIMDKVDEDDDGNGTAQALAALKDRLNRELKIKEGSENMLEALNTKKAKQTKDQRHRVEAELNASNIRIKDLRQKISDTQRTRAVPPTTPTRNRTQESITSNGIKSPPSASRSAVGSDVDESSESPTFALAEILQALEVEGMSPEYYVSRGNQLVELFKRHPTLKYDLVWSVFGLRVQMMLLSESREVVAAGYRMTRYAISDVSSLRKIRSLNTDFLVIRSLNNYRKADVEREQALKFVRAFLDVKDGIKEVSRAVVRTIVAVAEHGEARASNAPVSDQDVDRLRPICVETLAEILLRDPRLLLASGGLGPLTEALCDGMYKSPESLTSAFLFLLDTPQRRRYIQPGYAIEGLFTVFTDHLYSNDTVLKQNAKAISTAIKSWPGLMSLCMNDYWPIRSIFASMVLPNPTVRETVLDLLFSLLRIKLPAWAATYLAGRRLTTYGRVANLKASGKEKGAALYLEEDSGEQNFVEHYTALLLAIFIKAGLVNGLLRMAQTEEDPTLRRKTTLLIGEILKLSSRLLPPSWSSELQLLPELFSAATHFGDDNHFISTGIVYQISSVSRTLYRSAPSGSLTGALPVSNSTSDLTMEDQPKSNASIVFDDATFRQLIIETNVLNSSNYSKWNWEVIMRVFDGPLQTGKRLEEAIKASKFMKRIMSFYRPFKHKFAEIKNTRNTQKYVRAGCALMHSLLQSLEGSKFLADSKLLRQIAECLAQCDPTSGITAANPMFSPDGLSETLCGGYFAMLGALTAEPRGLAMIERWRMFNMMYHIVDLKQRPDLIKLLLTNFDYSLHGHPRILLSKALTAGTKDIRIHATNAIRRYAIRPVPSLHSQGGVSDSKWAIQMLVTQLYDPEVEVCATAVKILEKASNRKTYLEYIVECRPALDHLGEIGAPLLLRFLSTSIGYHYLDGLDYISNEMDDWFLGRNDTYVGVIEASLAKSFLTDPDDQSNRISMFDDGEAEADFHDSHVPPHFYRELTRTQEGCKLLNDKGHFAEFVTTIREHGMQTEDPEMLTKVKGCLWAVGNVGSMELGAPFLESSDVVERIVRIAESHEVMSLRGTAFFVLGLISRSTHGLEILSEHGWDANTTPMGNSLGFCIPTDLSKLFNLKPWKHDTIASISLPRSQRTIQEAPPARAPKPPLESADIPPLLSDDQVNERILELIVDLGNMVLYKKALTELHKLRARKPSAFRSKDFFMEVMGLMEWSHYRLGVRRMVIDLFEKNVMRQIVFDEESSGSSEEDEANEEDEDEEGGSREESSEDDRTERQRSISEPADVPSSLMPAPLNFGR

SEQ ID NO: 3288 - protein, 1072 aa, Unknown
  Kingdom: Fungi, Phylum: Ascomycota
MNTTATSASNPTADDPHHRQRNPEVASVENGDVVGAGAVLVSEPKNDGADQKMTANDPDNVPRPSPKKVPQIRHEANTVVETSASTVDTGRWASVGGERGSTSNDDNPRSGTQDTSAGNQEAVDKSVQSNRKLEERKTEDRDTKKNKYKDVSGKKDRKYRASKSTNFSAGEKHNADYDESESDSDYSSDFSGGSSSSDFSSSSASSEATRKDVKMRRKKKTKHSREPKYSTTEKDQIDTSQQIQELGFQIAQLAQAVQSLQASSQTQQQYPAYAFGAQPQTSFLASQSTTLPGATSTNSSLPISELNLDISRGSNRGSRRAGGGRNRPARGHGSQPVLTIVDSNGEAPSSATHSKKNKKVNATKGTRSDYKRVDWVWDSSLYTWKLQDSAESTRDSRYEDYIFHVRRSFDMEGKFRSTTVDIKSKLLRECLQEVIGDIKGVSLVDESPKTDPNMLFLYLEDLRRHRKKLKQSKAAGNTKKERKKSQRQLEDKRKQLKVLIGYLDKDYAQTKESLYPMLENGLITFELMWALWKPGTLAYTNTYGSTDDPRVFTVELAERHKSFMKGELYHLDGKYFEFDGKKFGHGGVSDEILAFRGARKITSLPCYPLKYHPDENRLRERLIERGKKFVSLSGVHYKSYTGVAYQKSKKSVIKFNIQQSRVMVDPAIFRRINPNYYISPVKAQEEPIMLGSRYPGEDEDDPCSSESSDDGQTHIIRGRRARKMAAALLGAASNVNEGQMSFDVEPRSAELGINDSDGARDTQNDVDGIPPTFSDDEYLTASPVVLGFAFSEKQWLEFTVDNIKEIIWNDTAWDSLVSEPETKDLVQALVKSRKFNAANTIDDVIKGKGKGLVTVLHGPPGTGKTLTAEGISELLRCPLYMASAGELGTDSRFLEAELQKMLDICHAWGAILLLDEADVFLEKRNMLDIHRNALVSIFLRQLEYFQGILFLTTNRVETFDEAFQSRIHIALRYGALEPRAKKAIFQMFIDKVRKFGKMKVAEFSEEDLDALARKELNGREIKNVVSSAQDLAVSKEEALGMEHIKQVLDVHAKFGRDLKGGAGFEDAMRSYF

SEQ ID NO: 3289 - protein, 707 aa, Unknown
  Kingdom: Fungi, Phylum: Ascomycota
MDILKVLSRGTKKTSRPGSVPAAQLPSAGAKTNPQLYHDPIRGHKRKRNDEQTEPAKLTTEELPEVDFFAPKQENAPKKDVSKAPISKEIESAPDPAAHVQLSEDECRRLLRSHRLKVTMLSKREDDSKVTKKKKKSKKEKEEPKSGKKDAKQQLAPQPLSSFTELRSVYGISRRIAENLLTEGYRVPTEIQLGSLPLLLRPELALKGEGSLENGVDLLAVAPTGSGKTISFLLPIFNNIMRRRAEEKVNGIHELEAVIVAPTRELVHQITNEGRKLLEGTGLRITGMKKRMNIAAEKQEVIADSSDEEVADEESEEEAETGDAKKTKPPKPVTKTDILVTTPLLLLNFLQSGPDGAQRVLPTVRDLALDEADVLLDPLFREQTLGLWAACTDPNMRLTFWSATMGSNIESLVTEKLEARATELGVAQKPLIRLVVGLKDTAVPNITHKLTYTASEQGKLLALRQLLHPRSRIDDDTPLRPPFLVFTQTIERATALLEELKYDIPLEAGGSTRIAALHSGLADSARASIMRKFRAGEIWVLITTDVLARGVDFAGVNGVVNYDVPGSSAAYVHRAGRTGRAGREGGVAITLYTKEDIPFVKTVANVIAASERQAGRTGDQAEVKKWLLDALPNVGKNDRKMLREKGVEERRTGNRGAEISSKSGWERKKDHNRKGAAEGSKRRKVEEKKGGDKKAKGASEEWGGFED

SEQ ID NO: 3290 - protein, 233 aa, Unknown
  Kingdom: Fungi, Phylum: Ascomycota
MSRSLACRTATQAARLSRASNCSAQSLRSFSQTSFRCDDSDSTSRPPPSRPSGNSLLKDMYGMPQATRTSPMSGLSSNPIFKALGNQTRIDTSSLMGEPTEPQAPVVKAEVEPYHLHIYSTKHNTHVTCTKPNREPIISLSCGNLGYRKSRRGLYDSAYSLTKYVLDRLVHTGWPPKIDRLELVLRGFGQGRDAAIKVLMGPEGKILRDKIVRVADSTRLKFGGTRSKRPRRL

SEQ ID NO: 3291 - protein, 515 aa, Unknown
  Kingdom: Fungi, Phylum: Ascomycota
MPNYSTIEDRAESSSSPSDMTRTRRRGGKATGHQGQASTVSSIVNLLNTIIGAGTLAMPSVLSHMGIMLGVVLIIWSGLTAAFGLYLQTKCARYLERGTSSFFALSQITYPSAAVIFDMAIAVKCFGVGVSYMIIIGDLMPGVVLGFNSHADRIPYLVDRAFWITAFMLLVIPLSFLRRLDSLKYTSLVALVSIGYLIILVIYHFATDIHANPRDVRIVKPEGLVATLSTVPVVVFAYTCHQNMFSIMNEIKDNKPSSMMGVIGTSIGSAASIYILVSITGYLTFGNAVVGNIVSMYPTGAASTIGKAAIVVLVLFSIPLQVHPCRASLDAVMKWRPGRAQPGGGRANSPTPPPRSDHAMAPMSDTRFALLTTLILTLAYITALTVDSLDRMLAFVGSTGSTSISFILPGLFYYKISDPDSIHHQRLLKEDDDIVESGDEDVENSGPLAQSTGSLQSVASNASGRDTWRWRRKWRWDLEHLEHGLVRRMALALAIYGMVVMAVCLIMNIFFAATS

SEQ ID NO: 3292 - protein, 520 aa, Unknown
  Kingdom: Fungi, Phylum: Ascomycota
MTAFTSAFWVVPTVFLVYKILQFGRREPGLPAGPPTIPILGNAHLIPAKGLYIKFKEWADKYGPIYSLKIGRTTMVVLCDREAVFELLSRRGAYYNDRPKDRQVDIALGHENTALMGEGPLWRAERKIISTYLTPKNLDSVLAPIQVAEVSQLMIDLLDKPESFRDCVKRTTASISTITLFGHRAPDLDSYWGNAAYLGIDEVNRSLAPGSYLPVDHIPILKLIPDRWNKPAQVAKKSYITMSDIWAVAREKVEERRQKGDKRVSMLDKLLDGAFKCDVPFSYSQMNNFFGAVHMGASDTTSGHTLASILFLAKYPEYQEKARKELNSICGTERMPQWSDFGDLPYVNCIVKESLRFRAALPTGIAHCAKHDYWYKGMLIPKDSVLMVPPSAINFDERYIKDANTYNPDRHLKIAHKLAPELAASSHFDERDHYTYGVGRRICPGFHLAERVQWRIIAQLLWAFRIEPLEDLSIEPEMWEEGFLNFVKEFKVRFVPISERHAEMVRTQFKENEEFLGQWV

SEQ ID NO: 3293 - protein, 382 aa, Unknown
  Kingdom: Fungi, Phylum: Ascomycota
MSAITTPYELPHEPDTPISGLTEISLNPLILCNITPYLPVSALLSLAATSHTVRRLIYHTPGALRHLDLTRIKAAQFDIDEVDHGGQVWRNVQLDEYLTEDDFYSGPLRGIFTILKRRDILVHVQTLILDGLSVTAELCSEIINDPKYSVRVLSIRDVKNLNQGILRGALQYACRASRPEGTPRLRSLYVFGPRVPSGPPASTPSLGPRRTISASWNERSQRHLTSSLQQESELWWDKKGRVIGKHVDPEWALCLMTCEGLIAFDAVLCRGPRHRNSDAPSPLPDCLDPCVATFAVPPCQNCHAAPEGTLTSKSPRFSLPLLSPPPLLSSTLAAAVSPHSPTAIPGGVRTVMELGPSKTRQLHMGLRQAGQIHLKLRSPEKR

SEQ ID NO: 3294 - protein, 429 aa, Unknown
  Kingdom: Fungi, Phylum: Ascomycota
MGSQGTPYTFEPRPAKRVAAEKQDVWSMINEAAANSPVQPIVNMGQGFFGYNPPDFIIEAARDALLRPDCNQYAPTRGKPSLKKAIAANYSERLGRHIDEEKEVTITTGANEGILSALMAFVEQGDEVIVFEPFFDQYISNIEMAGGVVRYVPLQPPANGHAETTSSGDWQLDMGALEATVNNRTKMIIINTPHNPVGKIFTKAELESITQLAVRDNILILSDEVYDSLYYTSMTRTAALSPEVYNLTLTVCSAGKTFYATGWRIGFLIGPAHLIKYVAAAHTRICYTSPSPLQEACAVGFRDAEKHGFWDESRKSMLGKINRFCEVCDELGLPYSKPEGGYFVMVNFAKVKLPEDYSYAENVKGRPRDFKLAYFLIMELGLAAIPPSEFYTTANQHSVENWLRFAICKEDGVLDDAKDRLRKVKKWMV

SEQ ID NO: 3295 - protein, 478 aa, Unknown
  Kingdom: Fungi, Phylum: Ascomycota
METAGYHVTPPRGAVEVLLLPLLLLLPLTTAGNVTSETAGGWNPTIDLHLQHSCAASIVTLITAHLLLWTLRRALLRPLPTHVAASIATMTTPPIVLDGGTGFLKVGYAAQNFPEHQFPSIVGRPILRSEEKTDNDIVIKDIMCGDEAAAARTMLQISYPMENGIVKKWDDMQHLWDYTFNEKLKVDTQGQKILLTEPPMNPLKNREHMCEVMFDRYGFGGVYVAIQAVLALYAQGLSSGVVVDSGDGVTHIVPVYESVVLNHLTKRLDVAGRDVTRNLIKLLLRRGYALNRTADFETVRQIKEKLCYVSYDLELDKHLSEDTTVLVEDYTLPDGRVIRVGSERFEAPECLFQPHLVDSESPGLGEFLFNTIQSADVDIRSSLFKAIVLSGGSSMYPGLPSRLEKELKQLWLTRALQGNPERLSKFKVRIEDPPRRRHMVFLGGAVLANIMADKESMWVTKAEWEEQGTRVLEKLGPR

SEQ ID NO: 3296 - protein, 507 aa, Unknown
  Kingdom: Fungi, Phylum: Ascomycota
MAFHADLAKDIDFIKTPPAAPSTFEKEDCGVPTTNYPAIKNAPLPAEAPGYLNFNNYVLLGLITIVPWFVGRTIGGGWKTKVFLGFVFLVPSIVAYWTFTSHMSPRLDDKTKLPGRPIESYVTFKTEELKRKYSGRNKVQIQDFSDMYINGDADFNGDVLDILEYRHDWCNFALTWSFMKFLWGTFARDVLMHSREQDMDQIRPNYDNGNDHYSWFLGPRMIYTSGIISDPTREETLEELQDNKMAIVCEKLDLKEGEKMLDIGCGWGTLAKFASLNYGAKVTGVTIAEKGAAYATDALRTAGITEEQSNILCMDYRDIPKQKFNKISQLEMGEHVGVKKLTTFFRQCYDMLEDDGAMYVQLSGLRQAWQYEDFIWGIYLNKWIFRGADASTPLWNYIRSLERAGFEVKSVDTVGVHYSATIWRWYRNWVGNKDAITAKYGQRWYRIWELFLAWSTIASRQGSATCFQMMVVKNLNATHRLDGHRSQFGITGALAAAKAAGKAVLKI

SEQ ID NO: 3297 - protein, 488 aa, Unknown
  Kingdom: Fungi, Phylum: Ascomycota
MSADDDRVQVRQGPSEFFGSIGDKVQNLTPAQDATATTDGEDDDEPRAVEEIESLCMSCGKNGMTRLLLTSIPYFREVVIMSFACEHCGTHNNEIQPAGTVQPRGTHYELRPTTLEDLGRQVIKSDTATVKFIELDLEIPAGRGQLTNVEGLLSTVMEDLEMGQEQRKEDQPEVHAKIAEIITKGRAMMAGDVLPFRFYVDDPAGNSFISPDLKDGVGKWEKREYLRTPEQNASLGLAASDPNEHGPVTIPGLTTDGEIIPNEVYSFPATCPGCAHPCTTHMKMVDIPHFKQVVLMSTVCHDCGYRSNDVKTGGEIPEQGEKITLKVDDNVDLARDILKSETCAMECPELQLQVNPGTLGGRFTTVEGLLTNVRNDLHSQIFESATGTGGDSLQTDEKSQWSAFFATLDAAIAGEKPFHIILTDPFASSFVQPLVDPPAPDPKIQREKYDRTEEEEEELGLKDMKTEGYEEAHQASLDAEKKEEVNGS

SEQ ID NO: 3298 - protein, 197 aa, Unknown
  Kingdom: Fungi, Phylum: Ascomycota
MASLRTQSAARLLRATASPASRLAMPVRWQSSMTSAPAAIPAPQENQPDYEIQADKAASTFTPVPKRVQEGTEDIALPAAIISGAPMELQARTVRIYKESKPATQSGNFRGKHWRMDWDVLAKGHRWENPLMGWQSSGDFMQGTNIHFHSKEDAIAFAEKQGYEYFVQEPQSRKISPKAYANNFMYSARKLKHIRTK

SEQ ID NO: 3299 - protein, 1020 aa, Unknown
  Kingdom: Fungi, Phylum: Ascomycota
MPDIMRRASLDEAEETVSRRLSLAEDAAHMDLDLTMPPNQDDEDDDAMLEDDVLDQDPRIYTPPPHIAARFYRPSHARRRDSAASSRSRRESISSAHSHSRCSSIQPGTHRNTAEEQSKHVAQHLRRASFLEDRRARLADRAAHAEKVRLRAAMVKAAPRMSSASEDRALAAQQAREKNLAKIVADCAEEVKKAKQISEQIKEKREQDHARMKAQMEERMAEASRRREEIRSRTVSRRSRGQSVMARKPNESPPARKETEQDSEPSMLSNDDAARMIQGWWLGRIRRKTIQEFNNLGLSLDSIRDASFDAVVEQLANPQVLITTARLLRLCGLHEGKPGSVEEMAAVRTFLSAFLIFGHPNQVLSNKDDPAQDGPLSTHRLPPADLDNPQLQELVGKAKDLLICFENILSRFTSTNRYTMPPALSKALPESFGAWSNAFIAWKSRDADAMVEVMVMQFVELDAILHTVKDKTDEAATELYRQSIRGNQLQLMVRVKRIAGPEKGKKMIFDAVAEARKARMAKKQTGDTKPRVAESSTEEDTATARNIVTSEPQAPTPASALPTASPAQPTVAYGGLQGLLPDNRIVVHELAINKEYQVPAEEYKAEQAILTRPVFEQMRAFLDHTDPETNFRLFLMAAARVKDKLQRLLKPGNSMHKLIGEILDPEIAQQQFTMGSFSYETFFSAMGNLLPKLCAPFRDDEVKDLVRNKLNDGNLIDRIEALNDFIDLMLCDYMNYLLRIAAPQLIDAAAQYEIARFKKQVDEGMPLSVAETAWRAARSKVIAETQKRDPEGNNHPKSRPTGTKFYAQMLVDVFTQPLPINPENVPEMLRLDVKRIEEVSTMVQRIITVGAVLLQCKNLLKRDVRASWKMEAARIMSVLEAKHESLDTTINGTMAALEAGRSMPTVTKTHLRALVTKVLTASQDMTTGSIEPREPVLRLLLTRLRGNIMARLAPGSANEKVKAVNSAGEKLASLGLSEFVDRVRGISDLLEKVGTVDRAAHDGWWDMVAMKVEEQDPASS

SEQ ID NO: 3300 - protein, 859 aa, Unknown
  Kingdom: Fungi, Phylum: Ascomycota
MAPPAKRRRRNVVEASDDEDDHHQQNTLSNFLLSSPSSPNKTRIPASSPSPSKNGSPTKRPANGPTQTKRRTQSAKNGTSASPKKAQGSQKPESSQTADLKTLFSKQAQRAIPLSQTSNKRNNAIEDLISDDISDDEISELKASSSSLVSQHAKKRQRDGVQVISSDPPTASQRFLKPPKPAGSDALDDDLRPWSERFGPRSLEELVVHKKKVADVRKWLEDVMSGRMRQRLLILKGAAGAGKTTTVRLLASDMGCELLEWKNPSGHTGTGFVSASAQFEDFLGRGGKFGALEIEGPLASSQAPTPRSSSAMGRDKSKRIMLIEEFPNTFSRSSTALSSFRKSILNYLATHTPSLSMFSTQNSQEPIQPVVMVISETLLTTTSASADSFTAHRLLGPEILRHPGVGVIEFNAIAPSLLAKALELIVQKEARKSGRRKTPGPLVLKRIGEIGDIRSAVSTLEFLCLKGDQDSDWGARISFTKPKKASKNGIGLTRGEEESLELVSQREASLGIFHAVGKVVYNKRDDEATPSPAEQLPSYLSMFSRPKPSQVSVDALIDETGTDTHTFISALHENYVLSCESTGPMDLMTSMDYVNDCIEYLSISDLMCPSRDVFFGGRGGFAGRDSASHILRQDEITFEVAVRGMLFSLPNPVKRKTTTMSKTSDAFKMFYPTSLKLWRAKEEIEGLVDHWSTRLLKGTDALPVKNLTDGAATFRKPQQSGEMSWMQRQQQQRQQAMQPTQSTDNDESAPPLLSLGSAARRELLLERLPYMAQITRGRKSNGGVRLKDLEKIVSFQGVHAGAEEESEGEDAEQPTGEAWATDKPSEETSPRKRSSGIKAGGVSGLLAQKLVLSDDDIED

SEQ ID NO: 3301 - protein, 1210 aa, Unknown
  Kingdom: Fungi, Phylum: Ascomycota
MADKEATVFIIDLGSSMAETHSGRSQSDLDWSMRYVWDKITDIVSASRKTLCVGVVGLRTDETNNKLQDDDGYENISVLQELAPMSMSSLRSLQNAIIPSQTIAGDAISAIVVAVDMIDTFTKKLKWVRKIVLVTDGQGVLDDDDTSDIAKKMNDSNIQLTVLGVDFDDPEYGFKEEDKSSTKAENEKTLRSLVEDCKGGVFATIAEAIDELETPRLKAVKPYKSYDGPLTLGNPEKLPSSVNINVERYFKTHQARPLAASTVVVKSEAAATQSTQTLEGDEMDGVEFSAVKQARSYKVNDPGAPGGKRDVEFESLARGYEYGRTAVHISESEHNITKIETTKSFSIVGFIPCDRYEPFLNMGETGLTVARKNDLKSEIALSSLIWALMELESYAIARIVTKDGKDPLLVLLAPHIDPEIECLYDIPLPFAEDVRGYQFPPLDRVITVSGQTMKKHRFLPTDELNEAMSDYVDAMDLSGYGIDDEGEPAEYVPIDDAFNPSIHRINHAVKARAIHPDGPVPSIPPLLTRFAAPPEDLISKVQGRIDSLIQAAEVKKVPPKAKGKFRREAVKPISGLDVDALLGEEPRGSKISVENPVPDFKRILGTSEQVSEIEDAAKQMGSIIRTLITDSFGDSKYDQAMECLGVMREELINLEEPALYNTFIKDVKKNMLSGAYGGDRRDFWFQIRGAKMGLIDTNLSEVSDVSPEAADEDLERRLKQLQEILDERVTLLSTSPKARFRSRKPQSGNGPGPQKNGQLSSRNAAGSLSSTQGASASSAANSMTPNRTAAVGTSSRETQAAVGFFKKGDFQAGMIMGEDMQFCPWTAVVSYPGRFIGKTNRPRARIYFDSIYEGRNWDFFYLYNPENPKNEPFLLVPTAQFVAFLDHINKCLNTALVVPKGQESKFAVVFRGAGVPKPRYLTRSSDQRTFKVDKFPEISNGDVEAYKSMERADQKKVQKMLDVFSTRHPDKVKKDQRREKDDAGMLLDAQRMLGLKTSLVPLDVVFICIDAEALERKPNPVSEVGIAILDTRDLKGTSPGPAGKDWWPSIQAYHLRVKEYSGLRNYQFVQGCPDKFSFGQSTFPPNAEVATEILEILKPWYPSDRDLVLVGHDVSQDIKYLADLGIHAQDLRFIRQIDSQVLHRSWRQLKDGRGLEAVLSELCMQYQWLHNAGNDAVYTLRAVIGVAVEQVREEELVAKGEKYVPALFTA

SEQ ID NO: 3302 - protein, 557 aa, Unknown
  Kingdom: Fungi, Phylum: Ascomycota
MGHESDSKTSSPPLEQLNTTSNDEYQAQQDANDLVTLGHREELTRKFSPWSLFFLAFSVLGTWSTFAQGLASGITNGGPVAILWGLVLVTVCNLCVALSMGELCSAMPTALGQGYWVSRLWPGSWGRFVSYMCVWINTFGWWTISASQNAFMTEFILSMKLLFDPDWTPGNEGWVKFLLYVGVTVVLTLLNQVACRRDAVLPMFNNFVGVCFIALFFVFCLALLISVGVKDDLHYKSASFVFGQWYNQTGWNDGVTWFMGLVQAAYGLTAFDAAVHMVEEIPAPKKNAPRVMWLSVTLGAISGFIFMVVCLFTTQDLEILLSGPIGIPFVDLLNQVTGLTCATVLLSFFIMNGMGQAASLMTTGSRLTWGFARDGGLPWSNYFSYVNKTWKVPIRALWLQGGIIALVGVLYTFSDFVLGAILGVATIALTVSYGIPIAVLLWVGRDKLPHGGQFKLGRLGPVMNWVAIVYCIVSSIFFFFPSSPNPTGSSMNYSIAVFGIMIIVALGFWFVKGRKSFLGFVGHGADVRAVGVVQPGLINQEHSKSDIVDRSEAGASV

SEQ ID NO: 3303 - protein, 1111 aa, Unknown
  Kingdom: Fungi, Phylum: Ascomycota
MGSSKESYSPTAGNGHSNGANGANGTSDVQSKAPKPQQTKPKQQKKSGGSVVGNYMKLRTASRRPLPTDLGNGHYRQLTKRPGIGQDLRSLSREDLKTLLDIIRAKLKGEVHQDDKTMVMERTIALVAGLPDHSRTQETLTNSFIGKLWDSLDHPPLVYMGEEYKWRRPDGSFNNPMLPQLGAAGTKYSRTCKPHVTPLGALPDPEAIYEAVMARDGFKKNPNNVSSILWYWATIIIHDLFWTNLRDGNQNDASSYLDLAPLYGGTQEAQDSVRTFEDGLLKPDCFADKRLIGNPPGVCILLIMFNRFHNHVARNLATINEGGRFTKPTADRKDEEGAEAWRKYDDDLFQTARLVTSGLYINITLVDYVRNIVNLNRIDSTWTLDPRQEMGTSAGTKPGSESGVGNAVSAEFNLCYRWHSCISEADDKWIQDFYVQLLGENYGDMNLQTLIGAMKKFEASMPQDPGQRTFGGFTRKPDGSFDDDDLVNALATAIEQPGGAFGARNVPRIMKPVEMLGIIRGRKWNLAGLNEFRKHFGLKAYDTFEDINSDPQVANQLRNLYQHPDYVELYPGIVAEEAKTPMSPGVGIAPTYTISRVVLSDAVSLVRGDRYYTIDYHPGNLTNWGYKEVEYDFKVNHGCVFHKLFIRAFPDHFKGDSVYAHYPMVTPDENKKILTNLNRAEKFSFDRPVFKGQRVSIASTGAVKQIVANQQAYTLIWRDGLENLMGQQGNRLLTGGDSSLHAQQRRRMLDTLYKGEWKTVVRTFYAETAEKLLTEKSYKIAGKTHLDAVRDFGNLVLTRFIARLFSLSLKTKDHPRGAITEQELYHKLTAVFRSMSLDFDPVKSFELRQVAKESASDLTRAIETNIKLNKTFGLKGLFTKEPKNDPLTAIGTTMTSEMAKTGVTPYDAAWLYVLPAAACIVPNQAQLFAQALDWYLTPAGEKYRPEIHRVAALQPSEHADSLLLGYALEGIRMAGALVLTRESMGPAVVNEDFGLNVQLRAGGQIFMPSAPMSRDAEQFPSPDTVDPRRPTESYVHYRAGPQTFLGKDICDVAMVELFRAIFKKKGLRGATGPQGSLKKVVRDDGVVDYLSEDWGSVSPFPVTMKVMWDDN

SEQ ID NO: 3304 - protein, 1175 aa, Unknown
  Kingdom: Fungi, Phylum: Ascomycota
MSSTWMNDAVPNHNGNNFPHMNDPNAASGGMMDPSAFMNNPAQFNPAQFSNQQQPQQGQPQQQQMAGAQNGPMRNASPSFQNPVYQTNSVIPSKRPRPREDSLAGSPRQNPGMLPTSRSETPQQQNFAGFQPGAVQQHNPNHFPHLQANGSANASPSPIMGNQMRPGSVPQRVATASPHPFSPSAQQFGAQTSPIPSEQGTPQPYMQNMPPGYNANFAPSPSGPRPAAPNGMAGSQMTAQQLAHMQHQMGQMPNSVYAQMQQQQQQQQQQQQSQQPQPQQQQQQQPQQPQQQQLPSQQAGQPSQQPGQAGQQRQQQMSDQQRMAAYQMQLQQRLQGNMQGSPHMQGQAMGRGMMNKQQMPGMPNGQTPPGQMRPQQQQNQPQQRQPQGMNPESFMKNLHNLMNAKGLPLDPSPVVGDRPVNLMMLFQAVSSKGGYKMATGGQAWGPIAQALGLPAQIPTVPQTLKQVYERNLLKFEEVWTAQQKQRMMQMQQQQQQQQQQQQQQQQQQQQQQQQQQQQQQQQQQQQQQQQQQQQQQQQQQQQQQQQHHHQQQQQQHLPPQQPQAQQQHPHPQQHTPNMAHPGTPQRPAPPQQPAQGQMQPGMQGSQTPKPGQPTMNGFSTPHMQHQQPPLTPQQAQQPYPQASHNRNSMSRSVDPAAGNDYAVQSPVHVKTGSVSVPPQQHRSGQPSEQVVPRPLPKSDDYTPCAREILTWGGVDTDAASKLGEQLEAWRPDMPHVQELGNIDIPALTRSLQCGIHGEVRLALDTLAIVSNSPIHAHFLQLAYCDDLVDVLVDLAEEQLDMLTENTVEVSDEIQLNSYEDQFRFCQLDKYTVREEPVFGTKDYDLDRAVDRLLCITAIFRNVSFPGDMNENHHALAEDTVMKLFCSIIRYLGTRTMLLRSHANTLDFMKDMVVLLSNIAGAVELASREHALCFLHFLLAFAPMPGPSPAADGIEFQPYKPSLHTYLPHAIDALAKLLARDEPNRTHFKTIFALDAANNPAHELLTRTFALAVSPIPTKAQEQERHPQHPPLLEMRKPFLMQGLLSADILASLAPNYESGLVRTWLSSSEGQFAPNLFRIIRELSRQYEAPQMYARNAPRGQPRKDPELVYIVMVAVSLLRRLAEKARDPNTPSSSIPSDFLPSNDILFEATTLQSPEWTREGLLQQLTSFYNLAA

SEQ ID NO: 3305 - protein, 254 aa, Unknown
  Kingdom: Fungi, Phylum: Ascomycota
MAKSPPRKQCLLWDWKNTRDRPSSIDQLFPSDYQTTTRFISCHNWNTWVPPELKDRLTYRPMLRDISHVTSEEFSWVRDSPYPIVHYLNEPERQNTTPSEAAKAWRQTIIPELAQKKGKKIISPACASDQPGKDWLAAFFAECGERKPDYLGLHFYGADAEGAKRYLREMYEIYKLPVVVSELASISRDESQVEAFTEELGRWLDGEEWVIEYGFFGCMPEVADDFVSEKAQLMDKDGNFTKLMHKLMASHGTR

SEQ ID NO: 3306 - protein, 320 aa, Unknown
  Kingdom: Fungi, Phylum: Ascomycota
MWVRLHCFGSSLSSTNLFHLLPNLSRADSPPLVDSAAVAWRLESRRAHSTGRNRMVWPFGSGDDGKSSPTKDPAPARERTTVSWSDSIANAAYDPLGAAKEWAPVVGFSLVGLGAIQLYANYLRRIPGAAYIRPGFFRNRSIFGKVTSVGDGDGFHMFHTPGGRAVGWGWLRRVPEKRKELKDRTISIRIAGIDAPECSHFGRPAQPFSAEAMQWLSSYILNRNVRTFVYRRDQYDRIVGTVYIRKWLIRRNVGLEMVKRGLATTYEAKTGAEFGGLKDVYMKAEAKAKRKRKGMWGGKQSEFESPRDYKTRYSGTENPK

SEQ ID NO: 3307 - protein, 274 aa, Unknown
  Kingdom: Fungi, Phylum: Ascomycota
MQSSLLILSFGLSLVDAICHHGTTLYHRRAEVEEPKFGYTNLDGPLAWHGLSAENMLCAQGQRQSPISVTGDNSSPAAGSSLAFDITDFPEGGELLNLGTTLEVEANGTMALNNKTYTLAQFHFHTPSEHRMNGEYYPMEIHFVFQAADESLAVVGQMVEVAAMEVPSAFISSVFANLDRAGETGAAVETAPINFTALKEHIAASTIWQYEGSLTTPSCDEGVSWNVVENPLFISSTTYRQIKSVIKFNSRYTQNAPGEVNLVDNACTALTAEA

SEQ ID NO: 3308 - protein, 552 aa, Unknown
  Kingdom: Fungi, Phylum: Ascomycota
MDRVLERTPEGTSPRTFALNHLRPKSSFVGCSRIGEYELRKKLGEGTFGEVHQARSRKNGTIVAMKKIIMHHEKDGFPITALREIKLLKLLSHENVIRLEDMAVEHPSRQTDKRKKPIMYMVFPYMEHDLSGLLDNPSVHFDEPQIKCYMLQLLKGLAYLHENHILHRDMKAANLLINNRGILQLADFGLARHYDGHTPVAGRPMGEGRRDYTGLVVTRWYRPPELLLQLRQYTTAIDVWGVGCVFGEMLKGKPILSGESDPHQLELIWDLMGSPSDEKMPGWKALPGGQNLTPRSRPGNLESKFKGYGQGAVSLMAELLRLDWKTRINAMDAMEHPYFKAIPLPAKPHEIPMFEESHELDRRKFHDRKANLPAAPRGGTVGVGPDMIEDLPGNEEIGVHDRRRAIGPLTETTETVDREGAEVHHREAHPTETHTFPATRAKYHHVDGKTDREMIVEMTGDHAVGGKTVATTGKGTDARGAAADLLRVISRGTAIGIETETEIPTEDDVIIHNTTTFFCPHFRSATTLLEYPRAVLCSLGSLSIVSSVYSSL

SEQ ID NO: 3309 - protein, 285 aa, Unknown
  Kingdom: Fungi, Phylum: Ascomycota
MAAVTPTLQHIPATEGREAILKAVREDGAVIIKSLFTKDQVRRLNREVQPSVDNIHTGSNHKEDWVKEFHGDNTKRLNNVVAISNTFRHEILECDLIHELCEDIYIEDAGGYWMNSAQVIDIGPGSKAQPLHRDQWQFPIFTRCGPDAPEASINFVVALTPFTDANGATRVIPGSHKWKDLERNGTQEDTIPAEMDVGDACFITGKVVHGGGANITTDSTRRAITLVFQCSYLTPEEAYAFNVDKETARTLTPRGQRMIGFRSQFLKNSPGVWKRDYGQYDEVYC

SEQ ID NO: 3310 - protein, 1108 aa, Unknown
  Kingdom: Fungi, Phylum: Ascomycota
MADKKGDDPLASHVSGQSNRPMSAPAHALSVEQVAQDLGANPETGLTAEEAKKRLGEFGQNEFGNSEGVNPVKIFVGQLANALTLVLILAMCVSFGIKSYIEGGVVAAIIALNISIGFIQEFKAAKTMDSLRSLSSPTAQAVRNGNNQTVPTVEIVPGDLVELKTGDTIPADIRLIEAVNFETNEALLTGESLPVRKEISATFPDDTGPGDRLNVAYSSSTVTKGRAKGIVFATGLYTEIGQIAVALRGKKSRRREPKRRQDGTASLPRWAQAWVLTGSDAVGRFLGVNVGTPLQRKLAKLALLLLGTAVICAIIVLAANDWSGEQEVVIYAVATGLAMIPASLIVVLTITMAAGTKSMVKRHVIVRNLKSLEALGGVTNICSDKTGTLTQGNMIVKKAWIPGRGTYSVDVGNEPFNPTVGDVGLNKSQPKDIDFSASEAAGDIVTPKDLVGTDETLKQYMNVASLANLATVQEVEGEWRGRGDPTEIAIQVYASRFDYNRLRLSTGNEPQWHQVAEFPFDSDVKKMSVIFVDKHANKQWLFTKGAVERVLTSCPQYMDGEQLSEFTDAVKADVLANMEAMASLGLRVLALASRTDFREVEENEADLERGEFEENLIFRGLIGLYDPPRPESAPSVRQCHEAGISVHMLTGDHPATAKAIALEVGILPSRMSEIASDVAKSMCMAASDFDKLTDDEIDNLPLLPLVIARCAPQTKVRMIEALHRRKCFVAMTGDGVNDSPSLKRADVGIAMGQAGSDVAKEASDIVLTDDNFASILNAVEEGRRMFDNIQKFILHVLAENIGLACTLLIGLMFKDENNISVFPLSPVEIMWIIMITCGFPDMGLGFEVAAPDIMNRPPVSLKTGAFTIELMLDMMVYGLWMAALCLSSFVLVIYAWGNGDSEFGQDCNNRYSEGCRTVFRARAATFACLTWFALFLAWEMVNMRRSFFRMQPKSKLYFTQWCHDVWRNPFLFWSIIAGVFTMFPIIYIPGLNRSVFKHDAITWEWGIVLVEAVLFFMGVEAWKWAKRVYFRRADRKKSSDKVDLEERTFGAYFKSNISRSGDEESGLGNGSEHSYEKKATRSPEAATNDTPATVNGAVDAGNKEKVEV

SEQ ID NO: 3311 - protein, 470 aa, Unknown
  Kingdom: Fungi, Phylum: Ascomycota
MMSDVEKATVSPESGRRSRRLALKTSMKSPEHDAQASTASDKREPRRNPKRRSSQVSSSSFDLPDDLLAAAYEPVTEQERDEWEGWVELESDPASFNHILRELGIQGVQVQELFSIDQESLDLLPKAVHGLIFLFQYQPEAVEEHEDAQDNDVWFANQTSNNACATVALLNIAMNIKSLQMGKQLQDFKAETLPLSPPLRGDRLTVNSFIRSKHNSFASRIDLLDVDLRLDNNIEATEKKSKRRSSPKKGRRSASRPDEYAFHFIAYVSANGSVWELDGLKPSPNKLGPVSSSDWTSIARPYIEARMMQYAESQLTFNLLALCQTPLGSHRQQIADSLASLIQMRVRMGSNEDFKDLVSGEEQPLDVQNRTQMAEYGLQPSDIGQGAISDESARKLSRPDLELGDTYDLYLSFIARTKQAMRAYQGELRKDSEATQQKATPSAPWGPAIHKLVTALADKDELLGIIRHTS

SEQ ID NO: 3312 - protein, 527 aa, Unknown
  Kingdom: Fungi, Phylum: Ascomycota
MAGDSLKASKAQDAAARDAAQLAALGHDQQLERNFSFFSMLGLAFSILNSWTALAASLSIGLPSGGPATIIWGLIAAGSGALALAASNAEFISSYPSSAGQYHWAAIITPKRWVPIVSWVTGWINVSGWVALSASGGVLGGQLLLGIITMYNPDFAPTQWQFFLVFLLYTFLGFFLNLFTGTGLPVVTKAALVWSICGLVATAITVLACGAPDFRPASFVFGSLINTTGWPDGVAWLLGLLQGGLALTGFDAVAHMIEEIPNPTVRGPRVMMMCVGMGLGTGLVFQICLLFIIRDVDAVVTAATGPLIEIYLQATDSKVGTVCLVLFPLVCLVFGTVGIMATSTRMVYAFARDRGLPFSRVFAKVHPRVGIPVNALLLTNAVVIIFGLIYLGSTSAFNAILSAAVVALAVSYAVAPAINCLRGRKMLLASRPFVLPSWLGWVCNLYGIAYTIVITIFLLFPPLKAVTAENMNYAVVAFAVIIIISAIQWFVDGRRNFTGPSFDEFTFASIEGTNDEETQQVDHKSGT

SEQ ID NO: 3313 - protein, 646 aa, Unknown
  Kingdom: Fungi, Phylum: Ascomycota
MAIPTESRVDVLIIGAGPAGLMMATALAKCGVHARIIDKRGTKVFNGQADGLQCRTLEIFDSLGFGRRAWDEANHMLEICLWNPDENGVIRRSDRIPDTIPGISRFQQVVLHQGRIERFFLDAMEDCSDIRVERGVLPISLDVNESQVEDTEAYPVKVHLKHLTEEEATPKQTATSANGTSIQDGLFRSNLAKDDTEELIRKSKLNDKANTEEIVHAKYVLGADGAHSWTRKQIGVSLQGDSTDYIWGVLDIVPITDFPDIRMRCAIHSEASGSVMVIPRENKLVRLYIQLTTTAKLGEEGGRADRSKINPQVILEAAQKIMAPYKIDYRKLDWWTAYQIGQRVGTCFSKSERVFLAGDAVHTHSPKAGQGMNVSMQDTFNLGWKVASVVKGHADRSILKTYEAERKKIAKDLIDFDHKFSRLFSGRPAKDVMDAEGISMEEFKNAFEKGNLFASGTAVDYEDSLIVAKPKREASKGTERTVVSDQSLAPGIPVGHRMPSVKVLSQSDARPWHFQERLPSIGRWRVVVLPGDITQPAQAAKLANVGKVFDHASSFLRKFTPTGKPQDEVFEILAVHHAPRQAVTIFDFPEVFRPFSETEGWDYNKIFADDQSYHEGHDQYVSYVGSIDAPEIVTEFFSGFMKTRAV

SEQ ID NO: 3314 - protein, 331 aa, Unknown
  Kingdom: Fungi, Phylum: Ascomycota
MPSDLSNYLASRYLLADPKPSSKKRKRKQAAADQGLLITDDADSAWGTNNAKNDDNEDGPLMVSGSTTAEFRKAKKNNWKSLSAGKGADDSASADAILASAAAETKAAGGSADDDVPVVEEDPSVVKMSDGTHAGLQTAASVAAQLERRNREERADFERHRKTAKEEETVYRDATGRRIDVSMKRAEARKAAAEADEKERLRKEELKGEVQQEEARKRREALDDAKLMKVARGIDDVDMNAELKEQERWNDPMQQFLSEKKDGVGGGAGKARAKKGKPVYNGAAPPNRYGIKPGYRWDGVDRGNGFEAERFRALNRREMTKDLSYSWQMDE

SEQ ID NO: 3315 - protein, 593 aa, Unknown
  Kingdom: Fungi, Phylum: Ascomycota
MRRDRLRRDIVLAAVVIITLWFYVSSPTSRPTTEWGRLERYMNKGAALSATYGHKSSFDWSKVPSRLNSVPQDPLPPPRPGGLPKVQFNFPTQELRSVAKPRIAKLGVVREVFRKNWASYRKYAWKKDALLPISGGSKDQFSGWAATLVDSLDTLWIMGLRTEFDEAVEAISEIDFGQASSPKVNIFETNIRYLGGLLSAYDLSKREILLTKAVELGNLIYAGFNTASGMPVDFIDFAAAKAGEQLSIEDVVVAASPGTLSLEMTRLSQLTGDPKYYNAINRVMELFFRDQNKTELPGVWPMYVSMKKQDVVTGSKFTLGGYEDSLFEYLPKMHQLLGGGDEKYETMTKTFLRTADDHFLYRPMLPDRNDILMPGNVNMEGGKPVLDPETEHLSCYIGGTFGLGGKLLNKKVEVAIGEKLARGCAFAYKSFPTGLMPERLNMVPCPDRQLCAWAEEEWQEESAKRPEYKEYLPKGFTTAKDPRYILRPEAIESIFYMYRITGRKEYQDIAWQMFTSIIQATETEIANAAVKDVTIAKYPLEKEDYMESFWLAETLKYFFLIFSEPTIINLDDWVLNTEAHPFRVAKAPQQRNF

SEQ ID NO: 3316 - protein, 536 aa, Unknown
  Kingdom: Fungi, Phylum: Ascomycota
MATAIGMRPSRPQQVQELVAQAENFHFNTNISLKHWTRAAETLYQEASFALSEGDYGRAYMMLYRHSLLVLKHIPSHPQFKDPENKKAFRILSKRVDSVLNDLEALKPDIESVYNEWEQTRAPQEQAATEDYVPGSYDHHASRDPSLGGYTQVLDASDHQDLAVDLAQQELHRRDTARRATRQAGLSDQETSVRRRAGLWDSVGPQSTSSQDLDLQRQLEATRRNLDRPSLSGSSERQDNDSLRTTNRYHYPSISRPQQSDTQTWSLGNDSQPRLDRPPPVPSKSRPDYAHGYDARDSAPVLPPKYPVASEPPPLPGKSPIGALSPQYEPAPSAPALPRKERLTFRPGAYLENGEPIRSVFLPSQLRQEFLKLAADNTRAGLEMCGILCGMPINNALFVRCLLIPDQKCTSDTCETQNESAMFDYCDKEDLLMIGWIHTHPTQTCFMSSRDLHTHAGYQIMMPESIAIVCSPKFTPSYGIFRLTKPPGLEHILQCTHTDTFHQHSISNLYRGAERPDGHVYESDKLPFYVHDLRAG

SEQ ID NO: 3317 - protein, 644 aa, Unknown
  Kingdom: Fungi, Phylum: Ascomycota
MADNEESSATKLARAAHNASKARRPARDIRLLLATPDLTPSPSPLLAVASSPNVPASNEPSGPRFLSREVTLPPRRGSRRAPESSTSSPAPEASSSSSLPPPPAPLPLVGTDGFYFQIFQEQTAGDLSGFFDSVFFKERVLEASHTEPAIRHAAIALGALYKTWVQSWGNSSTSSESPREPGEQLRHWQVAVRQYSEACNAMMAMRDASQNSLRTQLMASVLLATFDSFIGDHRQAIVQIQNGLDLHERIRTAERLPAYGVATDTVEEELTIIFMRLAIQAKSYDLGFHFPEPYVVRFTSPAQHQARLQRTKEQQQQAELDTDLYSAHSSPGAGYQNNPASSSGGPETPLTFANLDEARVAHDRLNERLVRLQESMNIRPRAMSRMVMPEAWMRAIASFKEQLASWAQAFAPLLKSRTKPHVSRRERAGIAVLQMAHLTAAMISAIQFSSNELVFDKYMSVCRAVVDLGIEIVREEDALGVAACQAESAYCPHQRHPPPDYIESRVFSACHIKPTFSMDLGIVAPLFVVATKCRHRHVRRQAIELLRSCSRREGMWDGDLTARIAHWVMTVEETPLSDTAFGNPQVPATPPSIETYIGVPPERRVMIKSIDFDLRARWANVVVGTRNVDEGMPDPRYRATQITW

SEQ ID NO: 3318 - protein, 552 aa, Unknown
  Kingdom: Fungi, Phylum: Ascomycota
MFGRNKNKTVSPEASEAQHDYDYDTTSHPHGASADLVDPDSGVKRGLKNRHLSMMALAGIIGPGLLIGAGGALANGGPASLLIGFGVIGIIAFCIMQSLGELTTLYPGGGSFISLAERIVDKSFSVAVGWNYFIIWATVLANEYNVMSSILTYWAPEVPLWGFFLILWSVFMGFQMLGVEAFGEAEFWLALTKLLGLTAYFIFSIIYASGGLIGQDEPLGFRYWNDPGPFNGNGFRGVATVFVFCSTFYAGVEAIAIAAGETRNPGVAVPQAIRQVFWRIIFIYMGSALFFGITCPANSDELVSASGGKALQSPMTIAIRNAGWDGAVHLINAFIFITCLSAINSSIYIGSRTVLYMAQSGKAPRILGWVSSKRRVPIPAIFLTNAVGAISMMNVSTGAARAYGYIVNLSGVSTFLVWGSISFIHIRFRRSWRLRGRSREELPYKSMGYPFIAWFGLSACIFLALVQGWTTLSPFNAGNFVDAYILLPLFGIIYGISKLVWWKTDRFKRSFDIDLDSGRRIDLDQKGFHVNEDGNMVRSAKLPFWKRIWASF

SEQ ID NO: 3319 - protein, 703 aa, Unknown
  Kingdom: Fungi, Phylum: Ascomycota
MFSYPSFMPQPPWGLAQDLDCSKWIVFKLSQGAMLNKPDKVGKKPRPDADGPCDYCRTTEQVCSIDVTKRRQKPFYFVSEEEYRLLRELCTRCYPEEDLDLPSLRRLAAGTSNTSRRDVALRQDLSLSKAVDGAPETHHSTGTPAKDPSTVPEYEEDEDIPLPEITNLHNDLGCLLLDAYGEYRYVGAESGVSFNGAVRSWMLRMSSRIKTTQEDADKDKIPPLVKVTPPSTRSPLTPSTAPDGQPTSLLPPQAVVTSSAAQFFEQVHCLYWLYSTEDFYSRLDVTYRGDMDASSQTGSWLCSLQSMVACASSEPGPDTEQQGPGWLDKAKALVPRVCDEADLDSIRALILLALALQSKGFTNSGYVHIGLAVRIAFSLGLHLDKYATKDGLVTRAYARRLWWTLFLFDQDLSLQLGKPCMTESTASAVWQPPLPSEHVVGPGSHTPHGYLEQAIRLAQITQDIRQRLYTGPIPDKQSLTQYHFTAATESLAEWSNSLPPHLHLSSSISPLHRRSISLLHLRYWSTVMLVTKPFLLCNLLRGHEIESRKQSIFANFMTTCLSAAESSADILEGMVLHNVVSSLVVTDFYLALQTLQVFLAACVAISVSGYPKHLLPETIFQVQQFGIVEGADDGNSSALSTKELQGAQIGGQQRLNRDNRGITSDLISDSWLNELNMTDVIINDELWGDIMDFSEIFPANSLT

SEQ ID NO: 3320 - protein, 166 aa, Unknown
  Kingdom: Fungi, Phylum: Ascomycota
MSETDPTSELSPKFAPFVGMAGIAAAMIFGCIGAAYGTAKSGIGIAGVGTFRPDLIMKCLIPVVMSGIIGVYSLVISVLIAEDLNPPSSTSYTLFAGFLHLACGVSVGMTGLAAGYCIGVVGDSGVRAYMEQSRIFVGMVLILIFGEVLGLYGLIVALLLNTRTKG

SEQ ID NO: 3321 - protein, 394 aa, Unknown
  Kingdom: Fungi, Phylum: Ascomycota
MYSTKSAQSLKNLFAGYHEPAALSQQHSQKLLDGLKTSFRSQLDREHGHPSTSASAASKAAAAVNSSRRQSPAHQHLKTILTNPLFSYDKDPPKILDQPAATIKRDPMDVFQQAASKGMMTIQAATGCLIARNQSQQQETIHPATDAKETAARVLGWLHTSDYMENMQFMSNYRFIRALMPCLVEAGEDDVVWDWLSRSIASDRAHPHAISYLLLQLVWHKGHPRNGNLDSCITALLQAEQMFRSKTNAPDLLVRPWQAVSWLSTVEAYRRRPASEQLFDAHVNTANRLPGKFPVEQAHLQLLHPKHPDNEPALHLFQDKPNLRSLLTSFASGTEKKTARAVPVWSSIGSWVSSLGQDTVDSLTRSGRNDEAKEITRFLELDVPELLGHAPQTT

SEQ ID NO: 3322 - protein, 569 aa, Unknown
  Kingdom: Fungi, Phylum: Ascomycota
MRPSSPPFNMDNYGPLHPSRIDKGVAASVAATRQKSCNACVRGKRRCDKKAPKCTRCSSKGLECVYARVPPGATADSVLLEEEYFSSNANSNSAGRPGDRSAAASVDSSGLSASDAPEFGAMGSFVDIPSLAGSSAGNTSPESSLDYGLDSCNVNAAAAAGLGTTSGPHTTNAATAEFMQMDDMSGFSIADLLAASNPSFVGDLWDIHNFPSLDGDSGASSDNMPSAFNSSLNPNALTGKVDPHPLQVVAARPIRDLSMLREECDAAFDPLEVHDSRSKPGHILKVFTEIHATFSQTRSLSFLHSRLYATQLPKTVMTAFCAASAYTNRTPETKGWTVKLIGDATREIYAEGERANTPTEKLARLHALLIINSMRMLDGDLWLRAAAEKEMPVMIDWITDIVNTRDKLEEGLSKSQWTDKACPPKSWEAWLLLENIRRAIIASISFFCLISILKGEARKNSHPLTLPLSRSIPFVDSSLLPPPTAECELWSQPLHFTASRHLWEAQTSVEFYRAWREKPRFLIQNMQYREFWQYATPDDLDEFTRVMLTTQTGTEAMDHFMLGDTSVTA

SEQ ID NO: 3323 - protein, 473 aa, Unknown
  Kingdom: Fungi, Phylum: Ascomycota
MAIETSPHSVDYKSSDKGDMVQTASVKAGVIDHGVDLESREVFQTGDDILEFRTVSWQRAAIMFCKINFAMSILAIPEAISTVGAVGGSIILVGFTSLNVYTALILGDFHNRHPECHMLADMMGHIWGRIGRELVGVQTIVLQILITAGGVATTAVGLNALSDHSQCTAVFGLVASILITACSSVRTFSKLGWITWFGMITFTIGVFVFTIAVTQQDRPAAAPPTGDFELGWAAIAYPGFVVGMVSSANLFICTAGSSMFLPVISEMRRPQDYRKACLWAGLIVGALYLVLSLVIYRYCGSWLSVPAFASAGPLFKKISYGISLPGLIIGLGIYQHVAAKYAFVRLLRDSDHLQKNTFVHWGTWLGINFALGTAAFIVAEAVPILNYLLGLAGALCAAPFSLIFPCLLWMHDFKGHRSGSLVQRVQYAAHVLIILIGSFMVVGTAYAVGVAIKTAFDTGMIARVFDCADNSGA

SEQ ID NO: 3324 - protein, 307 aa, Unknown
  Kingdom: Fungi, Phylum: Ascomycota
MKSLIPLALASMATTLQYMSIENSILEGNTFEPEGVVRLGDDRYVFSIGQWTVRTQSYGAIINGTDRTVGKGFNHVRVYNGKGQIIADATITKRDDIEYHNGGIDCDGKVIWGTNEQYRPNSTADIYTADPYTLEMTIKFRYRDHLGGAVHDTRDNLITAMNWGSRNATTWDLNKIKSCSGGAYPKPEYTVRNPSYFLDYQNCKWLGHSKFYDGRSVALCSGVATIERFNVGGVALVDVKTMRPLAEFPIALSTARGGRVTQNPVDVSVHEGKLRLYFMPDQGNSTLYVYEAQPASSFQFGGGRIDL

SEQ ID NO: 3325 - protein, 475 aa, Unknown
  Kingdom: Fungi, Phylum: Ascomycota
MSSTSAPKPAQAAAFPDGTTDYKPLRASQAFDAKKVHIADQPMTWGNWYQHVNWLNTTFIIFVPMIGFISSYWVKLDYRTAAFAVIYYFWTGLGITAGYHRLWAHTSYKATLPLKIFLAAGGSGAVEGSIRWWSHGHRAHHRYTDTDKDPYSVRKGLLYSHIGWMVMKQNPKRKGRTDITDLNEDPVVVFQHRHFIKCVIFMAVIFPTLVCGFGWGDWMGGYVYAGILRVCFVQQATFCVNSLAHWLGDQPFDDRNSPRDHLVTALVTLGEGYHNFHHEFPSDYRNAIEWYQYDPTKWAITFWKWTGLAYDLKQFRSNEIEKGRVQQLQKKLDQKRATLDWGTPLEQLPVVDWDDFVDQSKNGKALVAIAGVIHDVTDFIKDHPGGKALISSAIGKDATAIFNGGVYYHSNAAHNLLSTMRVGVLRGGCEVEIWKRAQFENKDMTYVEDSTGNRIQRAGNQVTKVVQPVASADAA

SEQ ID NO: 3326 - protein, 275 aa, Unknown
  Kingdom: Fungi, Phylum: Ascomycota
MASVDTSLPPEPTGAAANLASAHSSPSPLKLYGGWFCPFVQRAWITLEEKGVKDYEYVEINPYKKEPEFMALNPRGLVPTLAVPMDAQGRDQKALYESLVICEYLDEEYGNEEERLLPRGTYERARARLWINHIATRIIPAWYKLLQHTPDKSFSLDEARAQLHKHLKAFATEMSPGGPWFYGDKFGMVDIALAPWAKRLWLIDHYKEGGTGIPEKGEDEVWDRWRLWMQAVVERKSVKDTWSSEERYILAYKRYAEDKTNSEVGQATRGGGGLP

SEQ ID NO: 3327 - protein, 530 aa, Unknown
  Kingdom: Fungi, Phylum: Ascomycota
MSTIKDEVSVNDTKMAHEEDVNRPQAIAATLNHQDQRPNPWGPGHRKLYFFCLIIYLCSTMNGYDGSLMGSINVLPEYQAYYNISANEGATTGLVFSIFQIGQMIGALFAWVCDWQGRKKSLVFSAAAIVASAVFTSFAPNLPSFIAARFLLSFFSTICTVAAPMLLVEIAPPFYRATVAGTYNTLYYMGSIIATFKEELITLKAIYGSNIHLSGNIKWRLPLILQVLCPGLVVLGGWWLPESPRWQVAQGQDEKARAFIVEHHANGDASHPLVEIEMQEIITSVESLRQRSAWACFDVSSLFKSRSRLYRLMLAVTMAWFGQFSGNNVSSYYLPIMVENVGITATSLVLLLNAIYAITGWVAATIGARLHDIVGRRKMLMGSCIGMSIALAVVAATAAQYEKTGSVPSSSASIAFIFIFGVIFAVAFTPMQPIYPAEVLANDMRANGMMFFQITSGCAGFINTFAAPTAMKNIKYWFYVFFVFWDLFECAFIYLFFVETKGRTLEELDAVFESKNPRKASTRRVITPEA

SEQ ID NO: 3328 - protein, 343 aa, Unknown
  Kingdom: Fungi, Phylum: Ascomycota
MPDNGFTFLPLGAIIQTFTVNGVNIVQGFDTAEQYKSHNGPFFGETIGRVANRLSNSRLDSFNGGKTYKLAANDGTNTLHGGNVGWGKKEWKGPKAIGIREIPGVDGLEGGESVEFTLTSEDGDEGFPGTVEARIVYTSGTVKVDGKEAIVLAMDYSAKLISGADETPINMTNHSYFNPAGVDAATYADTEITLSTVNHLPVDDRAIPTGSVTPFPNLKAETPFTLHATEPFIDHCFTVASDPSAVPIDTRSRPLDKHVQAYSPHTKIHLEVLSTEPAFQFYTGDGIDVAEVGGLKARGKRSGFCCEPSRWVNAANVDAWKGQVALKKGEEYGCRIVYKAWAD

SEQ ID NO: 3329 - protein, 421 aa, Unknown
  Kingdom: Fungi, Phylum: Ascomycota
MKAFLALALGLQAVTAKVSYDGYKVYHIETSDYEATESALSRLEYVSLNCESDHKTLEVAVAPESLDAFEKLGLNAELTISDLGTEIATEGDLQPYKGKAKKRDTCTGLPDFSYFDSYHVFEEHLDFLDDLQTAFIRNSETFVAGESLEGRPIKGIHLWGKDGPGVKPAIIWHGTVHAREWIVAPTVEYMAYQLIKGYRKKDAFITDIIDQYDFYIMPVVNPDGFVWTTTENRLWRKNRQPRSGNTCVGTDVNRNWPHQWDVPGGSSTNPCSETYRGEAPGDTPEMAILTNHTLSIANDVGIKFYVDWHAYSQLILLPYGYSCSAVVDDLDNQMELAAGVAQAIKSVNGLDFIYGPTCETIYQTSGGSMDYVYDVANAEISWAFELRPATSGQGGFVIPPDQILPSGEENWEGMKHLFANF

SEQ ID NO: 3330 - protein, 362 aa, Unknown
  Kingdom: Fungi, Phylum: Ascomycota
MATRQASGAVVSQIETILEPVLRQLSYHQPASVVLASKQGGVVSFEDVSFPGRSASEATKFARVVLILQLAHDSVVSGNVMTKRNVFYQNRDLFRTQTQVNRLVDAVALTLAVGREDLNIVATSKGVISGSPTITFADGSISNLSSGATGVPIPSPNMVDSIDLSHVRWVLAVEKDNTVLDEAKGYPDLTTREFLQSINARAPYLPIFTLTDYDVDGLNIARCYRFSVDPTSRSQATVNPGVRILGINTAQLLRLSPPLTSPTRLRSPEVLHSNLQSVGATTQESISSANSRGPVDHLTFRDRKVAMGILLALAEYKTDHVAMEMAIELQRMLMIGTKCEIQWIDDSGNLAAWLDEELLGIL

SEQ ID NO: 3331 - protein, 489 aa, Unknown
  Kingdom: Fungi, Phylum: Ascomycota
MSAKAIHEADGKAVINYHLTRANVIKPSPLPKPTKHNPPSRLASLHFNDDDDVNAVLDQAELSFPWLLQDGSKFVAKPDQLIKRRGKAGLLALNKTWAEARAWVAERALKEQKVENTTGVLRHFLVEPFVPHPQDTEYYININSVRDGDWILFTHEGGVDVGDVDEKAEKLLIPVDLAEYPSNEEIAASLLKHVPKGVHNVLVDFITRLYAVYVDCQFTYLEINPLVVIPNEDKTSAEVHFLDLAAKLDQTADFECGVKWAIARSPAALGMTAVASANGEKVNIDAGPPMDFPAPFGRELTKEEAYIADLDAKTGASLKLTVLNPNGRIWTLVAGGGASVVYADAIASAGFADELANYGEYSGAPTESQTYHYARTVLDLMLRAPMSDKGKVLFIGGGIANFTNVASTFKGVIRALRDFATQLTEHNVQIWVRRAGPNYQEGLKNMKAATQELGLKAKIFGPEMHVSGIVPLALVPGKWEEANVEEFKA

SEQ ID NO: 3332 - protein, 768 aa, Unknown
  Kingdom: Fungi, Phylum: Ascomycota
MKSGLYFTGAVAALAGTAVAEDRLVSQRLSKRFVDDEGHYNMTFFHVNDVHAHLDEFASSGTNCTDPSRGCYGGYSRIKSTMDDLREEHPDNLWLNAGDEFQGTLFYTYYGGEKIAETVNALKFDAMTLGNHEFDGGDEELGEFLQNLTFPVVSTNIKSDYEPLNKTIKPYVIFEEHQVAVIGATTEDTPGIANVGNQTRFIEAIPEIQNNIYEIRNETNITRIVVLSHLGYEVDQELAEKTEGISLIIGGHSHTKLGSMDDAEGKYPTIAKDMSGQEVFIVTAWRWGEFLGHIDLTFGDDGRALAYSGAPIHMTNTTEQDEDLQEKIDEWAVPFEEFAGEKVGFTENELDQTTCQDGDCLLGQVMADAMLEYRANLTTSDDEKPDFALINAGGVRATIEKGDISRGSVLTSFPFGNAIVEIKMKGEDVRKVLEGCVSMENQFNNDEITSWFQVSDGIYIEYNEDNDKGERLVNATIGGEALDDDEEYRIVTLDFLAGGGDNIFEATSDFATLDTQDEVLMQYLEAHNPLTSDLEERVVKTDGQASDDDNESGGSGGNDNNDGGDDSEGSGSDGGDVGDAAGMLSVPAWGSLVALAAAFFALLYHIYKAHVAGLGRWPCQRRSHPFSALDRNDLTLCSKLQLFPWMIRPLHHLCCPQAQLLVPTISHPSTWQRGSPQPPSNSHILPSIKSRSRTNRLNILPFSTPSHPTKRVISVESIIPCRTLVRFETETQHLLAKVLVVTHDEDAEDDERHRSEGEGYADGEDDCC

SEQ ID NO: 3333 - protein, 725 aa, Unknown
  Kingdom: Fungi, Phylum: Ascomycota
MSSSITLHNIQDQEAVHQRCLLVTGYCETAAAIDDGHIKITVGDKSGRTKFPEQTWPMCQGHFKALAILEPGENIIRFAFDQDGPDTFEISVMYVPLLQTPPLHLAIMVAKDSPLMMDCPPCKFGSLSTAHSSLDAAIAKLRVTAYMWQALTAEDMRSNGLGRRTFRLEEEWGRDTLSATFANQDILQTTAKVHLIRSNMSVAELRDRERAQQNPSARKADELHSIFTEALLAHGAPFLKESHPVVAGMILDSHYDANAKLITAHAALGAHDSKGLSLGIFGSHLTYSWPRFMEEIPNCLLDAQIPGDRVGNDNDECVSLWEACSVGQGAFLHEVGHAFSAPHSSGIMMRGYSKDWPKCFLSRTAYCRHTKCDGIVPVTDATPNDCHWDVRDLLRFRSLRHFRHPSDKDVDDSPPSFELREDEDFLGLTILSAAGLARITFNKTAEAEPSVASPVNSVYYTVDQLEGRFDPEKPLELEVTSMNGKHRTLNVWKFFRSKSFIRIPGTSIRLTKQGFGDEGHDDQDCSWLVMLHKKGKGVSLIAAKKIDIRVGCGLDGAVVHYKDGTSAPCGRMAGSHPTWDMGGHQAKKMAIPRGVEIVKVAVSGPSGWGLSGLRMFLSDGKAMGALNKSDGGEVRVLAPEDGQKIVGFYGTSGTYGMCKEFGILTMDKSQELMASAYDFLESQGNQKSKSGRKGSREDDMDDDSDDSTSEDEDDGYDNESDTDTI

SEQ ID NO: 3334 - protein, 1484 aa, Unknown
  Kingdom: Fungi, Phylum: Ascomycota
MAKKKKPAANPARGFATTSIASKPRPETVEEASKPPSKAEAEAATVSKDATPANGAASATSTGAAAKETALSPEEFERQLEESQLQIIVDKHATKVKRDAQRQQTRLETDRRLLRGQADSVNSSRWLPQELMSHILDMIQAENRFAASSISSDAPASGKMPPEEDVIARLWTLQQTLEGVGFPSDRVQAVSQFILDISSTISVSNKDMIWGLEEALEWLARECPAEELPSYEPKLKATIKDTLDDSPLPSRPVTPKAANSRGGRKGNKGAANGGAKKSSSSAKLQVTYDSDIEPDDLVPAYVDAKCKLLELERLSPATKGKSNTLSADDELAIAKLEAKLRKIRGDVLFDEYTAEQQWQAKRIPLEKELAEVKRLAEQEAEEEQPVEKSPPQVEAVEEGVEVNEEAERIAAEILAEGDDSDDGIEGLFDSLPQTEVDPTTGQSQTVINGSDGVKTVIRDFGKWTGVSPRRALDEACRSRDGLVKVNYVIVSESGYANRHAVDISWSKPQEIPLVVETSLMQVTTNPYRFTLTMTGIATPDSKQSEAYAATAALFYIFSGNAREEKVNLRLPAAWRDLWTELAEDKKNQLDSQDREVVRKLRDLVRKKQDQELEDGVILQGAFRGRATAKSSHNPSEAGSQDRSKQINGGEEIYRKIWADKSSTRKFHTMLQSRMQLPMWSFKQRVLDAVDQNQVVIVCGETGCGKSTQVPAFLLEHALSQGKDCKVYCTEPRRISAISLARRVSEELGENKGDLGTSRSLVGYSIRLESNTSRETRLVYATTGIVMRMLEGSNELSGVTHLVLDEVHERTIDSDFLLIVLKRLMVHRKDLKVVLMSATVDADRFSSYLGGAPVLNVPGRTFPVEVKFLEDAVELTGYTVSDTPPDKMVDLDDDAPEPEPEGPKGDLTKTLTKYSAKTRTTMTQIDEYRIEPELIVQLIARIASDPELQDYSKAVLVFLPGIAEIRTLNDFLLGDPRFQRDWLVYPLHSTIATEDQESAFLVPPNGMRKIVLATNIAETGITIPDVTCVIDTGKHREMRYDERRQLSRLIDTFISRANAKQRRGRAGRVQQGLCFHMFSKHRHDNLMNDQQTPEMLRLSLQDLAIRVKICKIGGIEETLGGALDPPSAKNMRRAIDALIDVRALTAGEELTPLGHQLARLPLDVFLGKLILVGSVFKCLDMALTVAAILSSKSPFSAPFGQRAQADNAKMAFRRGDSDLLTVYNAYLAWKRVCQANMGMGKEFQFCRKNFLAQQTLANIEDLKGQLLVSLADSGFLSLTEEERRTLSKMRFASGGRRRHQVFFEVPSRVNLYSDNDIVTSSVIAWCFYPKMLVRDTPGTKGLRNIGNNQSISLHPTRRRKSTSSSSICLGKHTNYSGSVYHAHETTATEPFAIALLCGDVRCDMFSGVIILDGNRGRFSVPDWKTMLVLKVLRTRLRELLTRSFKQPGKLPTAQQEKWFDVWQRVFTQEFGVEKSIGAAVAMPRG

SEQ ID NO: 3335 - protein, 294 aa, Unknown
  Kingdom: Fungi, Phylum: Ascomycota
MIDKRVAIVTGASSGMGTALSIDLAGKGWQVAMADIQPNVDLQKQLGDNASYHHCDVADYDSQATCFQEVWDKYGRLDALCANAGIVDKSSIFVFDHRNSDKIPPKPNLLCTDIDYKGVVYGTQLAIHFMRKNEVPGGNIVATASVAAVVPHESYPEYAGAKAAVVNFVRAVSRVLKIKENIRINAVLPGIVHTNIIPPEMVAAVSPECLTPVDTIVRAYHKALEDESVNGEALEASVNEILVLPRPELANGRFSKRAVTVWDPLFKMMHSAAAQDLKQSRTVESQRRFVASWT

SEQ ID NO: 3336 - protein, 162 aa, Unknown
  Kingdom: Fungi, Phylum: Ascomycota
MTTNIQLETSMGSITIELYTNHAPKTCTNFTTLVRRGYYTSTIFHRIIPNFMVQGGDPTGTGRGGSSIYGEKFADEISRELKHTGAGVLSMANSGPDTNGSQFFITLAPAPWLDGKHTIFGRVKAGMGTVKRMGLVKTGEEDRPVEEVKILAAKVLEEEDQI

SEQ ID NO: 3337 - protein, 249 aa, Unknown
  Kingdom: Fungi, Phylum: Ascomycota
MRFSLASIAAVLPVLASAQDAGADGDYVAQFQNFLGNLGSKIPHTGIHDPVAALEAKLGSMRLHVLTKENWWETLMEGVTPQTVSPSEWWVLLSGRNTTCGGRCGQLDQAFNETAAKFALSPGSPKMGYLNCDDQPLLCSSWMIGAGHIWAIDVLPNPEEVNIYKHRFNVSLATSDDMVALRVPDKATDERWTEVDSYFHPFKGQVSKLGLGMPFAYILWFFNIFPNWLFMLVVSFASRSMMSRRMAPN

SEQ ID NO: 3338 - protein, 737 aa, Unknown
  Kingdom: Fungi, Phylum: Ascomycota
MSEFTAADTIRILVATDNHVGYEERDPIRKDDSWRSFDEVMNLARTEDVDMVLLAGDLFHDNKPSRKSMYQVMRTLRQNCLGDKPCPLEFLSDAATVFEGAFPHVNYEDPDINVSIPVFSIHGNHDDPSGEGNFCSLDLLQASGLLNYYGRVAEADNIEAKPILLQKGLTKLALFGLSNVRDERMFRTFRDHKVKWFRPNVQMGDWFNMLAVHQNHHAHTATSYLPENVLPDWLNLVVWGHEHECLIDPTKNPETGFHVMQPGSSVATSLVPGEAVQKHVAIVEVTGKDFKVQKIPLKSVRPFVTRELVLSQDKRFKGLDKKKDNRQEVTRKLMEVVEEMIEQANRDWEGLQTDDEALEERPLPLIRLKVEYSALDGGQFECENPQRFSNRFLGKVANTNDVVYFHRKKKADRKATAVDPTEALEALEDGDDMVKVESLVQEFLQAQSLKVLPQGPFGDAVNQFVSKDDKHAMELFVSEHLTGQVKQMLGLESDDEDLNSAMEIYRTRIEQQVTAGERKPHDSRKRVLKPRPDTWDSDFDGSWEDAPDAWTYEEGTTTAAKKRGKASARKTVQDDEEMEDAEEEVSKAPSTRRAPAKTTKAATKKAPAKKPPARSRGRKAVSESEEEEEEEEEDDVIMESGPEEPPPKSAASRSRKAAAPARAAPAKKTTATTAKATTRGKAAPAAAPKTKQATLNFSQSQRGNGGTQIKAVEISDDEISDDDAFEPAPVATRTRRR

SEQ ID NO: 3339 - protein, 621 aa, Unknown
  Kingdom: Fungi, Phylum: Ascomycota
MTSHTPSADQPTPNENHGEVANLPLHAEAMSATPELPLRLSSTLSSTSLREMPNRNRKLRLLVAATGPREASWALALVVRLSNNPNIEMKAIVEHVVPRLTQTITAMPNKRLTQEQNTDDTAFYRQQAYKLVKWADLLVCVPLEALDIGKMLAGVDDTFLGKVIRGWDTTKRIVLVPGMDMNEWSNPTTKRHLSKIHRKWNWIRVLGPILWHWEGTNEGAPVSKPMPNWNGFDELLGIIQNQADLLGLGRDVQVANSVAPRHDSDTKVQAKLPPEIWTIILNYVGDWELAKALRVYTNLPTPRAWRDLSKDAGDPLKVYASELAWTTLTCNSAAICKKISESPPNFHDLPALVVKLVIRFALIGVLQYMEANRPDLFTAFDGSVLPTYASAYYPRLDILDYWRQSRWFRDRHHTYTHEALDGASKNGHVRVLDWWLRHSGFQLRYTESALEQASANGHLLVLEWWRDAAAQDEDVVLRPGRSVLWATQFGRANVLRWWDASGIPVAHGDGVAKLASRWGQVEVLETWRRLKGDNKLVYDSEVLRDPTEHGYVGVLEWWRKFAHGEHEGMEGREHPVEFRTCNIEEALEDSVGDQRGVRQWWAQNGLNLGVRNEEWLKTRYL

SEQ ID NO: 3340 - protein, 157 aa, Unknown
  Kingdom: Fungi, Phylum: Ascomycota
MSLCQNRLQEERKQWRRDHPFGFFAKPARTKEGVLDLKNWECGIPGKDKTKWEGGLFKLNIAFPEEYPTKPPKCKFVPPLFHPNVYPSGTVCLSILNEEEAWKPAITVKQILLGIQDLLDDPNPESPAQAEAYNLFKRDRAEYDKRVKRVVRENPAP

SEQ ID NO: 3341 - protein, 565 aa, Unknown
  Kingdom: Fungi, Phylum: Ascomycota
MPALIHDDLPSSGIGEITIYEDPWPSSRADTPLEDAALDHIALVGFFLRLLPHFPRGDGGVITDEALAYSEWRYICYLRYLDTHGLSPHDRPPPWDVAMVWYCHLMSPSSFQSHLWNHGHRAFGLDYRHFPLKRLLQLKQWGRWSDRQTQKDWDRWAASSNVGYYLTYQLWDSPPWEHVSLLSRILRRAPKTQPPRRLTKHSVMPTHSPAPYVSHSKTTSSSLTATHIHQPHEKVFPCSLKARASDPTSWPLSDYALFRSGQIHRPCQSQALHDACPPNSPQSACELAPWRCISHLKTALYRQAAFWNALCVARETQPSFFGAPTTSGVVSEYATFITLLRRPIPKVHGMSRFDPKAQRLPSIHPETRLVPPTLEIDLLWRTHRLFPGSYWAWCDENIGQLIDSEAAGEGARLAMEMTRAAWATLSPIAWPSTGSPIQGWEDTYTPDVAILGPLPDETTPISSILTGLLPRRKRRHAPRKPPSAHQRYATGTSGGRYSFSSTAGAASPRTSTTISGGGARGSRSTDGGSSTLGQGNSTRGSVDQGYVPLGKFEDEKNWRISGVVL

SEQ ID NO: 3342 - protein, 195 aa, Unknown
  Kingdom: Fungi, Phylum: Ascomycota
MDATTPPSDSAMPNTLPRIHRYITTHDTRGKAVYSNAIPEALNFWTVGAADGQAAGFELGYTTGGLPIDLNGDQDLLSFKDAYEKKQESGLVKHGGTILRFCDIPPGGTSPMHRTNSLDYGILITGSLECLLDSGESRTIYPGDVIVQRATNHQWKNTTDTWARIVFILFDATTLEINGVPLQEDIGGIELPPSH

SEQ ID NO: 3343 - protein, 465 aa, Unknown
  Kingdom: Fungi, Phylum: Ascomycota
MTSHLVFDVALTPADKVVLSNLASDIALTEESKGSTSSTSFSGADARIHDVKQTGAKQPGMARRHSTTQGDSSLTYLEEKTTHDDGKDIAQLKATNDPNDPAFEPAVFSSVDLRNLHLPAFVDAYLLRPYISWASNIVRNKTDVIMLTHLLIYASTSIPSALYLFYNFTYKHAIFHVAMQFWYMGAYTLLMHQHIHARGVLAKRFGLIDKSFPFILDPLMGHTWNTYYYHHVKHHHVEGNGPEDLSSTMRYQRDELKDFLQYFGRFFIAIWIELSLYFLRKRRPAMALGVMCSELGTYALYYAASCVNARATVFVFLLPVMVMRLGLMVGNWGQHAFVDTEQPDSDFRSSITLVDVASNRFCYNDGYHTSHHLNPLRHWRDHPVSFLQQKETYVREGALVFHNIDYVMITIRLFMKDYETLAKCLVPIGDQVHLSMEDRVALLKRLTRRFTEEELREKYPNYKST

SEQ ID NO: 3344 - protein, 303 aa, Unknown
  Kingdom: Fungi, Phylum: Ascomycota
MRVSLNIGAGALLLAPGVAAWGSLGHITAAFIASHFVENTTQAHFQELLRNDEDDYLAKVATWADSIRYTKWGRFTKNYHFIDAHDNPPYSCDVDFERDCKDDGCIITALANYTAQTLSTDLPSWRRMQAAKFVLHFVEDLHQPLHNEDVQRGGNGIYVKWDGREYNLHHVWDSSIAEKWIGGRRGKPFPMAEKWANQLVVEITDGKFAAEKDKWLDDLDFSDPAKTAMAWSREANALVCSHVFPEGPAAIVGQELGGEYFEKAGPVIERQVALAGFRLAAWLDHIAEEYEAKLTSEDGSVEL

SEQ ID NO: 3345 - protein, 802 aa, Unknown
  Kingdom: Fungi, Phylum: Ascomycota
MSAFPNGLSHLRAGADDVAPTPSNDPAIQDAANEADMRAALAALHEKETKICTRLDGLVASQTDMSRDLGRLDMLRAGLGAQVIATRSISNNMLSTAAETAGRLSDKVKELDLEKSRVEDTLRVVELVAELRACVHGVVGSMGAPQDWEAAAGYLDRASKVPDEIVRGAFAASIVPSVEVPDPPWVTLENAKESLCGLFLREFERAAGDSDGTKVTRFFKLFPLIGRADVGLDVYGRYVCQGVAGTARATLKDGMGGHSRKEGFFYANSLTKLFEHIAQIVEGHGGLVERHYGSGRMVRVIERLQMEADVQGGIILDTWSDERGIDRKLTDVKSYPFSFLVRSFLPPTRGGTPRVNSPAVGGQTPGRESEDEGVNMKEIDGTLNEISLMLGRWSLFTRFIAGKCKDPAAADDAPLVMPDVLIKSTLYRKVTDKLASPYNVMAAFFFRRSVEKAFQLDEFPAGLSLSLNRTIDANAPYIILAVDDVMYIVNTVIQKTISTSQRDVVGSVVPTLSRIMTADFIGMIQRKMRDESYPRAVVQGGFPPEDRIIQFIVLINSLDMSNEYLQRIISGRIGSPYETTNGDDAQNPLHQSFPFERDVTFVTGALRTFESSFITKSNELLNEGIQVLVTQVVKPRLRPVLTDTFRDADYTLTEDEIAEIAQQNDEDEEEILDQVSRRFEHGWDQLMKPIARLMTPGTFSILLDTTARHVAKLLEKRILLSSGRMNAFGAIRVERDFTGIIDTVSRGDYRVREVFGKVTQLLMVANMEDDEWEEVNALSGADVIDWVLTEEERRKARSLVRP

SEQ ID NO: 3346 - protein, 379 aa, Unknown
  Kingdom: Fungi, Phylum: Ascomycota
MPLSSLSPDPGNIAGCNAHCTALHYTTYHYTTLTHRGDGLPITSVPGLASPTSARFGRQGFILSPRNHVASSPPTLASSHKTSVHTLSPPVHPPLILGRPTCLVSLFCPPFATSSCCAVHGPFLPLTSNASPSLLHDLQPIANIETELLVHLFAANPHHVNQPPVKFGNRTIQVSLSLVRISALSLSPHENHHNAHLSGVIKAHHGPVAPPPIQPTTGPKPVIARLALLPVFIEPSSLPTPSAHINICFRVVRPPPPQRQHHARTANMATADSKPQQARTSVRYSTYSVAAPSVSPTVQSSDSTDGELRTIAVGLDRMENKALSSQRVVLDEEKTDNMRKLALGAKLERALDRRMSSQDAVMRPRGKSVSLEKDAEKSG

SEQ ID NO: 3347 - protein, 340 aa, Unknown
  Kingdom: Fungi, Phylum: Ascomycota
MKGKLDPVFERIYNKNIANTPLRPPNLAALRTKYSVLYSYATGPAPDIGRIYDDTLPLEDGQLLKVRIYEPSSEGPWPVHLDFHGGGWGLGDLDTESHICQHICAKGNVAVIDVGYRLLPENPFPAAIMDSFEALKYIHAHGAERFNITTESISLGGVSAGAFIALALPYLATEASIPLRLVAVGTPVIDDLSQYATAADSPYASMRENEFAPTLNWARLTWFDKIKWSTLPSDPSAREAAKREMGWFTNLLDAPKATSEHPKTVIYTAGADPLRDEGERYAQKLVEQGVEVTMRRFPGVPHPFMHMDKDLWQAREFIDSTAREIRLAHHGHPAGRDTRG

SEQ ID NO: 3348 - protein, 550 aa, Unknown
  Kingdom: Fungi, Phylum: Ascomycota
MGFTINNIFAVNEDRPTPKAVYNWRVYTCAAIASFASCMIGYDSAFIGTTIALPSFMTEFDFASYEPEDLALLKSNIVSVYQAGAFFGSLFAYITSYFIGRRYSLIAFSLVFMLGAGMMLGANAERGLGLIIGGRVLAGVGVGACSNMVPIYCSELSPPAIRGRLVGIYELGWQIGGLVGFWINYGLAETMAPSHSQWLIPFAVQLIPAGLLLGGAFWIPESPRWLFSKGRREEAMKNLTWLRQLEPSDLYLVEEINYIDQEMDRYNKEVGPGFWKPFRALKQRRIQWRFFLGGMMFLWQNGSGINAINYYSPTVFKSIGIQGTNTSFLTTGIFGVVKTSVTIIFILFLIETVGRRKLLIIGSVGGSLCMWFIGAYIKIADPAGKIAAAEAAGNTAAPEMSSGGIAAVFFFYLWTTFYSPTWNPIPWVLNSEMFDENSRSLGQASAAANNWFWNFIVSRFTPQMFLKMGYGVYFFFASLMIMSATFVFFFIPETKGLPLDTMNRLFEIKPVWKAHGQLSHELREQEEVFRRDAELNEEKSGVMAQEKERV

SEQ ID NO: 3349 - protein, 864 aa, Unknown
  Kingdom: Fungi, Phylum: Ascomycota
MGDPATKSRPGIFSECAVSFVAGTLLTPRTISDLAAAIKENGGEVYEPRRDGSLRLDEATHIVSNTIDFPQYAESQAFMIPVVTADWITVSLARRRQAIVRPYSPDPRLIFSTLVVTCADLPLTDKESIIGATLAMGGSESKDVNRTTTHICALSMDHPKVQAAVDAKVKAKIVLPHWFDDCFKLGKRIDEGPYLLPNPEILSKPADASLNIPTNENLEGATSPNPMSLPFPPNSDIVRPPCTVFQDKRVMISMDVVTSSRKRFMKVVEEVIVNGGGKLADEVEDCDIFICHYRDGPQYVRAAQSCKDVGNLAWLYHLIVHNEWTSPFKRLLHYPVPKDGIKGFKDMRITVSNYGGEARIYLENLIKACGAEYTRTMKQDNTHLITARDTSEKCQVAPEWGISVINHLWLEESYAKCEMKPLTIKKYTHFPPRTNLGEIIGQTSMDESRLRELYYPGGEEKLSSDAKKKRKILDAADENTYGHGPGEGLLKTPAEVDKEMDVMRDDSGNSIEPKTKSKSSRKSAATPVRSSRLSSGKENATPTSMSTGDRSAKAKARDALQHIAPDIALYEKEKKRHSKSGPWGGKRAADTTEKEQEKSAKKGKRRETEEEVEDEEEEEEKRPAKRARPSLPDVEMRVILTGYTRWVGDGRKEDTERRKLRNMGIQIVSEGSPCDYLAAPSIIRTVKFVCALARGATAISSDFITACLEAGELLEPQDYLLKDKENEKKYDIKLSKSVARAKAHRGKLLWSVAVYCTDKIRNGPESYRAVAEANGAIFKMYRARSGVTIKPTTAEEDGGRAPEPVYLLSSMSPEEKAMWPRFKDMAEKGNMEPRVVAPDWLLDVAMAQEVRFDEKFLVENFYDE

SEQ ID NO: 3350 - protein, 374 aa, Unknown
  Kingdom: Fungi, Phylum: Ascomycota
MGNHDGQQYDPSMFSMEDLGPMVNGVVWFLAIIAGIVLALRFWCKMSRGKGLWVDDYWLIASLGCLILTACFNSASVAFDFGKHGWRINWAEGDWLLLNMNLAGTFSIIAAAWSKTSFAFTLLRIAEARWMRFLVWFFIISLNIALGGGVLITWIQCWPVEKTWRPSTEGSCWPKHIHVHYNIFAAIYSGVMDIVLALMPWWIIWSANMTLKEKLGVMIAMSMGVFAGIISFLKIPSIFGIGKADIIDTVPLVIWGAAESSVTIIAASIPVLRLLLPSYTRHVNELDYKSGSRKLSDIESATDSRAIASPTAARTPYSPGNQYSRGTPYRGQDIPSIQEALQTSSLQGANASGVGGGYEMREKDLPPLPRYSRM

SEQ ID NO: 3351 - protein, 154 aa, Unknown
  Kingdom: Fungi, Phylum: Ascomycota
MMYSSFFQSATLLLAAVGGVLAAPSHVEQRAPKSPITHLGTSSAILSSAVMTKDLVYTSGTVPSINGTIPEGIEAQTTAIINTISGLLEEAGTSWDLALKTTIFLADMGDFQAMNAVYSKLLPDPKPARTTIQAGKLPGNFLIEIEAVVARPHC

SEQ ID NO: 3352 - protein, 85 aa, Unknown
  Kingdom: Fungi, Phylum: Ascomycota
MRSTTAMRMFRQTPRMMRPVPKEDQAGHTISQRLRKLRQIPPELIPLGVVVGFAVFAAGYSSIRKFVVDKNLRLARTGPAGREDH

SEQ ID NO: 3353 - protein, 439 aa, Unknown
  Kingdom: Fungi, Phylum: Ascomycota
MAQPRRTRIAIVGAGIAGLTAAIALQGQPHLDVQIYERAAQLQEVGATIALGPNGLRILDDLGIAEALTDDVGFRNHTARSMIYRHYQTDEDISADVHNGPVQYKHQTARFFRPHLQKVLLNHIKPGRLHLNKAFQSIQRIPPNDFLTIHFQDGTSVEADLVFGADGIHSAVRRTFLPGTTAEWTGHIFFRTVVPRSHYEHIKDLPNEAVHYWGPDRTLFLSPLPQNLYAVVAAYQADPKDPSGSYKVSEWDKDADVASLRPLYKDWSPLTRAILDATPHVKVYPNTAAKELDTWILGDGRVTLGGDAAHAHGGAYAAGGSLAINDAWAFAQSVVHYIPATSTSSLNDQTSAKILRLYERTRKPHTDRVQRTVQQRNKFLVDQIKKTQTDAQLRKAMAKRDHLSWLHEHDVQAAFDNALADQSGPPVIQPEEVRAQAHL

SEQ ID NO: 3354 - protein, 664 aa, Unknown
  Kingdom: Fungi, Phylum: Ascomycota
MNQAQPQGQAGAQPGQQQRPPPMYTAATIETLPYITDEEKTRYKAGLQGLWNKVSNTQPETPESQQARRKIIEFSRMLVNKITQRRQAQASGQPQQGQQGQQGQQQGQQGQQAQQAQPQPQQPAPQPQPAQPAQQQPAQPKASPVTQNAAAQAAIAQRQNAQAQQSGANAAQATAVPAPANQAQGAQAKPRLPDHIMQHLNKMNIQPPQSYAAGKTQAEIQRWIDDAKDRYGKALLQMDTTKKQMNQFEKLAKDRADSGNPLNETEMATLNQRKEQQMKAWHEAKSWADSFRKQVQANASASANAPPPAAAGQQPAAQAQQAPQAVATPVNPALEAAKQQANRAPNPPQTPVHPPQRPGPSIQQPMNPQQPKQEQPTQQTPVNAPQPQAMQQARAATQPVPPAGPASGQGRALTHSAALSLANSRASNTPGSAPIQGQPQQPQQQAGNGAGTPGSAGPQSQGAMNVQQGHPHAHPGTQQPPTIQSKMPIPKQLPERAMSVPSGVTVGGGVAPGRPTMSQGSGTLGGVMSQPAVAKVQAYNHEAEGDHVLSKKKLDELVRQVCGGTAEGQEGNMLTPDVEESVLNMADSFVDNVLHAACRNAKERGSKVLEIRDIQLVLERTYNIRVPGYSSDELRTVRKVQPASGWIAKMSAVQAAKVMPGKGE

SEQ ID NO: 3355 - protein, 613 aa, Unknown
  Kingdom: Fungi, Phylum: Ascomycota
MRQRHLTFVAAFAFLLILSYTASRLHTSSFSFPIKPSFETNATQSSSVDEVVNAVPEPDHNAGPRAITNEALHPIAALIKEAEDNFEGTKTRQSKTLGEAVKEYRRRYGIAPPPNFDKWWEYARTQGVQLVDEFDTIYDVMTPFWGVNPKTIRSRAKEALSHKNHLVGVAIRDKQVTLVEGGPEWQRNATKGMLEGFLQFLPDMDLAFNVHDEPRVMIPHDDLSRLVRKAKEQNMAAAGRAKKLKNGFSGRPEGLNEGTVFEETKLTRFNVFPQQATWTNSRMSCSPMSPARTLDDEDNIDDLSGYSLGQVGFVYNTTAMTDICSTPSLRSTWGFFGRPNAFSVVHDLFPIFSQSKISSYADIIYPSPWYWNEQVVYDEERDMAWDKKKDKLYWRGSTTGGFSREGGWRRQHRQSFVQQINARDDAKIMANTGTEESPKWEVQTSPRGDHRDLIDVHFSHVGQCDAGDCEAQNQFFEVVERVDQQDAWGFRHLLDMDGNAFSGRFYAFLRSNSLVYKLSLFREWHMEWLRPWVHFVPLSLQGQDWLEVVRFFGRNGTGSADAERMAAGSREWANKVVRKEDMEVWFFRLLLEYARVIDDDRENIGFDPNIASG

SEQ ID NO: 3356 - protein, 571 aa, Unknown
  Kingdom: Fungi, Phylum: Ascomycota
MASFLRVSWSKSLRIKIMIVIDTLFFLLELTSGFLVHSLALTADAFHMLNDIISLIIGLWAVVAAQKETTDEFTFGWVRAEILGAFFNAVFLIALCVSIILEALTRFVEPPEITSPKLILAVGCAGLFSNLVGFFVLGGHGHSHGGGDHDHDHENEHDHVHEHGHGLHRGHSHGHDEEEGLGAHASTESSDVTAVEDSDPVIHGPPEVVIRRPTGAGQRSSSDDQPRRIRFDDDSSRDDSNTRASKGSVSSRRDNRRSSKSSQNHSRLASIEDMSIHPASFRQEIISYAASSSAGAEPASESDTDDNCQSGDYEQNADEQSPLLKDTKGNNGTMNTERSCRGQRALSPGKGRGRRDSSVHNGHNHTLPKKPGKKGGHGHSHGDMGMNAMILHVIGDALGNVGVIVTALIIWLTEWPGKYYADPAVSLFITAIILKTAIPLTRATSRVLLQATPENICIADIRQDIEALPGVVSCHHIHVWQLSDTKVVASMHLQVSFPIDTNSGEKYMQLARRARKCLHAFGIHSATIQPEFCLDAQHQHEAEAAALRLDGTADGPKNEVCLLDLLDPKRK

SEQ ID NO: 3357 - protein, 616 aa, Unknown
  Kingdom: Fungi, Phylum: Ascomycota
MASWWLPSRIEATVTRQFVVQQLVPEEIQRLDQPVAFGGEDLTERTYWDSIHQNAKRLFLILLDLGVPDQIFGIIDDGWDDAELPLGPEDVERLQLTAEKDDRIDRKFYQRQFMYLTKAINRGEHQAYSDYELVPLDVVDRPQGKAGSVDRVKLPNGGSRVFTRRRLALGNAPGLLPHRDFLDLISGIRPVRNEHIVSYWASYTHHGYGYILLTPTTDYTLKLFLANTPSVFKNLAKAARRELVMNWILCLADTMAFLHSKSRSHCCIKPSTILFTDSNHVFYADSTRLSPEAAGNGKDSSFDREWYDYAAPEQWYRPTGPGSPSAKKGMNPYSISPEGANFSIPKGPDGASSPSAAFHSPNPQLNPQQADIFSLGCIFLELLSFLVKRSTSKFASFRSAKHKTAGRGGAVLDTSFHKNLSQVEAWMSSLAKDASKKISDSDGGNVFRGITPMLHIITGMLSANPYDRPSAPEVQQKVYQVLIDQCDIEEPHCVHQYSTDLEYSLSRMQMADGEGLSQPIPIQHAGTYGVGPGTPRAFRHARTGSDGGYSEKSGTSNKTGSSSENGVLDPPYRGYSSGGRRGAPAPPSQPSASGWAGQAPYMGTRGDPATLYASAR

SEQ ID NO: 3358 - protein, 983 aa, Unknown
  Kingdom: Fungi, Phylum: Ascomycota
MARPHDSPILARLRSARTLPDRTAALRALKNEIVGHGELKEAWIGVGILEPIVRTINLSSARSWTNGKDAQGAGYKPLSEEDAAKLQALQLVASFANGGPAFLAPMHAAGIVPGLLSNISPDDNPPQIVVAALRALSNITDASALVAISSPLDRAALAEMLFAHENVESLVALLALPSTTHLCQTQITLSAELIGTLCTDDRHRHDLTMAGILDALATRLASFAVAQGHVVPGAEVLAASDGLIKAFPDAAPNNAKMEPILLAMASIIGDSKHRAHRLAYSPSIMAVFPSLRFRPTKAVQDLRQGNEYSGSAPVSPQEDATAMEYMLPVLPIRSTRVQQPKYYSYSSPERIDPQLSQPKSRLTATTMWDSLRTHRLGRAAEDESQDVETPLIPWLIYLVRRRSDSERVSAAAILTALFKAGLSPLQTREASLGLLVVPILVDLIARHEKSTTSDITPSDTNEAEGRLVLERAPAVLARLIADSEVLQKAAYDCDAVGVLTNILKRAYTPVDPISATTMWSPHADSQMDIEDEAPVARMGQPGENPLQVHYLELRASTLMAVAALAGQEEHRKALVREDLVLYVVESLAEFPKRPQPPKEKPTERRPGTIAETITPGYGRNTVKVMVAACHVTPLPILKFMEHSDVQVQVAATATMCNLVLEVSPVREQLTEFGVMNLLCHFAHSNNHALRINAFWALKHFVDAVGPTLKKMCLEKLGAEWLIRLIWENGPNTTAYSPSLERSSSDAMEDETETEIGETGPEPHRWLYAAGGTIQQLDASQSTRLRQAEDKLATIRDAELDPVRQARNDDIALQEQGLDLVRNLIGRPGSGAGNGDSPSETTEMIDYLLEQFGEDRLFDILVSKLRSRMVGRFRGAAGQEARMVHPHAKIMETVIYILVHMAASIPRHRKLVIDQTDLLKALCPQATNKDPGDDDGETPACQQRAQELRRLGFLTKMDAMKQQDRDIDVRERAKTAAWQLKQAC

SEQ ID NO: 3359 - protein, 390 aa, Unknown
  Kingdom: Fungi, Phylum: Ascomycota
MAPAPIDSSIKDVVAPKKDSLPLPAETRSRLEKAGIDLSHGYPYRPSRPLYLQDVYKIRAEDREYHDAGARADKSKKSLLAAATKVTDLTANIGTEIEGVQLKDLSPEQRDELALLIAERSVVFLRNQDISPQQQKELGEYYGEVEVHPQVAQVPGVPGVTVIWPDLQATEYPANFRRPGGASRWHTDLVHENQPAGITHLHNDTVPPVGGDTLWASGYAAYEKLSPEFRKIIDGRKAIYRSAHSYLDRDRPEAGPKYVEREHPLVRVHPATGWKALWVNRSMTDRIVGLDKAESDLILDYLYDVFEQNVDIQVRFKWTPGTSVLWDNRITIHNASWDYGGKHPRHGTRVTSLAEKPFFDANAPTRRQALGLLGPDEKEELDITTTAETL

SEQ ID NO: 3360 - protein, 689 aa, Unknown
  Kingdom: Fungi, Phylum: Ascomycota
MATDPPPQVGSFEVDMVAPELTGPRTLPPRQVTAATIEDAYVQFIVYCNPALPNKADIGSLRESFRVPPKSGGKAFDPFVIFELVRQFYAKEIKTWAELTMRLGVEPPDLSKDESSQKVAQYGVRLKKWMNSMHVKAFFEYLMNIPNEYWTQIPKGPDPLGEPHREGVALEDDMALRALLPQIRPKRGRKRPEDDEQPFTPVQRPRLSPATGTDEQRIPTTQPWLGTSDGSHLNPHGETPRSAIPPWSSTDPGQRPFAQWPQSAVTPSTRGQFWDDPNEPRSAITPSKLKPSQRRGVKNVSSAWKTGGPDSIGKTRGRPPINRTPIDGQSFASAAWPSTQANAGVSTPHDAFPPGQESSHIMASSSDPPRAQYAPMESERRTSTPTMAGMQHDGARPARPSISLQVPQRPPSSVRLASPPAPPPQPPPHPESHPQTSQAPPIIINNGDSHQDTPVNESQNKSAAWSTWASEAMGAYGESSTTSRQSTSSNGTGAPPGLPDYYFEKIEDRTNVDAIMSYFVQAAFDADWFNADGTPGERASLEEATSIVNTALQTMYKSATSPQVFLINLAALAGARHLMTRRARYIRRGGDENFRNYSFEWEYRFGHVHGKFTMLHKVPKTMWPIEEPPPVEPPEENGDGQGDEQDKAAMSAADWQKKYENLLKEVERKNKDMWELRTRVMGWGRGGTL

SEQ ID NO: 3361 - protein, 559 aa, Unknown
  Kingdom: Fungi, Phylum: Ascomycota
MLAGGLAQMTSNNFGSGLGMPTGGLASRRGGQNIKPLSFESTTKQGGPIDNGAPTPRTARGHLLAGLRTAPKTSTATSFPPMSPTTANPQQQYARNNGMGANGGNMDNAYNPPKTAFPQYNSQTTYNNSNNVPDQQYTVDQVLAPPELPLDEQAQDFMEPQLYEQLVATNMYLAQQQQRLQQQLRSVQAAAQQFQQLNLSNPQLNQQQMMLYQQQQQVRNLQQQLGIQAAMSQGQQVYYNAATGQYLVDSSGMGLGNAYGADQQYAVQQHQQQQMFQQQMQQNMPRVQVSPPPENQAQAPAYRSNSPPKRYDSPQTEVTPLPPPSANAFRRGHKKSTSLAPVDSALAAAIGSDGPKSAGPKTAHFPLTPATGSYGPGQARAGEHPIRQPRGPPSLDELKAKPTAKHEGSKNFATRTRRSALCNLMRAGNLRRKGTSSSAGSMSPVSETAEESATPITDNDSDSGRSGSGSLDGEMECGDSQTSASGSWGAIGSDRPSSRQKTTRGSVDSAVSETESNSFANVFKNGAARAAKEQEQAGAQRKAPRLVLTSVEKRKTTLN

SEQ ID NO: 3362 - protein, 924 aa, Unknown
  Kingdom: Fungi, Phylum: Ascomycota
MASYATASPDSAITVKINYDGCTRRAKMVLRDMVPGQLEQQVRTFLRIPTEQELTIERYSDSAGTYVVLDSTNVAVYKQLYRAAKAKSKLKLRVTNPNNKPAPRPVTVEEVPDTSSSTEIPSELKTDARKSEESFSSSATAAPQQPLATPRNTVEVTLPFRSGSMSKTYDSDKLSKAAQHLEEFESLRKDLHQRLHMFSNEMSEVHQPALTIASEAAARRLRIIQDMHKSRVNNAKADLVNLNTSSATQLSSQAPPTRSAQGFAVCCNSCDKTMPDVHYHCSTCDDGDFDLCSSCVDLGITCHSPQHWMIKRTTVDGQIVNSTTEVIPPKPKKQLKPKVEEKPTSAEAAKPATCYPPPIPVCYDTTIGNEMFTQFDPCSTTLRTCNNCIDAFGEKECLHCTVCEDFDLCKDCFAKNKHGHHPMHAFAPAIPGTDMPENIKVKLAAGRNQLHHAICDGCDKYIMGVRHKCLDCPDWDFCASCQPTAHILHPGHRFVPIFTPLVDSVRISDKSVHQGICCDGPLCAKQGYPSYIRGTRYKCAVCDDVDFCANCEANPGLGHNKTHPLIKIKTPIRHINVTTTGEKGDGSPMCVMGDGARVPRPSIPSPSPVSEPEAAPEVAPAPVAELKIESPREIVATKTIETPKPIIQLETLAEPRVSITPKPQVMKKEPKEFDLNATFVRDTVVDGTIMPENHVFEQSWVLRNEGPFAWPAGCSVKYVGGDYMGHVDSNHPAEISKLVSASESIVCYEALAPGQEFAFTVLLRTPSRPGKFVSYWRLSTPDGMKFGHRLWCDVVVRAVKVEEPKPVVIHAVAEEYATNADFAPVEKPTVEEAESSAASSTMIFPKLEKESPSASMHEHTRAPSTVAPSTIADDKVSSTGVPDESAEDEDWDVSEDGFLTDEEYDILDASDEELLEEHAKKMQK

SEQ ID NO: 3363 - protein, 451 aa, Unknown
  Kingdom: Fungi, Phylum: Ascomycota
MRSNSLRCLALRRAAPSTPRALRTPLQVRAGSSVSQRPNSDFVSFPGALKSAFTTELSFETPETYTALPTYRVVDQHGVVVDSSFQPDISDEQVIKLYTDMLYISILDMIMFEAQRQGRVSFYMVSAGEEAVAVGSSSVLDREDVMFCQYREQGVFRERGWSTKKFMDQLFANKFDHGKGRNMPIHYGDKDLHIHTISSPLATQLPQASGAAYALKMQKLRDPDAKARVVVAYFGEGSASEGDFHAALNFAATRSCPVIFICRNNGYAISTPTLDQYRGDGIASRGIGYGIDSIRVDGNDIWAVREATKRARELALTDGGKPVLIECMTYRVAHHSTSDDSFAYRARVEVEDWKRRDSPLIRLRKWMEAKGCWDETKEKEARDRFRKEVMKGITQGESEKKPAMRTMFEDMYEELTPELRAQMKELREVIERYPEEYDLSEFEGGMETLKE

SEQ ID NO: 3364 - protein, 376 aa, Unknown
  Kingdom: Fungi, Phylum: Ascomycota
MAPAGGAVSVRHASSATAPGLDDVNPETEESCPVCKSSRYFNKDLEFLINPECYHRMCKNCVNRIFKEGPNQCPYAGCHKTLRLRGFKNAFFSDLRVEREVDIRRRVANVFNKVEEDFETLEDYNDYLYKVECLTDDLVNGKDDAKKKAETELIDWEAQHKAEIDRNKRLARESDDARQKRIAFERDAARHRRMEELEAEAEEKANAARFREEMLDSLQSAEDGQAAQAVNKVMLKRRGQQKRDSAMETMAGASGLSIRGLRDRKAEAAAEAEEDGPYDPYGGLDMRPRRVDLAPEKLADYGQGNEWIDNARHKDEFKVGGYSPDEFISRALYEAFAGLGVFIGEEKMEKGVGTMGAMEAAQTGVTAGSMDVDDPF

SEQ ID NO: 3365 - protein, 85 aa, Unknown
  Kingdom: Fungi, Phylum: Ascomycota
MWLVERQTIREILDSGLFFRHNTAIMSHESVWNSRPRNYGKGSRSCRVCKHTAGLIRKYDLNLCRQCFREKAKDIGFNKFATQYR

SEQ ID NO: 3366 - protein, 461 aa, Unknown
  Kingdom: Fungi, Phylum: Ascomycota
MVATGLYLSSDYLSRVVLPKLHIPLAESSHELPTPDISSHELLAAAPSPDVADAPEPAPEPTPVLQPKPTSEVQAPIEPAPKINVKNGTILEASRIQYVIDAILDPESPTSKRMPCPPINETRYAPLKDLVIRDSGGTQIQFFFALNLRKNLNLLSRLLGSVVEVIRFLGPERCALSIVEGNSPDGTGEVLEALTPFLDQLDIQYFYSSSDINPSKGNRIEKLAKLRNMALQPLVDSFENGASEDITVLFLNDVAACSEDILELALQRQRLGADMTCAMDWTTVGEFPTFYDVWISRDIKGNSFFEIPENGSWENAWNLFWDDPYSKQRLNMHQPFQVFACWNGAVVFRAAPLKEGIRFRDSSKGHCKHGEPQNFCKDLWAAGHGKIAVVPTVNLEYSNAGGLTLKKYKGYVTDLVRSENEEQNMIDWSGPPEQVRCIENWGNQFWKPWQVSRRALLGPGT

SEQ ID NO: 3367 - protein, 513 aa, Unknown
  Kingdom: Fungi, Phylum: Ascomycota
MSDTYDVIIAGAGPVGLFLASELGLRNLSVLVLEKDTECDLSWKAPPLGRRGLNTLAMEAIYRRGLKDKISDPHKHEKLPGQPQGFVFGGHFAGIGLNALQLDLGRRKWRLPGPALYPAVTYMKRLEDALGDRATELGVTIRKGEEISHIEQTDSHVDVSTKQGPTFRAKWLVGCDGGRSTTRKAAGISFDGTEPRITGYAAKCTFDHPEKLKPGFHPGNNGLYAIVPESLYLMDPDGAKFDRTKEATKEHLQEVFERVSGIQDVKITKLDYVGTFTDACRQANVYRKGRVLLAGDAAHIHSPMGAQGLNTGIGDAMNLGWKLAATVKQENASESTLQSFALLDTYESERQPEGASTLEWTRAQVLALEPGIFGEAMRKLLQQLFASKDGANIMMDRVWGLGQKYNLESDETEQHDLIGRSLPDYELEDGSRIGDYMRSGKGLLLTFRGQQELEELLKGHELETERMTVQVKDTLGLSAILVRPDGVVAWLAEEGAEADVAALKKALDRWFSF

SEQ ID NO: 3368 - protein, 377 aa, Unknown
  Kingdom: Fungi, Phylum: Ascomycota
MADDMDLPAIDLDVFLNNPVSSPEVQAECLKAANALITYGALVLHDSRTSESANDAFLDLLEDYFAQPEADLRRDERPELSYQVGVTLENTEKPKCAVDEPCLDVIKRLAPEQRPLDISQHQPDPKCRFFWSLAQKPTYETEFPGLNAANVTPEAEHLKERWPETMAARGESMRESVAGLAQMVAIGLGLSADTFTNAAKYGPHLLAPTASDLVKYGKKDTILAGFHTDLNFLTIHGRSRYPGLNIWARNTGNRIAVKIPPGNYLLVQAGKQIEHLTGGLIKAGFHEVTVNEKTVETIERRKVQFPDRPLIRISSTCFWHLSSDFDLSPVPELAERAKQVRAEQFNLGRDEGEEVQYQPMKVGHQVQGELKHIALML

SEQ ID NO: 3369 - protein, 403 aa, Unknown
  Kingdom: Fungi, Phylum: Ascomycota
MITTTQVRTRRVSTTLKGSKEATPIPDIKTLRDAIPEKCFERSMLHSFTYVIRDAIIIGSLFYAAALLSQMDAPLSVKIPLWTVYGFVQGLFFTGVWILAHECGHDSFSSNLTVNAITGWFLHCALLVPFFSWKFTHARHHRFHNHMERDTVFVPSRKHEHEAKVKTKTGVIAKLIDHTAADTPIVTFGSLLFHQLIGWPAYILVNAGAGVKSLVRSDRTESPASKQLHLNPYADVFTSGEAPLVAVSNVGIAIVFAVLFYVAQFLGGWNTALLYGLPYLWMNHWIVAITYLHHTHPEAKHYEADEWTFIKGAASTIDRDFGFIGRHIFHGIIEYHVVHHMFPRIPFYHAEEATWAIAPILGERYIQQKTNFFGDLWTAFTECKFVEKSEHGSGLVWGKPKKA

SEQ ID NO: 3370 - protein, 1301 aa, Unknown
  Kingdom: Fungi, Phylum: Ascomycota
MPPSPAYERPLSPAQDSDSDLDLDLQELDPVSAQPARGAAPTPSDAEHKSPRIALRNLRMGRPRRANKRSRVYGELGRDRDDGDDEALLGGDGSRSQWSDGHGEDDQPLLGDSGPPRRRERLASFSSKVRLPSFMSGGKSQEEDDVDEQEEDDPSASRVVAVGASQSTRYPSNMISNAKYTALTFLPITLYNEFSFFFNMYFLLVALSQAIPALRIGYLLTYIAPLAFVLCITMGKEAWDDIERRRRDTEANSEEYRVLVFSDPETSFSAARPRRPLRSESYKKKSKRSGRSRHDLSDIREEVEGEPSDQAQPSSQVREASRKSKDLKVGDVLKLSKGQRVPADVAILQCYTNEGPSQVAAKEPAEEESLLAFGDGEASEVSKGKQPATELDQNETDNDNTGETFIRTDQLDGETDWKLRLASPLTQMLPVEEFVRLRVTGGKPDKKVNEFFGTVELLSSRQDAMSQQASLPSSDDESDQKTAALSIDNTAWANTIIASQATTLAVILYTGPQTRSALSTAPSRSKVGLLEYEINSLTKILCALTLALSIVLVALQGFESSDGKEWYVKIMRFLVLFSTIVPISLRVNLDMGKSAFSWFIHRDPGIPGAVVRTSTIPEDLGRIEYLLSDKTGTLTQNEMEMKKIHVGTVSYANEAMDEVTTYVRQGFHVQLTTDPATHNMLVTPSSTFSAPANAGATRTRREIGSRVRDVVLALALCHNVTPTVDVEDGQEVRSYQASSPDEIAIVKWTESVGLRLTHRDRRSMVLESAETGRPVVRVRILDVFPFTSEGKRMGIIVHFHTNFKNQNPDLASGEIWFYQKGADTVMANIVAANDWLDEETANMAREGLRTLVVGRKKLSYQQYQEFGSKYQEASLALAGRDAGMANVVSHYLENDLELLGVTGVEDKLQRDVKPSLELLRNAGIKIWMLTGDKVETARCVAVSSKLVARGQYIYTIAKLKRKDNAQDHLDFLRSKTDACLLIDGESLTLFLTHFRLEFISIAVKLPTVVACRCSPNQKAEVAKLIKEYTKKRVCCIGDGGNDVSMIQAADVGVGIVGKEGRQASLAADFSIEQFYHLVKLLVWHGRNSYKRSAKLAQFVIHRGLIVAVCQTMYSIALKFEPEGLYKDWLLVGYATIYTAAPVLSLVLDKDVDENVATLYPELYKELTLGRSLSYRTFFVWVFVSIYQGGMIQGLSQILVDVDGPKMIAVSYTALVLNELLMVAIEITTWHPLMILSIAGTFVAYIGSIPFLGGYFDLAYVITWGFVWRVVAIAAIALVPPYIGKIIRRTMKPPSYRKVQNT

SEQ ID NO: 3371 - protein, 1636 aa, Unknown
  Kingdom: Fungi, Phylum: Ascomycota
MARETRKKRAGIVGAGVSGLRCATVLLEHGWDVTIIEARDRLGGRVAQSSAMGSLDVDVGANWVHSRGENPVVDLAQETGTPLHEWAETTIVVDNKGNLLDTEVANLALSRVWDILERAIQRSSEESNIIDPGVSLYDEFANITQKDVESGEISDYERHLVLEMAQMWGAYVGDGADKQSMKFFFLEDCIGGDDCFIPTNYKKILDRIAALPRAQAHIKLNTIMTSVTGGSAGVRLAISDGSHEDFDDVVITTPLGYLKRHKDSITPLDLRLSSAIDQISYGHLEKVLIEFPHAFWDATEEEEGRRGTSFMHWLSPSYASDTNPSKWRLETVNFNAFDEPYRRNILLFYTYGDCSLHITSSICGMEKKARDAWLRQFFEPYYSRLPNYDPSTCAPLRYLATEWANDEFAGFGSYCNFQVGMDDAARDVETIRYGMPDHHIYFAGEHTAPFDGLGTVAGAYQSVLSTRSESPASLDGAGNLSHSRAELSIPIAARVAQLDALREASTAISGVLTNQANEYWTRMQWRSASPSWIQMHEEGVTKGPRQCIIVTVTFNGSSWRPESIDAIQNINGDYACNTTMDPVTAISLVSAILALADIGSKIAKRLEELSTAGDVPKVFRDLRTRLPLVLQIVERTREGAEGLTPEARASVNAVVRNCYENVERLDEILQRVTVDENDSRWNRGAKAVISLIQEARVDRISDALKDNVQLLTSLNVSPTEPRKGSLALERRTSIASQPPSYESGEVQFHVPFERDEGFIGRQTELDAIRDGFKGQNRMAISGIGGVGKSQVAIEFCYRHKELEPSTHIFWVWGGNVARFKQGYKRIAQAVALPGWNDPDVDILELVGDWLSHPVAPYLLVLDNADNMKDWWPSKYASMAPNDTEPALNLSNSLPDCGDNGRMLVTTRDARIATRLAMQGKPVPIQSMSPADAKRLFLSKSGDREEKYDPGKVEMLVHELDYLPLAISQAAAYLEENEYYTIDEYLEALQTDDAEEFLQEELHDTRRDQDSFNSIFKTWKLSFDQIRVQKPVAADLLSMMSMFDRQSIPKALIGHSDEFKTGLTTALGTLNSFHLIIVRANKVSFQLHRLVHRFVQSHIRRTKTEDRWRAAALKCLTKVYPVEIGAAQFDWCESLSPHVLALVEHTYTTDDANLDLATLLCWSADFAVEKNELKLATSRVKKSLDILTRLVPETDHRRASSTWLYGRLLYYQAWSHDEITAAACMLEDALRTSEYKTLSYAESAFELAHLYFDQGQKERCLELGLASYACWRDTEGPDSQRALDNLHDLALELALFGDEESGIAKWKEILKHCSTSHDSSMATRKVFELRSLASIAEFSDDPGMAEVLYVELISLCGSIYNEHHVHVYDYQLCHAEQVLRQGRLEEAAEAANTILDRCQHKVEWLIRAGTRQIMSECCRQQGDLKGEETQLVACLQIYEESLSRLRAETITAIEALAHCLTRAGKVKKAEALWQEVYDWRSKHLGPEHMESVRALACLGVCYAAQSRNSEAEKAFSEALSRTDAGDHVILHNLCIVQSSQRHWDELEVTCRETLRRWSVVGGNKSDEYGDSLSMIREYLALALEQQGENDDEVAVQAADLAVKDLTDELGTRHTCIVPKLPLRRRFGRLIHPRTWSA

SEQ ID NO: 3372 - protein, 778 aa, Unknown
  Kingdom: Fungi, Phylum: Ascomycota
MPQSGDDDASPTSPIQALPTAASGAAVRVPKLRNITQPNLGGSVPSLPLSNSESSLPFRRANPAASLYASTLSPPGSRSMSPASRGSPSRIFSGGVVFEASSDKELTDAASDNPGDPLNLILRAFVPHVTICTSEDTDAMMSEKGFKGGLWELLRPFGERIQGRVSIRDSTGISRPFDDFSVRFTQLGSNVEHPDPAISTQNGSQGAAARDRKVLGDVESLVDRHLTFAEESYANGPHFGINTRQGLDIDAASPYHALYLRRLLSGFPIAPHETFAHPVCCIVAITSRNETPIEELRRLYEETNTGSRKLPPWVDSEYLRYYVLVHDEENDDITRSMGFFDQMKRNLGPHCHLLRLRSSQTIETDDDSIPLPRSDWMSADEELAEIKRSEDDADFEDSTRHIFESDATAIRTFIREMVTQSIIPTMERHVSVWNDQVASKRKGLAGTFSSFTKRFPFGSSRTSMGGGGGAKEAYDPAGFYHAQAPDAILRKLADYAFMLRDWKLANSTYELLRAGFATAKAWKYQAAADEMAAVSLLLVPQYSSSKSRYEAVEQMIESAVYSYSTRCMSPYGAVRSMLLPVELLRLRGGSNIDGAGRLGVKLLDSKFLGLVGDALLKERLAISYATKEGVGSWNWGNRIRKSGLWSYLAADAWLQQEKFVPSQRCLNQALETYESLPHGNGMTKFATSTGLLEQLQRTLSEKLDLPPDDQGAGAYGEGDDDLVDVESEALTDMRTRRVSLVAGAGGMLETKPLHGDGKMDDTTVGGVQMEFDETAREG

SEQ ID NO: 3373 - protein, 1190 aa, Unknown
  Kingdom: Fungi, Phylum: Ascomycota
MESAGENTEARSRRAEVRGPEADSLDQDLWQVWSSTAKAFPERDAVVSMWQRQKCIMGTNISQVDSATVEDKTKYLRWSYKDLHTEATRLGNWLRHLGCGPGMRLAAVLWNSVEWAAFAWSATKLGMVFIPLDPRSLDSLPSLLARIDVHVLIVQDEKIADSIDGLKIVSMSSVWRLQCSGPEASGWLCVGEFPSDDSGIRRALEAQVAPYIDREPDEQVAMMILSSGTTGEPKVCEHTHKNLMSQACEYDPKPEDPRDRWLVHTPASHIFAVNNVLRAWKEGGTVVFPAHSFKVEATWKALTQEKCTIMSATPTLIKSLLSYPGFSKTADLKLDLVTMGGTTISAEDMLLCRDGLGAKHVIQAYGLTEGAPLISWKRSDSLLHSGIRHGVGRILPGAAARICHPGSHDVLAIGEVGELHVSGTSVASGYNGEDNPSAFYKDQDIRWFNTGDQAMIDADGILHLLGRYKDVIIRGGENIQPAKIGRVLAEIPGLQAVVVGVPDAQAGQVPVAIVELPLGVDKATVASKPLALGPIFALAAIYTLEELGLKAFPLTSLGKIRKGQLTDVVVKHREDMFDSTTHKGTDDPYESLSKFLTEAWERVTAITPQRDQDILGKHVYLKDLVKHNTVNKLARFLVDRDHDFGGQSESTPEVAASSFVPGPSNQPLTPMLWPPSRTYVSTSPHRVSSFVHEAPAESLATAATSALLSLGLPNLEAIVPIRSALRRFVTGQRPHSFHIAFTFRAPGTTNSQVRRVISRLVRQHPLLRSILLKRADREFHVVPCFDETIAKKAISELEVETVEEAIQNARQLSGSVWLSPFMLRVKVVSCKADKLIYISLVFNHSILDTLAIVPWVRNLDLLLKDEQVQMPIMTPYKLFADLHEQYSGVPKAKAAVVFHAKRLRGISLLARALWPKQRAPGWMISDDYGSLDQQKREAIRQEVWDGRFNSVKGGSEEPRISRIVHLPMLEQLVKDFGMIPAIFAKAAITLLNIIQTGSSHAIFTSWESCRSWPFLPEWIETRLPSAMSIDGPTLGWFLNMTEVTASESLKGFLERIREEHEQITQHVHAPWSEVSRELQEEGHIATEASFRQGFVWDVSLLGATGPEGYLTDFNVLEPVNRHNWSDCGLFWNAFMADSKSLYFIATWDTAQMNDNEVNGYCDMLAEIMRRLANEDNWSKQIGVVFRADSF

SEQ ID NO: 3374 - protein, 560 aa, Unknown
  Kingdom: Fungi, Phylum: Ascomycota
MLKSTHKPAASAGPAPLPSGWSEHTAPTGHKYYYNEFTKESTYRRPELLPPPPAQPQGPSLADPKVANAYLAQFRQPNEQSSHNRRGGNDGRPRPQPNDKPRRKEPIPGCEPWILVYTKYSRRFVYNPEKNTSYWRIPEKLMPGILELDKARIRGKADEESSAESKAAQANGAAKGKPASAKDTESKIEPEPAKDYGSSEYEEVEVTDDEDTGDDPDGPSNKRQKTEDETQDGPLEFTEDDIALQLQAMNEEYGMDPDDLEGADGDDWAEGEDDGGFSEEDAKFLFKDLLDDHKINPYSPWDKLMEDGVIIDDSRYLALSTTKARKECWDEWTRERIADLKEQRARQEKKDPKIAYLALLQDKATPKLYWPEFKRKYKKEAAMKDLHITDKDREKAYREHINRLKLPQSTLKTDLTALLKAQPIHLLNNQSSANNLPPQILADLRYISLDPKTRDSQIAAYIQTLPPPPEDVNAAVEDEEARKAGDARRRREKALEDRNRHIDEQRRQRERELAISKARMRDSEREIENATRVGKRGLQGQLADMRMQDAADEPVDGKDQ

SEQ ID NO: 3375 - protein, 287 aa, Unknown
  Kingdom: Fungi, Phylum: Ascomycota
MGSTIPERAGRLAGKNAVITGAAGGIGLETSILFAKEGANVLMSDISDPALEKALAKVQQLVPSARVQVKKADVSKEADVKALVDELDSWGGLDVMFNNAGIMHAKDDDAVNTPEDIWDLTHNINVKGVWFGCKHAVLSLRRHNKTKGSIINTASVVALVGAATPQLAYTASKGAVLAMTRELAMVHARDGYRFNSLCPAPLNTPLLQDWLGDDKEKRQRREVHFPTGRFGEAIEQAQAVLFLASDEASFVNGHDMTVDGGMTKAYVTPEGPAAPAPTNNALKDSLA

SEQ ID NO: 3376 - protein, 403 aa, Unknown
  Kingdom: Fungi, Phylum: Ascomycota
MFRRSTFLPHKPTLTEANLPDQTGKVFIITGGNSGLGKELAKILYQHNARIYIATRSRDRSDEAIKEIKAAHPRSKGDLIFLKLVLDDLSTIKATAEEFMAKESRLDVIWNNAGVMTPPQGSKTKQGHELQMGVNTLAHFLLVKFLTPILTQTALSAPKNSVRVIWVSSMSVDFAAKPVIDFSNMNYARDEAADSKYNRSKVGNLLHAIEFDNRYPGTGICSVSMTPGLLKTNLQRNFTAGQNLVVKLMGKPAIMGAYTELYAGLSPYITSESKWVCPFGAAEEPRADAMDPKVASKFWDWSEQQVKPYVRTATANAAVVPGAGGSSRGLDFGGQGGSITGNVPVAPVQSVQAQAGGRGLFGSAGQWRAGGGGSNYVDDSVEDDTVGLENTRAPGRVVVVSAK

SEQ ID NO: 3377 - protein, 266 aa, Unknown
  Kingdom: Fungi, Phylum: Ascomycota
MTSVDLSTRDINVLEKIKDPEFDPGRGVAIDTSLPRDPHIIDTSVYERVVAKEKSIIQSIQKIEIELSRSRQAAISSAAAVEGYRQCLSEFNGFIDEYPDYASARNNRAQIARRLYGDAMLLVDTTTMPSPLIGNPEQSEKLAAASDALNDMDTSISLLSPPTPFTPVSQQAARTLSMAHTQRAAIYMRTAKLMSYRELDIAKGRRESSWSKLDFEEAASSDLALGGRYGNEIAKGLAVSSNPTAKLCGEMVREAMKKEYGPAYAE

SEQ ID NO: 3378 - protein, 529 aa, Unknown
  Kingdom: Fungi, Phylum: Ascomycota
MGTTDAGASARGASKSPKKSTKSPPRKDTADAKTDSTKAEASTNADVAAKPLAPPPRPGQAQGNDTPDYFSNQPGGSLSLEPNPFEQSFGGGPGPETPGGTKLPSVAALTSPSSLLPPGNATPFNWGGGSLRTGPLSPAMLSGPTSDYFSDTHHLRGGFPTPNESGLRSGLTPGGSGSMFPAPSPNSQALFNQLASGGATPSTLDFHRTAMSAAAKREQTQANNNTSQPAQQVQQPQQPPTTQPQEMTNGAPAVKSEPKSFDPHDNDAANGLFMLAQGAQQRNGAQNGNQFTSTGPPVQPHAASVNPHVSPQMSSVNGGSVGSMRGVSEGSGMSEESEPKPNTRGKGKRTNSAVNGRKKTDDGPVKPPAKKAKSNNGASMNGGGSMNGLYDEPPSEPEDDMDENGPKGKMTDEEKRKNFLERNRVAALKCRQRKKQWLANLQTKVEMFSSENDALTAQITQLREEVVSLKTLLLAHKDCPVTQQQGLHGAFMSQVAEPYSNAQMNPYGMAVPMGGQPVMAGQGHQRRFS

SEQ ID NO: 3379 - protein, 358 aa, Unknown
  Kingdom: Fungi, Phylum: Ascomycota
MEADMSFLGQSLDYPLDSSYSDFAGQAGLMDPRSHLSFDTALAGKPSPGTPSQFLLTPSSLWDKNAFDDTAMDIFADFSETTEPVSEQPSETAPAECSKHISSGIVQTPVIKQESPTPPAQPQVTRRLTRATSSSSQATRKSIIQDKALASTETSKVKKPRAPAKRTTKRTKGQAKEKQVSEEAKSEVPEEQDDNMLSMDQPAGEENGRRNKFLERNRVAASKCRQKKKEWMHGLEETKNELEKTHNTLHETLNGLLAEIAVMKEHLMNHAQCGDPTIDQWFSNEARKFVESKTREDAARRPSSSSGSGETQQSSRSSVVQFSPTSSVAPPTVASPKVKEETFSYDYMPDDMFAETTS

SEQ ID NO: 3380 - protein, 627 aa, Unknown
  Kingdom: Fungi, Phylum: Ascomycota
MARNRFANPRLSDSIDLYELLLLFSNPVWSGGSTVPTTIVRNISSLSSQIAYEERLKSNITTLTTTNADTLDGVIQGLLYVPEIRSHPACNSQQYDFIPQNVTHRTDLPPANYNLIAFAPWFSIECTKAYLTSARRDPIRAFIFYKPNNSSNKPQDADSPVWNLDDNGLWKRMNPFPIFAVSGQEGQKISTKLSHYSGNLTEIPHGEEIQKLYRPHPKDYVRIWTELTMERQSSGPDLWAYFLIVIGALLLIFGSVSLTMHLVQRRRRSSLKKRVESGEVDLEAMGIKRVVVPADHVKSFPLFTYQAEPDVTSAPPTPMGPGGGPHGSRSVRPSRRQRRAEQAAISDAASQVGGISVRSLRSKRSSVAGSVDTTATNDQPKCQICLDRFEHRISIIREMACGHIFHPECIDEYLIKNSSLCPCCMQNMLPAGYSPRITNAMVRRERNLRRLRQRVNVDEVSLESGYTKMDKLKRLFRSSSADDTPTDGHDVPLTPVQKPRTPDVPVETTRTPIPEESALSTDNSQPASTPPNDEVGSTSAPRRPPVPKPPKSSKPRTRKSRPRALSLMPTQPEDSELKATQAVGRKSPSSFARQRMREIAHRNAPFDDPDRQPTWRVVVNKVFPGLT

SEQ ID NO: 3381 - protein, 538 aa, Unknown
  Kingdom: Fungi, Phylum: Ascomycota
MKPSAPSLRIVATPFAISATITCRGALRQTRTTCWRGFATTAFVRREAPPKGSSKLYEDADAAVADIQSGSTILSSGFGLCGVADTLIGALRNRGPESLHSLTAVSNNAGQEEKGGLALLTSSGQVSRLVLSYLGNNKVLEKKYLSGDIAIELCPQGTLAERIRAAGAGIPAFFTPTAAHTYVQDGKIPMRLDSSGAVVEAGRQRETREFNGRTFLMETALPGDVAILRAWKVDTAGNCVFRYTTKAFGGIMAKAAKLTIVEAENIVPVGEIDPNDVHLPGIFVDRIVPSTAEKRIEILKIRDSDSSKTGAAKVSEAEQKRLRIAGRAAKELKDGFYVNLGVGIPTLAASLLSDDKHVWIQSENGILGMGRYPTADEVDADIVNAGKETVTLIPGASCFDSTESFGMIRGGHVDVSILGALQVGANGDLANYMIPGKVFKGMGGAMDLVANPDNTKIVVATEHVAKDGSSKILNQCSLPLTGAKVVSTIITDLCVFQVDRAQGKLTLTELAPGVTVEEVKSKTDADFEVALDESMSYE

SEQ ID NO: 3382 - protein, 410 aa, Unknown
  Kingdom: Fungi, Phylum: Ascomycota
MVQTCDSRNIRHILAIRFSDFVLPELRNRAIASFLGFGIFTLNGHAWSLARSVLRPGFAKQKVDGMLDVLEVHLEAFWGQLPVLSETVDLQPLFFELAMDVATEFLLGHSTSELQASKLRSRNHQFVSDYLLCSEAVVKKLRLGPLQFLVGSIEASKAKGRVFEYMDNFIEEAKQCKIEEEAGPGYDVLRELQKMAPDHKTLRAQVLHILLASRDTVACLLSNLVFALSKQPAVYSRLRREVLDRAGSDRPNIEQLHSMKYLKWCVNESLRLHPVIPTNAREAVVDTTLPFGGGHDGNSPLFIKKGTLVMYNAYAMHRNPDVFGEDADKYIPERWEALRPGWDFLPFNGGPRVCIGQQFALTETYYIVARIVQRYAKIESRDERDWQEREALATTCKHGVAVGLVRPSDI

SEQ ID NO: 3383 - protein, 186 aa, Unknown
  Kingdom: Fungi, Phylum: Ascomycota
MAGAFFSRLLAPATRSTFTTPAFRPSTTTLPIRSSPILQSLTSTPTRAFSTTPTLSTTLNQVLRGQRKGKRARHAVSPALSGKNCPQLKGVCLRVGVVRPKKPNSGERKTARVKLSSGAVITAYIPGEGHNIQQHSVVLVRGGRAQDCPGVRYRLVRGALDLGGVANRTTSRSKFGTKKPKAAQVG

SEQ ID NO: 3384 - protein, 90 aa, Unknown
  Kingdom: Fungi, Phylum: Ascomycota
MASTIRQLIPLFIALIILSGAAWVGWHIYLSVAKIRDSASERMGKKNVVFTKDGMRVGVKQIQNEKYIDATQSWVVKAWNMGEIREDEDL

SEQ ID NO: 3385 - protein, 674 aa, Unknown
  Kingdom: Fungi, Phylum: Ascomycota
MPLKKEFRGPSNFCEWVVGTTIPTILGPEKRSRKQKPTKRGVIRVEVTTDDESAEDTLKISYPRDRGSRKKATTRSSKSKPKKVRFEQVPKKSALRKAAKTYVVSEASEDEDKTSDSSADASSDSSHSRVILIPENELKVHTVKVTDDSKTDDSSENESAASSEPSPTCKCIKCIRGRQKLAKRRRRALVLKAVSSESDYDSQPETDDSDEAKKNSKKKNNNDEKKNQGKEKVKVNVKDKEQSKKDKKKKTPEPATVETDDSESEAKEDADDESSDSEDSGKKQKQKGKQQGSKAGKGEQMEKKQADKDDKQKGSSSKKKEKDNADSKKEQKDKKAKDSDKSKLYPEAMPGPNLRRPNLIAPIRAQVVQVEDVVESQEDPPPNSYYDKANNVLRSYHGPVYGGFQNGGLYPKRDPKHTALPTGTPHPLRNPYFYGFNNAPPQLSRPGQENGPGAQWPPGAWPGMPWPYAPPYGQMPPAADAPPPAKGSKGAFSDRAGRNNVAPDGVETNPYYKKQQTSPFRSYAKNSPSHVKQGSKTGSRHGSASGWNNDGAAGSVKHTSPRGDWDQNAGNQTQDAGTWDGTPTQQSTGDWNTGATAQATWDTGQPAQTTEQSWGNTNDQNQQDDAGPAFATQESNVMPGTFDANPNPTWGDPSMAADTHGAVDQETPLPTAVW

SEQ ID NO: 3386 - protein, 195 aa, Unknown
  Kingdom: Fungi, Phylum: Ascomycota
MSRKALFCIDIQYALALDPDTRVPHAERLQAAGAKILAAARAIIDQHASRGKPSPILIFVVQHEEAEGGELVRGTKAWELVFEPRDVADEVLVAKTHGNTFESNPNLIGELRAKGVSEIVAFGIQSDFCVTKTTLGALEAGFPVTVLSGAHTTYDEGGRTAAEIEEDVNRNLAAKGAKVVPWEDVIATWEKNFTI

SEQ ID NO: 3387 - protein, 557 aa, Unknown
  Kingdom: Fungi, Phylum: Ascomycota
MSIFLQRRARPSNLVLLACATVIGLIIGIIYTQPYDYVIGNAFTQEQEKTHSPKLSAKPKPTPAPAVSLLDTKYDVAAGDRRLVVVIPVNNPSPALCKAMLSAVAMGYPMPIVINWGITPEEAFPGRENVGSHQLKISGLLTFLDEMTHESTPKEDRLTDDDIIVMVDAFDIWFQTPPDVLIRRYHESNRRMNERLLKQWNGKPEDIPFKQSIVISATKRCWPDDGPSGLYCDDLPDSDLPEDIYGPLTDKDSGDFWATLHNTRPKYINTGNVMGPVGDLRRYVRRVNEKLERTVALNDKFKFKSDQAFFGNILGEQEIYRKWVLSQDEKAIADNLPFMLSRDLEYHVGLDYSQNLCLPTTNEEDDGEFVALGDKAHIKQKSEELGVTPVRLTGVPEDIAVSPNPLAILDSLSTTPGWDTLPLYADYFTISVPAMLHHNTNRGEGKARIVSWWDRPWFFPYLRDLVLARTKADVEWKSLGTFNAKDGDVTYWPPESDKTKKQPRIFKAGETAKGLPVGEWEDMCLDPKKPKKHWSEEVFRDGKGGLKGEGAKRRRRS

SEQ ID NO: 3388 - protein, 789 aa, Unknown
  Kingdom: Fungi, Phylum: Ascomycota
MAPGEAHDAATPVAEQPTSNDSYKYQWARYVARQKLKRDTEAAEKRMEDLFQGEKFTVGTMPQTVTELAQIADIATGGGLIPEKHGEFKVGIVGAGVAGLFTALALDWINDTIEKNVGPGQLNITYDILEAASEDRFGGRLYTHHFSDGVHDYYDVGAMRFPQNNIMDRTFRLFNMLNIKKGQLGDRTKVSDPPVLIPYYLKDDNNVCPAYFNDVKKVGNAWDGTIDPFDLNKGVPEPDRIPDDRTKEDPSESFNNAIKGFILHVKKTMDSFSGKKDPEPRDEKEIWELLQFSDRMSVRQFLLSGKNPGEIPDGPNYSYNTVQWLETATYGTGWYDQSLTEAVLEALDFTVPKDLPMNDYWFCIDGGAQKIAETMRAEMKDPSLIRYNTKVVGMDATIQLNKRVTKAMQLSLKDSTSGKPLESRSYFTVVSSTTMAAMNRMDLSRAGLLWDTKQAIRCLGYGASCKVGIKFRTAWWRKEPYNITKGGLARTDLPLQVCVYPSYNINDEIDPVDKPAVLLVSYTWGQTAQRLATLIASKAPGKSPEDIMKEETELRDVLLRDLAFLHAEDPKDQESFQKTLDEITEHYSEHHAYDWYHDPHMAGAFAYFGPCQFSELYPAITKPNAFGQLYFVGEAASAHHAWVVGALESVIRGLWLMFNNLHQGSKNDPKLSNNGEGYRPYLWAMQLLQSGAVKDGDVVIDPSPEPLPFYPLPAEMPEGREKDVAHPNGPAPAHPAQELLDHPQLDGPGKEAEISYGAAMVALSMVESVLDEWGKPNVKVEIPVAMRSV

SEQ ID NO: 3389 - protein, 228 aa, Unknown
  Kingdom: Fungi, Phylum: Ascomycota
MDTMDEVNTSGGKVVRDYCVSDGVLRHEDVSRLRPSFLAEPLYLLRERYDNDGYIYMKGLLQQPTTEALLSNPPNCGPSSCDCMNCPSKAQTCDAQELNVAELTNFVAALMSKNKAGSPAPQEDSKSAKKTTSPARAWLCLSYFHPQGGGPIFLSRPSKGPGPQRDSPTDATQRKPLQLARELERRWLVATYEAGDVVLYQPDIIAAPTNNCDPKRRPSRGMEVVFPT

SEQ ID NO: 3390 - protein, 714 aa, Unknown
  Kingdom: Fungi, Phylum: Ascomycota
MDQHGAAGQRGRSPSQGQQHANNINHAHTPSQAGSFTTQDSSVGLGLGLDPNSQQNLNAFGANAYLSPQQQQQQQQAYSQNNVSDPAVFDPNASFGQTTAGIVDPTLSFDGSQSHTAFLSQELNDTDFSLFPAGGQGDSFDTPLFDRGATLNPNDMNNMASQQHHSPTPPHLLQPDAPQPGSAHQSPSFNQHQFSSPPGTHSRNVSLGPEAALLPNQMGDWNQPQFQTHRRTPSEYSDVSSVGHSPHIVSSDTFDDQTGHSPLQRPSDGSIYQDVLQIGQFSLSDAQGSPALHGRSPSHSPAISPRILPQQMPDMSQQQAFGLAPHNTGFPNAPYGSLSMANESYSNQSLGGTPDMSQMAAPAINVTYAEPNNAKTNPFNQIKGELDQDSLTPPDRGRPRSRPRAVTDPFAPGSGLVSRSNNSSLSPMGASLSPRSDTSRSLSPSSGISPSRRRQSTSAVPNNVIALRLADPEYQNSQDAGSTKRVQKHPATFQCTLCPKRFTRAYNLRSHLRTHTDERPFVCTVCGKAFARQHDRKRHESLHSGEKKFVCKGDLKTGGQWGCGRRFARADALGRHFRSEAGRVCIKPLLDEELMERQRQWQEQRMQQNMQSLSPQPGMGMDANSGYPMDAGGNQWLPAALLAQYPALAQVNWSAPEMTSGMEDDLSGRSSFDASDFDDGDDGGYVSRPGTGYGEGGLGQNFGDIGYASDFGGR

SEQ ID NO: 3391 - protein, 300 aa, Unknown
  Kingdom: Fungi, Phylum: Ascomycota
MGWLPSFLGGEKSSSNIDPELRDFLNKEAPTKYTPAEAPAPTQPAQTRPNPSIPQSNADGTDRPQVPRESLYQDGRYAHLWKTYQPKAQIEAENTTEHDKMTDLLENFKERKIELQAIALENCADQQEEWTNCMKHGKIEDQLQMCRHQVRRFERCYTMQTRFLRALGYGSAVGRPASVDEDIQMHADALYRRLLAHEAEAEKAKEEGRPIPVFDPAVPGMSKPKVEPPQDQQLRWQEALNKLPEDERAAERAALVADWQAKSQLAASVKGMKEEEKREREAKGQPSFLDFVGSVFSGGK

SEQ ID NO: 3392 - protein, 344 aa, Unknown
  Kingdom: Fungi, Phylum: Ascomycota
MTKTTTTSIMTSTMRLLALTTLLTTATASKRGLALISSTPDSDIEFLTSNDSAISWYYTWSPYAHPAVSSSVEFLPLLHGVDAASDDNLISILDRTPETSKHLLTFNEPDHGKDDGGSDISPKDAAKAYIEHIVPLRTSKDGERTWNISHPSVTGSEKGLEWLRDFNSSCYDIDPKNGCPTDFIAVHYYGAFPGLAGWLGALREFYNDTYSSSDDIPPIYITEMAFAGEDDEANVAMLNESMQYLDEQDWVDGYAWFGAFRKDDANGWTGDGVSMLEDDGGLTELGSEYLGGEDNGFEEGAKGDGDDDDDDGAFTVKPDLRLMMALLCVVMAMSTFMGELNLTF

SEQ ID NO: 3393 - protein, 584 aa, Unknown
  Kingdom: Fungi, Phylum: Ascomycota
MSSHGRKVRVKKLSVKTALPVLRENEIDASEYEALTTENQIATGVEQAEENEIHLQSILKDAGTSNDQEIPVPPPQKSDVNYDDLYPSNYTKPSSYLRFSQTVEECISCQYDMTIEDNDFLQQYNSKPPAAGTLSEDDFERVMEVFEDTAAEQTPFASVDNTVVGYDMMVPSLHQLGSASILQHAKPVYEYWKSRRQEMSNKPLHPTLKFETHQESDDTDPYVCFRRREARQTRKTRGRDNKVTETLKRLRRELEDGRQLVLLAYEREMMKRELLHMDRAVFEERARLKHIKTRLGIKDADDDLINQKPQKRKAAEAPAVQRPSGQHMRMPVRPDGRTMDQDLILLSDKLAEKENELNADIEMKVQNHRKWNLNHIDLTRDPLSPVQEKGEELKFRAAKTQYLMTPPASSASDDMDVDDDAPEPMQLDKEPAQVGVKEKVSLPIVQFKAGGSGEFHGSQQPSFRRRIGRQGRLWIDRRGLASPPREDRRSDRWRYDSDSDDDEPPVYEIDPFDTRALKFRATIPLNPFIFGNRRPQAPDLGLQQRPVPVPVPQLPASAQQHGPQVPQPQVQAQPQPQPQPQAAS

SEQ ID NO: 3394 - protein, 502 aa, Unknown
  Kingdom: Fungi, Phylum: Ascomycota
MASSTRSDERRKVPPTEQTPLLNAGNLAPDADTEASSLLPHPIPTQTEDPPASLPKLQIALVCYARVAEPIAFFSIFPFIAQMVQRNGHLPSSDVGFYSGLIESLFSAVQMLVLIGWGRLADRIGRKPVLMTSLVGMTIAPVLFGLSRSIWEMILFRCLAGIFSGSGLVIRTMIAEMSTKDNQAVAYGWFAFAGNFGIFFGPLVGGVLADPAEQYPKVFGHIAFFKHYPYALAGAIPGLIAASATVLCAFFLVETLGKNDKPPPYAANSDSVEQDPSQMSMWQILRSPKVGTVLLAYGHSMLLAFAFTALVPVVLYTPISLGGLSFSPTGISLFMAVNGASQALWLILVFPRLHKRFGTKGVMWGCAVTWPWFFASYIGLSTLLREGSHTSVVWFWILASLVATIGPGVSMAFTATQLALNDAAPSTHVLGTLNAMAMTMSSGIRSIVPAVITVIYAVGVRGQILGGHLAWVILTPIAAALIFVVKALPRDIPPSQRRNGSA

SEQ ID NO: 3395 - protein, 321 aa, Unknown
  Kingdom: Fungi, Phylum: Ascomycota
MSANYWESTQRQHWLFTKDQLASMRQKLDDDYAEWVRSYPLPEQRHLAIFFNQRKRLSVRQQALATAQVYLKRFYCRVQIRSSNPYLVLTTALYLACKMEESPQHIRLVVTEARQLWQDFIGLDTSKIGECEFYLISEMSSQLIVHQPYRTLTALRPELSMTEEDYQMAKSVINDHYMTDLPLLHPPHIIAMVGILLALVLRPAAPQPGGQNSSAAASAASGLAAAQAALQSAHLNSGGGLGGPGTMSGSSDGKDRPQPETRVHRVQMFVSWLSDSNIDVTAMVDATQEIISYYACYETEYNDKNTKDQIHRFVKARHLDK

SEQ ID NO: 3396 - protein, 366 aa, Unknown
  Kingdom: Fungi, Phylum: Ascomycota
MLYLNTLTALTGFVASAAAGVVPRQFAQTDANGFPKPSEQQTLAIAEEAGGKLPGGSLPSGLSATSITTLQLIAFNELFEVAYFSNLLYNLTSSQTGYAPPNKDAIIQVIKAIRAQEQNHALGAIAILETNNAFAPSSCQYAVPVANFIDSINLAETFTAVVLGALQGAQLNFAKDSAAVPLVPLVGSIIGQEGEQNGAYRQYLQRIPSESPFLTAVPAAFAWSALQLFVVPDSCPYDLSQIGLPIFPPLAINGGPVALIEPGDQTLSFSADLSNSEAAKNYVGGDGEGLYATFVTGQQLPASVAISNAKWSGSVISFEATFPYTDLVAHGFSHVALTTSCNFSSVDAVPDATLAAPGVIQVNNAV

SEQ ID NO: 3397 - protein, 773 aa, Unknown
  Kingdom: Fungi, Phylum: Ascomycota
MAPGFLKELRRRSRASFRTDHSTDTSSEGAVSHGTALSSGSVTPPSIAQQSDPALNTQLKRNSSGSQSPQLPNNPSRPALVTSSNNSSRYSVSGMSGLGSPSSNGRQSLPVSPYAPRIHNLTENAWVYQKVLLVYGSVGEQAIDGTVTVSRLDDSFPPVSWPACDSHFKALLYLQPGRNRLRFDFSSPKLNNSSSTNPIHSSFLTVHMLPSLNAPPLQLAILLGKDSPGTFDATPARAEREGNGLDTAIRKFRMAAYLWQAFTAEQMFRNKFGRRAFRFEEEWASGSANYRDLEQGTMRSEAKIHIIRTDKTVAELRDLNKAQQHKPATDKNALHQIAMEAAREYFKPKPGQTQYVSMLLLDAHWDVNEKVVTGHAALGSGSGDIRLGIFGSHCLHSYPSSFEEVVPAFTDCTPTDLNHVANDCNDGGSSWESANIGIGAHLHEVGHALGCPHQESGIMLRDYVVLNRSFVPREAYSTRTQTKGGLVMQSDECGWHRLDLLRFRTHPTFRLPNDPTMNSDTSVQAFRIEGGSVMAMAATGISFVEIFAEKDDTCHAWMEFPLDHDRLQRQVALNESELRAKLPPAKRKGQMKISIKCHGGGEITLDDFSKFTSKDSTVKIPGGPLGGGTAYKSRSLGSSKMDGSQSQDLVFTSTIRQDRVMSRVIIYHGRALDGMEFVFDDDTSQLFGNRKEGGDTFELDVRRGEYITGLFVRAGFWIDGIQILTSAGRRSPVYGNAHGGEGHTLIPPRGYTICGVSGTCGPWIDGLSVLVRR

SEQ ID NO: 3398 - protein, 335 aa, Unknown
  Kingdom: Fungi, Phylum: Ascomycota
MQTKPLRKFQIASVPKCTLGRLEVGMKVQHKPLPALYTVYVLRSTVRHASLYIGSTPNPPRRLKQHNGEVKGGAVRTSREKLRPWEMITIVSGFPSMIAALKFEWALANPNLSLHIPSASRLAVSTKKKANGRPRRPPLSLKSVMSNLHLLTSVPSFARWPLNVHFFASEAQKAWDTWLKNSGKTSRAGLNILTDFAPQASTDSDDAEHGIHALPLDYKPLTEYVSKAQEVVGFEQEGACVHCHENLAPADGLQPMCPGHDCKAMGHLDCWSRHALAQDTSHIIPDICQCPSCGSEVRWGDMMKELSLRVRGGAEVEKLLKKSKRAKSAEKLGEA

SEQ ID NO: 3399 - protein, 748 aa, Unknown
  Kingdom: Fungi, Phylum: Ascomycota
MASKTVHAPVATPLPAPPSTDWMVDEDWELLWSILDSMMPAIVSQSTATDAQNQLVLPDEEFEVEVDRFIATLAKPPNRNDVIKYLALRPSLDEGFRDDVRTTLGNSSGRDKFAKALTFLRSRMGSLFLTWCWNPLDQQSLETREGIVRSWRIGNMRGMRTFSKTLATIASRANALHNGLFHELTGYTDKPREWQPAQAHEFIFTQVEPGHEPYTIETDVVIVGSGLGGGLTAKNLAEAGHKVMVVDKGYWFPPSQLPMTQAAGCHHLYASGGALMSEDGGLATLSGSTWGGGGTVNWSVCLSPSELVRTEWADAGLPLFRSSDFDECLKRVNTLVGATTEGLTHNHQNRVLLDGSKKLGWKVAEAPQNTAGKTHACGQCHLGCGSAAKMGPALTSLPAAAKAGARFMEGFKVEKVVFAEDGVTAIGIEGTWTARGPGGVVHTPAAERMQRKVVVKAKKVVIAGGALCSPLVLMQSGIENAHVGKNLHLHPCNIVTAVCEKETRPWEGSIISSYGSEFDNLDGHGHGVKLEPVCSVPYALLASQMWQNALDSKFVELKYNHMIGYISLTRDRDSGEVYPDPVTGAPRLKYEVSEFDRENAMVGVQALAKLCYLSGAKEIRPCIAGVAPFIPDQNKVKSVSNQLSYDGKRIKDPEMEDPRFAAWLLELRQMGNAVPEATWQTAHQMGSCRMSSTEDNGVVDSMGKVWGKQGLYVADSSVLPSASGVNPMITTLALADWISRGLVKEMAA

SEQ ID NO: 3400 - protein, 486 aa, Unknown
  Kingdom: Fungi, Phylum: Ascomycota
MLSLWQTVSLALSLLPTAESIEVQWDSKDSIKEAAATAAYGLVKFYTGNNTGDVPGNLPAPHFWWEAGAMFGTLVDYWDMTGDESYNKITMQAMIHQAGPDRDYMPENQTLQMGNDDQGFWVMSAMSAAEKGFPDPPEDEPQWLALAQAAFNEWVGRWETEHCGGGLRWQVFRFNTGFDYKNTISNGCFFNTASRLARYTGNKTYADWADKIFQWQLDTGLITDEWNVYDGRHALEDGGCGKPDTKQWTYNAGIYLSGASSMWNHTEDQVWKERTEGILKRTTEKFFRNGTLHEQYCERGINATGFDIQFCNQDQRTFKGYLLRWMAHTLQMAPYTYDDIMPLLRNAGEAAAAACVGPVIENFKGHDGTACGFTWLEHTQGPFDGKVGVGEQMNALDAFMYNLVEDARPAVTNNTGGTSKGNAGGGRSDKDKLPRDRPITMADKVGAGFVTAILLGIMIAFVSYIIWNDKEPPIFLQEPKGKGSAG

SEQ ID NO: 3401 - protein, 507 aa, Unknown
  Kingdom: Fungi, Phylum: Ascomycota
MTMLTVTQPFSYGHKSVHDLPTPPSTSRPSPPPAYQEQPYRSLSHVPQGIEHAAQPMSAPHRGLPPPAAMGLAPQQPSSTAPPPQTVHQPHPPPQQAPPTNLPPHGHVHTQTSGHLPPPPQHWQGGEESMKSWLMARAEEEKTKQEEERTRQAQLRIEQRRIEVDILRSSLNGGIPPALIPLVFAGMGNSGGAVSKTALDWAQQYLTNPQGHHPQLLPAAQAPLSPEHQRDFSGQASSQYAASTPGPGPGPQSQGAFASHAGSPTRPRGQTLSGPLSRGPPGLTSFPSGGPQSGPPHQALGHGHSGPGQQEQALYFHHWQPPTSHGGNSSNPPGTPSGEAPRKRKAPGSQSSGGGTGENRLRSPPILTYSNTGETAPGRRGHKRQRSDMSWRLSSPGHADWREQRERRRKSLSPQREAPARAGRTMIKGEGGGHSVSSLLSAEPEMMTEQYRPSQSVSQHGRQFEQDSQRASATHTRHPSEGRDDTRSTPPGSSRREDEQGVGGRPQ

SEQ ID NO: 3402 - protein, 336 aa, Unknown
  Kingdom: Fungi, Phylum: Ascomycota
MEAEAPVAVFKKRGAKGRTNIRKRPATPPPATNSDSDSDGDYSSSEDESGRRVKRRKKTAVVTATSKNTKADDKDLTASAYTADRTAAITSANDATKQSNWYDENAKDALSAKNLLGSSKSALKDTQAGDGLYKGLANQTSFIQKNPDAPNRSVGPVKAPTNIRTITVMDFAPDVCKDYKKTGFCGFGDNCKYLHDRAVVQQGWQMDKEWEKVHKGKTNLGGTVVASADRTKNDEADGNDEEEKMLEKIPFKCIICEQSYREPVVTKCGHYFCEPCALKRYRKDPTCAACGAGTMGVFNSAKRLKKLLDRKREREAKRRQDALEAGEQLSDEKEDI

SEQ ID NO: 3403 - protein, 1908 aa, Unknown
  Kingdom: Fungi, Phylum: Ascomycota
MSKDGVKASFPTFVLDRLVTILETGSTKLIRDTAINQLADWQKQHPDELFNLLSRVVPYLRHKDWETRSTAAKAIGKIVEHAPLFAPNGEDALEPAKEEAEAPKKEEPSGENGHIKKEEEGEASLGPVDDFFGLDQLNVQHIIKYGRELLRGGVEYNLAALDPQARLEHQRKTLAGRLGLLGRRLEDEEIAPPVDHSAVPATPADAPNGNGLARSDSLAAQSQGTEESQLSSRQLNVLKRKRKREAMKASQGKSGFGDLSLRRSGTAGSDGFGADDTPLPDAETKKNGKTDDYFNLDRPVDLDEDSKVVSEFKGPVIPIKSELESEDTQDPVEWPYERLCEFLKVDLFDPSWETRHGAAMGLREVIRVHGGGAGRLRSKSQTANDALNCKWLDDLTARLCCVLMLDRFTDYSSDTSVAPIREIIGQTLGATLKHVSSESVYKIYKVLYRMVMQEDLELERPVWAIGHGGMVGMRYVVAVRKDLLLKDSDMIDGVIRAVMRGLGDLDDDVRSVSAATLIPMAQEFVTMRPGSLDALINIVWESLSNLGDDLSASTGRVMDLLATLCSFPEVLDAMKASAAKDEERSFTLLVPRLYPFLRHTITSVRLAVLKALRTFANLDAEASQGWLNGRILRLIFQNIIVEKDRETLTMSLELWGALVRRLAENPASLAEEFAPHVDALMQLTLHPIGISRQPIPMNAGLFQKPSGGSYSVSVPVPSRKMSSPDPADRATKRRRKSAKIEDSVPATLTHDVDGAMIMGDVDLVGHDVLVRSRVSAAQAMGLIMSLMPVSSLDDFDALLIPGFTSAYSSSQLTACVVVDEFAKNKPQESEQARYMSHLQTIVESERPTSYRDLVNYIQRVRAQCTQLIHMFRDHGKVSSSRLPILPVLVQGEPEAGPTAFSITLAEKCVGDDYEKMRKAMPPGQRLIAGQQLAEARDMTAATIAEAQAAKTARDIRIKAAAACAIVAIRTLPKKPSPLIKGIMDSVKSEENQQLQSRSSDTIAKLVQLFSEKGRKGPADKVVANLVKFSCVEVAETPEFPVHADKTSCILSMQKEEDRVDHADAAKWAKEAKAARITRRGAKEALEILSKTYGAELFEKIPILRTHMEEPLTRAFTGDLPAEAKDAEQTFGQEIVDALSVIRTMIPTMNQALHPFVMELLPLVIKALHSELSVFRYMAAKCLATICSVITVEGMTALVEKVLPSITNPLDLNFRQGVTEAIYHLIAVMGDAILPYVIFLIVPVLGRMSDSDNEIRLIATTSFATLVKLVPLEAGIPDPPGLSEELLKGRDRERTFIAQLLDPKKVEQFQIPVAIKAELRSYQQEGVNWLHFLNKYHLHGILCDDMGLGKTLQTLCMVASDHHQRAEEFAKTQAPDCRKLPSLIVCPPTLSGHWQQEIKTYAPFLSVTAYVGPPAERKSMKDKLNDTDIVITSYDVCRNDAEVLEKYTWNYVVLDEGHLIKNPRAKITQAVKRLGSNHRLILTGTPIQNNVLELWSLFDFLMPGFLGAEKVFLDRFAKPIASSRGSRASSKEQEAGALAIEALHKQVLPFLLRRLKEEVLNDLPPKILQNYYCDLSDLQKKLFEDFNKKQGKKLQAEAGRDDKDAKQHIFQALQYMRKLCNSPAMVMKPGNTLYDDTQKILQKQGTTVEDVVHAPKLTALRDLLVDCGIGVEGGDSNDPLYQPIKPHRALIFCQMKEMLDMVQTQVLKEMLPSVSHLRLDGGVEANKRQDIVNKFNSDPSYDVLLLTTSVGGLGLNLTGADTVIFVEHDWNPQKDLQAMDRAHRIGQKKVVNVYRLITRGTLEEKILNLQRFKIDVASTVVNQQNAGLQTMDTDQILDLFNLGDTGPGLISDKPQNDMEGREEDMVDVETGDVRQPGKKAAWLDDLGEMWDSKQYEESFDLEDFMKTMG

SEQ ID NO: 3404 - protein, 1095 aa, Unknown
  Kingdom: Fungi, Phylum: Ascomycota
MSLLPAEAHQELLQLLTALQSPDNTARTQAEEHLHNNWTSTRPEVLLMGLAEQIQGSQDNATRSFAAVIFKRISSRTRKNDAGTSVDMFFSLADEQAIAIRQKLLETLATETQRGVRNKISYAVAEIARQYIDNESQWPELLGALFQLSQAAEPEKREVAFRVFATTPGIIQKQHEEPIIQAFQKGFRDDAVLVRLAAMDAFAAFFEITPKKAQVKYHGLVPDILNILPPIKDSQDSEDLSKALLALVGLAGVSPKMFKSMFNNLVQFSISVVQDKELDDVCRQNALELMATFADYAPSMCRKDPSYTNDMITQCLSLMTDLGEDDDDAAEWLSLDDPEQDESDQNHVTGEQTMDRLANRLGGQAILGPTFNWLPRMMTSMAWRDRHAALMAISAISEGCRDLMIIELSQVLDLVVPALQDPHPRVRWAGCNALGQMSTDFAPTMQNDYYDRVLKAIVPVLGSPEARVKSHAAAALVNFCEEAEKSILEPYLDDLLSHLFQLLQNEKRYVQEQALSTIATIADAAEAAFSKYYDTLMPLLVNVLQKDNEKEHQLLRAKAMECATLIALAVGKERLGQDAMTLVNLLGNIQNNITDADDPQAQYLMHCWGRMCRVMEQDFLPFLDTVMPPLLEMGAAKADLQLLDDEDQTDVAGEDEWHLVPFKGKMIGIRTSIMDDKNRAIELLVLYAQVLEGAFAPYVANIMEKIALPGLAFFFHDPVRYTSAKLIPQLLASYKKAYGPNSNELGGLWNATVDKLLEVLTAEPAIDTLAELYQCFYESVECLGKNCLTAEHMKKYIDNVHSAIADYQDRVAARAEDKAAAGPDDAEDEEEELQLAIEEDETLLSDMNKAFHSIFKNHGAAFLPAWETLMQVYTSFLNSDDPTQRQWGLCIMDDVLEYCGPESIRYAEYIADPLIKGCKDSSAAIRQAAAYGIGVAAHRGGAPWQQFLGNSMQSLFEVTQIPEPRNEENIYATENACAAIAKILHYSPNSVSDAQAVIGPWIETLPVTNDEEAAPYAYAYIAQLIDQQNPVVMNNASKVFTYVAQALEADSLQGQTANRVVTATKAMLSAANVNPAPLLQQFSPEAQQTIMTHFA

SEQ ID NO: 3405 - protein, 1465 aa, Unknown
  Kingdom: Fungi, Phylum: Ascomycota
MTQHTDKELELQAPEPAAAAIAPTDVERRDDAGFATPVETIDVSKRAEEQIEPADDDTTQDDEKAVRPTLAQTRSHATTASIATMGSVARSKRPWYKQWNPLRWGAIPPIPKEPIVSREASAGFWSRLTFTWMGPLMTAGYKRPLHQNDIWSVHPKRAADPLTEKVRVSFKRRAAQGDKFPLFWSLHETFFFEFWVGGGAALLATILQVVAPFTLRFLIQYATDAWVANQTGGPEPPIGRGIGLAVGITIMQILQSFGIGHFIYNGMMVGGQSRGVLIGLIYEKAMVISSRAKAGDHIQPESAPEEDAQTKKKAKKSKKKAEPAHDGLGWGNGRIVNLMSVDTYRIDQANAMFHLVWTAPFAVLITLALLIVNLTYSALAGFALIAIAMPLLGRAIQSLLARRKRINRVTDQRVSLTQEVLQAVRFVKFFGWEKAFMDRLGDIRKKEIRAIQYLLALRNLINAVSMAMPLFASMIAFICYSLTQKDMPPAQIFSSLALFNTLRIPLNLLPLVLGQVADAWSSMGRVQEFLLEEEQEETIAVDDKLEHAVDVRDASFTWERTRTQDSEKDNKEQSSKAQSATKPDERQTSIQDTPLVEHREPFKLQDINFQVGRNELVAVIGGVGSGKSSLLGALAGDMRQTSGQITFGASKAFCPQYAWIQNATLKDNITMGEELDKAWYKEVIHACALQADLDMLPHGDETEIGERGINISGGQKQRLNIARAIYFDADVVLMDDPLSAVDAHVGRHIFDNAILGLLKDKCRILATHQLWVLQRCDRIIWMENGHIQAIDTFENLMQDSAAFRTLMETTDSEKKEPEDKAKKDVIEAVVDDKEKDKKNKKQAALMQQEERAVSSVPWSVYGAYIRASGSLFNAPLAVFLLAFTQGTNIMTSLWLSYWTSDKYGLPTGTYIGIFAALGFFQAFMMFIFSVSLTILGTRASKVMLREAVNRVLRAPMSFFDTTPLGRITNRFSRDVDVMDNNLTDALRMYLFTFISITSIFGLIIAFFHFFAVALGPLYILFILSAGYYRSSAREVKRFESVQRSHVFAKFSEGLSGVASIRAYGLKDHFIQELRKSIDEMNAAYYLTFSNQRWLSIRVDGIGNAMVFTVGILVVTSRFSVNPSIGGLVLSYILAIVQMLQFSVRQLAEVENGMNAVERLHHYGTKLEEEAPVHTIDVRPSWPEKGEIVFDNVEMRYREKLPLVLSGFSMHVQGGERIGVVGRTGAGKSSIMSTLFRLVEISGGSITIDGINISTIGLHDLRSRLAIIPQDPTLFRGTVRSNLDPFGEHTDLELWSALRQADLVSSDEVTDRKGESSRVHLDSVVEEDGLNFSLGQRQLMALARALVRNCQIIVCDEATSSVDMETDDKIQNTIATGFRGKTLLCIAHRLRTIIGYDRICVMDSGRIAELDTPLELWRKGGIFRSMCDRSGIRMEDIKGAKDALAAMTVEAGPSTSSDYGDEKKEV

SEQ ID NO: 3406 - protein, 299 aa, Unknown
  Kingdom: Fungi, Phylum: Ascomycota
MRFTTTAIAAFAAAPALVSALDLRLITYNIRQATNRPGRNEKHWNDRRPLVTTQLNIEANEDTLMCFQEVFDHVLEDLKTDLGEKWDSVGVGRDDGKTRGEFSPIFYRKDVWTVDSKKTYWLSPTPNRPSRGWDAGHNRIVTVAEFTHKDSGEQLAFLCTHFEWSGKRAQAESAKMMLDFIDDFGDKPVFVAGDLNSQPNDKPYQTMTKELTDFRTWAETYQSPLSRPHMETSLKSDADILTFTGFTEEEESMLLDYIFIKDKDMVSNPSYSVPTNLFDGVYSSDHRPVVVDVTIGENF

SEQ ID NO: 3407 - protein, 126 aa, Unknown
  Kingdom: Fungi, Phylum: Ascomycota
MPPHLHPRSRTTSTLFATTVFASFFVVALPHILPCPVPPARFADGEVVIDENGRRRRWKRKETPEVRNGIAKFGQTTPDEELMGPGQKVPDRRECPVPKPGGMLGEWLGFHKDSEDATSAGRIERN

SEQ ID NO: 3408 - protein, 390 aa, Unknown
  Kingdom: Fungi, Phylum: Ascomycota
MAQTATTNGGRGRIRDVLPNVRFGKWPVGQLNSITDVPGVLVSVQSLHPTPEINTGVTVILPRSDWYDWSSPAGIFRLNGCGELTGTHWIEETGLLNSPIVITGTSGIGQAFNGLRKYVAEELGGENRDHEIFTFPVVGETYDGFLSHQNAFALKSDDVVKGIKMASSERVPEGNTGGGTGMICHHFKGGTGSSSRVVKGLNIHGEDTSYTVAVLLQANYGHRENLRIAGVPVGRILVEAGDPSPIEEEKIEARKDGSIIIVLATDAPLHGLQLQRLAKRCALGLAKVGGYASNSSGDIFLAFSTATKVPTEKFQNGSSNPYVPQELRLGMSDDSTLTGLMEAAADATEEAVYNALCMAETMEGKKGRRVRALDLERLRGIFGKLPEGWW

SEQ ID NO: 3409 - protein, 488 aa, Unknown
  Kingdom: Fungi, Phylum: Ascomycota
MSAPPPTVDAAVTDEPQSDGSKLRTFIGILRRFIGVSDLASVRFSLPAQLMEPRPNLEYWTYIDAPNAFVAIGNSDEPLDRMLEVIRFWLTKDLKYAKGKPCKPYNSCLGEFFRCNWETEDNAPRIDTNSFRGKDGSPSKKDGIASLKAAAKTDKNASTASLSVSVPQHGTSTPATVDRQYRISYLVEQTSHHPPVSAFVVSCPEKGITARGFDQITAKFTGTSVTVLPGEHNSGIFITLDKRGGETYQLTHPPAHLGGILRGSLSVSVSEMAYITCPQSGLKAILHYVEEGGWLRGSTNKVDGIIFRYDPENDDKTRVQDVPEEDILVRLSGPWKEKVMFSMGPQPMASSPSSPSSPNVTRDRITNIIQKNVPAEEQHVIIDIAPLNVAPKILPPEEKQAPNESLTLWGGVTKAIHSKQFSQATRVKVELEEAQREKARQREKNKETWQPVFFQQATGNGGRPELTEKGQEVLEKAQKAEWDLPSVL

SEQ ID NO: 3410 - protein, 394 aa, Unknown
  Kingdom: Fungi, Phylum: Ascomycota
MSSHRPNAFNSLRMGEVIREKVQDGVTGETRDLQYTQCKIVGNGSFGVVFQTKLSPSGEDAAIKRVLQDKRFKNRELQIMRIVRHPNIVQLKAFYYSNGERKDEVYLNLVQEFVPETVYRASRFFNKMKTTMPTLEVKLYIYQLFRALAYIHSQGICHRDIKPQNLLLDPNSGILKLCDFGSAKILVENEPNVSYICSRYYRAPELIFGATNYTTKIDVWSTGCVMAELMLGQPLFPGESGIDQLVEIIKVLGTPTREQIRTMNPNYMEHKFPQIKPHPFNKVFRKADANAIDLIARLLEYTPTERQSAIDAMVHPFFDELRDPSTKLPDSRHGSSQLRDLPDLYDFTRHELSIRPDLNQQLVPQHMRSVLAARGLDIENFTPLTKQEMMAKLD

SEQ ID NO: 3411 - protein, 616 aa, Unknown
  Kingdom: Fungi, Phylum: Ascomycota
MAHARAPSEGLLPQVEHPHKYDDDHEKPAIAGPKRNVGRDKIRCLDGLRGIACLLVFNYHFLWPWTPAIMLGYGALPPRAPEAYTSWLSWPILCLLNRGRPMVAIFFAISGYVLCRHILRAIHERRLDAAYQGLASSVFRRVFRLYIPPTISMFIVAVLAQTGAFRSEFSIYKGPDSHYINGTVSIGKVTQSTLCGNGTIHGFGPAGVADIFGVLDPEIVGNETIWGDQHVCVNMTSRAFSPAQLYLIPDPLKREKPNKTAIKLGLEEDPTKSQIEAEEAFYKKAAGGVTLGLRVPKKMPKAERAKKNATERELKWIQFGGSWEEHPFIHDNVTYAMQNFTRSYAEWANPFNFGHYHPRYDPHTFTIPMELRGSMVLYIFLLGTAALQYKWRLRISAILAAYSLTLGRWDIATFMGGMTMSEMDIRNSDAMDPPKEGSMIPSAARAQRDSTLGFFHTPRGKRMTRWATIVLALYLLSYPDSGAEYTPGFIFLSDWVPKYYIPLSGWMFYQAMGALLLLPCVLRSPLLVSLLESSPAQYMGRISFSFYLVHGPVLHCLGFWIMPRLFDSFGQPVGMAIGYVVLLSLTLWLSGWWYRKVDMWSVGVGKRVEAFMKDGQ

SEQ ID NO: 3412 - protein, 2402 aa, Unknown
  Kingdom: Fungi, Phylum: Ascomycota
MSFQGHGSVSRRTNPFARPSSPSPSTSPRIGSRPKSTTLTNQSPLVGPDPFTSTHTRSQSSTSSAFAVPSAPIEKKHYRQDSRTAALSSNTFAPSFIKTDEVRRSNDAVKGIEGENDFSGKRYVWLKDPQQAFVKGWIVEELGGNRILVQCDDGAQREVDGDSVDKVNPAKFDKANDMAELTHLNEASVVHNLQMRYQSDLIYTYSGLFLVTVNPYCPLPIYGNDYINMYKGRSREDTKPHIFAMADEAFRNLVEEGQNQSILVTGESGAGKTENTKKVIQYLAAVAQTDPATRHKSQHSNLSQQILRANPILEAFGNAQTVRNNNSSRFGKFIRIELTRTGSIAGAFIDWYLLEKSRVVRINPHERNYHIFYQLLKGANDRLKREFLLDGLDVEDFAYTRNGHDTIVGVSDRQEWDTLMEAFNVMGFSEKDQNSILRTIAAVLHLGNIGVVKESRAADQARLEPNAKAQAAKVCQLLGVPLEPFLKGLLHPRVKAGREWVEKVQTPEQVRLGLDALSKGIYERGFGDLVNKVNRQFDQSGMGMDDAHFIGVLDIAGFEIFEENSFEQLCINYTNEKLQQFFNHHMFVLEQEEYAREQIEWQFIDFGRDLQPTIDLIELSNPIGIFSCLDEDCVMPKATDKSFTEKLNSLWDKKTPKYRPSRMGTGFILTHYAAEVEYSTEGWLQKNKDPLNDNITRLLAASTDKHIASLFADCAEDADESSGGRSRVKKGLFRTVAQRHKEQLHSLMSQLHSTHPHFVRCILPNHKKKPKQFNNLLVLDQLRCNGVLEGIRIARTGFPNRLPFAEFRQRYEVLCSDMPKGYVEGQAAASLMLEKLGLDRSLFRVGLTKVFFRAGVLAELEEQRDALITEIMSRFQSVARGFVQRRAVYKRLFRTEATRIVQRNFQVYLDLAENPWWQLIVKMKPLLGATRTASEVKKRDAMITQLNEKMRQESENRQKLEEDRRNCHTEMMRIQQTLESERALALDKEEIFKRLQNREVELEEKLAGAIEDQERLEDELDELMDAKNKAEADVERFRAQLEHAATLIAKLEEEKSNISTKASELELSIADISKRQSERSEQEAALENEIKMLQSQLAMKDRKAQDLETKLLKVDQDLEVKLHNTKKELESVKVRESTLKRENRDIQGQLSQLAKTSTDYEDLVRQKESELSLLRNDAQKFEVERRGLEHQQRSLAAETENAAARAREAQADLVAMKSRQAQLEREAADTKKLLEARLSEDAQADKNRQLVEAQLKDLKEELYKVQKELSRERQSRDDVLLLGEHKLNALQEEFDRLNEAKITIEKELYVQQDTLRRAKEARTTAEKERDEARDEIRKLRVAKTQAEEARLQAEVAGERQATKVARELEASLRRDLDAAQERLQWFEEECAKLNHQVEDLNKLILSSGEFGLKNDQAKERMERELHTVKSRLAASENDNRALLNKLQLKGLEIARSTSRASEASRGQLTGLQREKSRLEEQNTKLNKQLGESQLTIASLEKRVEKLQLSLEDVNHEMAREVQSSRNAEKASSTSTAQLAEANRTVESERQLRTQAQTTVRTLQASLESRDKELEELRSQMLNALRTADPDLRIPAQSDGPSDKGLLKSYDLVRKVEELQQNLRVQSTARSNAEAQLAEMRASRHESPSRPKLEEIHLNEAPFNGSPTQRRSTRFQARHYSNTSTPTRKQIDNDHFESARSDKTIDTVTQNSRMDLKAENEELQNQLQLAQMQNRHLQSQVDRGTPIPESFDDSPSVRRVQKLEKVNSRLHEMLDDSSKKVSALEKSIRSGELSLRDIQTKSHEELLDVFNSQEESRRSLLHSHKDAIAELTDVKTHFDKMRHDRANMELQLRDTRSDLQEMTTARDQESQSRSQLLQEFSDLQIRLDAETSKLADVSSSLELYKSRADEYFSKLEQAEIAVLKASRAEQFAKAQAREAEETYAEIMAERQKMDAAIEDLQRTNQRLEEKIEDISTDLDGVTHAKRRLQNELDDYRNQRAMDIEDKESGMEQTRRKYQAEFATLTKELDLAREERVFKHAEIARLREELDDLRSKWDDEVLNSSTWSKEKARLESTLADVASSRDEAVGAHNEAQGKVVSLLSQVRSLRTSVDDITAERDSLIREKRSVEARLEEAKNGLEDLAKGDASLRDVASSDKEILELKSSLAQHEDLAAAAVEKMRRAEALVSEIQKDIAAERETSTHLQQQKTSLEKSLSEAQLKLVDLETKGYSSASQDIKFLHKRIQELESQLESQENERNKSQRSVRNVDRAVKDLQTQIERKDKQNSQLSEDVGRMRDKVDKLLHTIDELQSSESSTQLSARRAERELREEKEKSLRLERELEGWKGLRVDKASAGSVMGTGSLRSRAGPWRTGEIDAFSAVEVPERKSSISRAPSLTKGFI

SEQ ID NO: 3413 - protein, 602 aa, Unknown
  Kingdom: Fungi, Phylum: Ascomycota
MSSPQRGSPSPDQPGRTDDHTPDPENSNSASETVANIGCQWRTDQYQDGECSRFLDCPSHSLEREESEPPNESAPSPPPPEADTVSTNTKTTDDEPHTDRESVEDRLASQLQLLGTRSGASGQGVDDVPAGDAGPSTTLDQPLPPLPLPRSTSHMVPLQHPIDLNHSLPPTPREEHPEQELPITAPRTDRRRSTVTFRDDTVDEQASSSRTSTARNYDLERQGSLPAVSQAVHRTSQSSTSGTHDVDDSSQSEFVLPRWQPDAEVTYCPICQTQFSIFVRKHHCRKCGRVVCNSCSPHRIIIPHQYIVRPPGSEAPLPQGFLYDGVSAAGYMDVTAPSGGERVRLCNPCVPDPQTAPPQSPASGVSSGGPRSAHQRSRSSYTGTYGAATPSTRYPGSYGDSRGGDLRRYSAGTRSIMMAPGGRAGSSGSSSRMVHHGSLQRFSQPGSSYPARHSSLASVASSSRNRMLPPTPQIAEEDECPICHRELPSRDLPNVEAARETHINACIQSHSTYGSPRAPASGRNEPAGPAPPARMTGMYKYVATEKDCIDDAECTICLEEFAVGVGMARLECLCRFHKTCISAWFVNHPGRCPVHQHDGFGF

SEQ ID NO: 3414 - protein, 340 aa, Unknown
  Kingdom: Fungi, Phylum: Ascomycota
MKYLPVHDFEAVTGALNFNTPDCNVTGGCDLYTTKSTGSDKKLYKNIDEDLNSQHDALVKLSASLSPPDRKHVLATSPAFSQSSAFGPLTELSSRRTFAYLIATLNASHPHYDFSHVLRPGDFKRERTVRRVMVNLDSILQNVRPGFEAKSLDSSYGSDSHSVWGPQCWSRIDKEMRLNECTIFSYRPDNDPFEEDESAIWAVHYFFFNRALKRVAYLYVRVVPVISAHSPVLRPARRGSIGKRQTDDYNGDFDSAGAKKRARYWLGERGAADLIGESPEGDDERLDDGLYWNRGEDGDIVPFSDDDYPEADEYEDDDDDDVLDKKERYMSEDIAGRMEI

SEQ ID NO: 3415 - protein, 864 aa, Unknown
  Kingdom: Fungi, Phylum: Ascomycota
MARFSFPVPGRKKKEPAPVANEGPKSKAHKLLGSTPLSIDAPAPKNWDHVSNSGFSVTVTDAPSTPYGNRENEQHGKFGRAGATKDWGDDSEILPRHYRTGYLDPNEDAYSEATTALRSRQSSSTIKSWYDKSKQPLSVSQQTSASAMARGLPSKAQRMLDMDNSLAPQKTKKKPARLDLSVLTPHPRGKAHQNSEGYILGPDLTTKSPSVLSQLSPSSGGGRRLQKRPTKESLRQPPSITISDPIRPSTAGSGRFPNHPNGVPDLYGHYEQMSLRQIMDLESHDPDQDETAASSKPVVAPHAMPNPSIVRTSPSRRKGPSHVHTASHSTHSSKARHHSPSASVSSRHTRTSKASKRTETSFQDADLHGKSVLSLSSDSEDDDDYGSSRSPTSEFVRRPSDFEEHAASLDNWPSHGSSSISQSPDSRAKSVKRASFAPFHTYLPVPGESPKPAPSSIATSTSAASLLQPPSPSRISSLSNSSESSALTWQSNKAGYGVQEARAITMLPAQGPADQDSSLESGSEWEGEAVAGRRRSSVPRDSMGSTNDQPTPPLSPSSVDFYIRSAHSSIDGPSGGQNRFMAVSKQEELLLAALRQKRQLMRESFIAEEVSARIGRHSQNQLKGHKTKASTATITQDLFDFDFPTPPKGKDEISLSSSDSSKLDRLDFKPGHVGGFEDESIGSVLFPAPKRSSQMSVSKPKMEQDEIQQRRGSYMSEEWPISPRTLSNFPEPGQGRATEVDSRSIASYDSNVEENEQILLPNRYSGGAGRRKSSQALPGRGHRSRVSVVPEEPGSPAFYGGQQFEDKQPEDNDAGVPRPDSPISPEAFPAIPTARVTVNKKLARLSAVGSAPLGSQPGWWGDDD

SEQ ID NO: 3416 - protein, 564 aa, Unknown
  Kingdom: Fungi, Phylum: Ascomycota
MAGGYERVNAQDDDDHVSPVERRSDYASPNSPPPSFRSRASSPNRNRQVDATLAGAFDDSGDSSDDEGDDRQRLVRRNSGPSAGNSVGSSQELHTPPSSIPSQPVATPATTASRQQRVVGGGNGSDGVFANMSARPERVESEKDEMPPTYEQAAADAAPPYWETTILAPGMGGPDDVYVDGMPVGSVFSFIWNCMISTSFQFVGFLLTYLLHSTHAAKNGSRAGLGITCIQYGFFMKGAAEGEPPVMSGPDGYAEPPDPNSHNFDAGDITDGGGSIGDIGMSDWMGYILMVAGWFLLIKSIAEFLIARRHEQLVLQSPDRGLGVPIIAEGDSNDALVNNMARHGLIKDDRVKAAFLSVDRAHYAPSRPYEDSPQSIGHKATISAPHMHAHAAESIISYVVPTTTSPKRRILDVGSGSGYLTHIFSELAGPESLVVGLEHIPELRDLGTANMSRSETGQQLLAEGRVKFRLGDGRQGWVEPVTDGKADGDGLWDAIHVGASATEVHPELIRQLKSPGCIFMPVNDDEGGYSQHIWKIEKDDQGQVTRERLFGVRYVALTDAPSRK

SEQ ID NO: 3417 - protein, 1146 aa, Unknown
  Kingdom: Fungi, Phylum: Ascomycota
MAVTSSATGPPGQPDITYTPDFARYQERTAQRKSQEVLQTHLPNGLPKRLIGPLVWDGDSVKSSYNWTFSLSEEQVEEVRQALRHFESLSLSKAHISPETFPLPRVRSELRRLSDELHHGHGFFVLRGINPDEFSREDNIIIYAGISSHIAPVRGRQDSKYEGRPADVVLSHIKDLSAGNDSGVIGSPAYTTDKQVFHTDTGDIVSLYALNVAASGGASKLASTWRVYNELAETRPDLIHTLTESWDVENFAKGDTKYTSRPLMFHQPKTHNTPERIVLQYARRYFVGFGALPRNPEIPAITEAQAEALDTLHFLGEKYCVSTDFRKGDMQYVNNLAVFHARDGFTDEGTKRRHLLRLWLRDPENAWETPRELAPRCLYLALPLFAGSGTCAKHHPKRQEIEYSTVPDYFLQDLASTDPSSFDYAQWNLGLLNRTYPTDASFDPGHRKPQWARFARWVKYLNKNCKKDGRTQYKVLIMGRHGQGWHNAAESYYGTPAWNCYWSVLDGNGTAIWSDAHLTPAGESEALKANAFFKSHFADHGLPFFDSYYSSPLTRCTTTADLTFGDIKTPKHKPFKPVIKEYLREGISIYTCDRRSNKTYIHSVVPKFKFEAGFTELDELWRGTEGETTAHQTERSKELLDDIFSTDDATWISFSSHSGEIRRLLEVLGHRSFSLSTGQIIPVLVKAEFKDAGEEPPTGTEPGFTAEATCTQPPMTSIGGQGEWAAGLEGPPATELLEGRLWVDGCFDFFHHGHAGAIVQARQLGDELYVGVHSDEEIMANKGPTVMTLEERLAATNACRWVTRSIGHAPYVTYLPYISHYGCKFVKEAGRFKVVKRSPGISTTDLVGRMLLCTKGHFIKSLEAVLSGDEGNGTSEERKTLGDSMMERMKLYATDETAKAPGARVFCWSASEPAKAEDTREEKGSFRKLIDGKGPQPGQRVVYVDGGFDLFCSGHIEFLRKVVEAEEELARADGWFSQQAIDERLGKGADYPPAYVVVGVHEDEVINRWKGVNYPIMNIFERGLCVLQCKYIHEVIFGAPFTPTESYLTSLPLGRPDTIYHGPTSFMPLTYDPYTAPKAMGIYKEIGEHAFSGVNAGEIVQRIMKSRDLYEARQRAKGVKAEVESAARQREILEEEQRKKEEAMTK

SEQ ID NO: 3418 - protein, 924 aa, Unknown
  Kingdom: Fungi, Phylum: Ascomycota
MEILTLLNTAATSSGKSTSREASPSSSHEDLATPPSTAVPTPSPEPSWSRPQVADKHHEHTQTWDAEETSTGLHTESGFGWNANFTFPFKGDSLGYTRLEMDPSGSGTSRDGHRRPHRIVTDGSSYRPQDPSPAEDAFVPSSADPFRVPDYRRHKFSDSHSSLASLATSRSDAHSRISSVTTINEIPSIDSVLSEVSQADASSPGLPASSPTQAERKSRFKSQDASLSPRGRSRTGFIVPRITRAASPSDVALNLKQGGIVKPPTSATMSTHPHLRNTSRLSAPRTHKRAVSAPVFPPLPRRLPSFTVNQARPFLPPPHQMMSAPRGSPFPNEEVSYLRVGPPEVIREHEPTRPVMTTRHTDSEATSATASVAGSHMTSPTTVSQSSAGAHAKSQPDDVWDIDDENLRMPSFEELELHGMQDETVQCIFVDKCATNSPIRKSVSHFFGRNKGTTLQIPEHIWLVYCRQHYQRLRYRLGQKYALHQLDLVKVVIHRIERWGKDNKAKKDGAEVLDWQIMLRKCVRDEQERWARFKQDLRRQGISQPEQDERYEAFKMSRVGHSKYKQHVGLSHEVAPTSGLMESNNSAAETLFSIERNYPWLLDTLGDHRAEDEVISVIDRLRQDYKASLEAKSPSGVAVIKELPPIEFLPNLSNDNDDRPLKTGRKRGPARTSRASESFKRRATRSVESPDEASPAESYSQAGFQPAYTSQLGPSPFQGGSATYDHPQMAQWMGRPGQQDRSVSRSNYIVPRMQPLNYGYRSSVGSGSTANLTHESVSGVGTPGLERTEQSRNYLPAPRPTHHRSASAFTPMSRYTPTLERPSSSGEGSSSGRTQEQGDYFSTFAMGGPQRNTHIFGDLGGYQMASNNRPPVFDFTPRTRPGLWTEAEAPELPRVTAWSPHEGSVPHTATYRSEGDIQQGGGKQ

SEQ ID NO: 3419 - protein, 589 aa, Unknown
  Kingdom: Fungi, Phylum: Ascomycota
MVLFEAQVGQDPVPSPLKVPSLTNLSFERLLASVSLVLSFSSVANLFLVTRNTAQRAAPPRSCLSLPAHGKRANEQTPRMEDYVLFHLVPLCYGNENLGISASARAANHVSPSARGDDGLVIGFHRTIDQDLRDRVPRERNKHLVDVTLLRLHSELETSSSCDTQRDEPSVIIRAMFHTQRECVSLRLIPENSVNYDPSNHLFSWEYMSHDEPQPCTMYDDGISNCRFGDDATIRVGALRLDLVWARPNLRPGEDIEYVLLNRAKAGHRERMQRKNKLDYSSRPALKAAATPSKHTRRTVSKHNILPGQGKQIGKGSYNTVVYRRRTDLPYREVIAVKEVLDLAAGNAAAREINQLQRIGANHIVGYFGHYVPDHNAGAPVEIYLDLYDGDLSILHQQRRFKNSHNNNYFGLPLHEQMLHQVLLALKFLADWNVCHRDVKPQNILYRRSGERYDFALSDFGISRVAGNGNTIAGTDQYKAPEVFDAERDARPVMDIWSLAVTLMEIHPDIPFNLDIPAYDRYKVAEKLAEFTFAFPEYEPMTHEDPQRRASAEWLLHQRFKPRGLPIRVSARAAEMERERRSWHSRYLD

SEQ ID NO: 3420 - protein, 1069 aa, Unknown
  Kingdom: Fungi, Phylum: Ascomycota
MAPSEAQRRAAKGPTVVSSRPDLWSIREHTDGLSFIKPSDMASAFSVQDNNGSSTQPNALVFIENQLPAWFYIRPALDCPAVFSTRRGDLPFRHMEHVLPSRSVHMWDRDEIQSACNSLRLLYWDLMKVMDRPQEWSDMWKWFDAHDLYFYGAQNLWNCINHLVDENKIIHADVRKEFALHIGHWADEWCAVQEQKGRLKAWNDQKGPIFNILSKKDHEEMGPVGDDIIPMISDALKHRRHLLMMDSKMTAQAGPNHLVPACRSGTVHNWMAGQKILSANGLPPPPSFPILLHSPPAGSEKSGSVTPKAKPTTPMPIESRRSSGQSRSAVDALFESAHPSFAPPTAVVPEKSAQGRGKARRTASAPACLINDGREIQPAPKRYTISDRNIGPGEEDSNIFSDVPPPKAAAAILDSDPKGDPIPSEVKLAISEVDDAAESTAQASVVDASQRDRTQGKPHIKVQPPRSNTFEPRLGYGTLRRNPAPRVPMIQDTNRNSEDQAWNPPRHWQSSGGTQGHVASFLNPAVSAWPVHPQVPNLNALSIFEHAPRPLPYPPIALFHRGPAVNLASTFKQLSKAPRASTQHDSQPVQTIYPSHYGAAARQTPPVSLGGIESEDRVHVGRSNVPTTKSQARKQTNVHGSSWRRSDDARNPASEYVVTQATGNSQAKVCPNTKSRPRPYQPCDCGLCEKRNRSIYLQLVRFDHVLVKDQVIRVLTSGLVPLIGEVEALHSIDNKDPFPRTFIASFYTQEHVKKALLLYEEQTLESGPVVSIRPTLRSKWEDFRSKGERPGANPTGTKEMAKRYSSQRPYPTKPSAPSVPVADSQGSAVRHEKPVQILKPLKKHHAGSGADERKPVQEKLRDSPEKSMQNAENQIQKATPAGDGEDAPPSPSQNEKADFSSSTALESHSSTVSQAEPVANDFTSQASGSGEINTIKYAAESVVGTSSNTATEDSTTKANSAKGGKPKKRKKEGILAISSPDPSLNLADTVAYPKLEKPKQAITSKKSDPEASSATEHKRTTSIFSEAEITERKKAWNKIAMPLDLQQGAKKRGSLPAAGSLRKESKSKL

SEQ ID NO: 3421 - protein, 394 aa, Unknown
  Kingdom: Fungi, Phylum: Ascomycota
MTTITLTKTVTAEPGTPGNLTAEQETCLQEAWAHILRLCATPDVNHDARDHSYEFLAHFTDKTPATFQKAFWNSVLCDDPDDVVLRFLRARKWDVVKAVDMLVSAINWREERRVNTEIVAGGEAVALKKSHTPDEEAFMRQYHSGKSYIRGADKNGHPIYIIKVKLHDPNKQPASVMEDYALHNIETLRVMAKSRQDKVCLIFDLSGFGLKNMDFHFIKFLIQILEARYPETLSVVLVHNAPFVFWGIWSVIKHWLDPIIASKIHFTSGNKSLLPFISRDNLQKCYGGDDNWEYKYVEPVPTENDRMLSEEKKTKVMSEREEIIEQFTKTTAEWLALTADSDSAKEILGKERQEMAKELENNYWRLDPYIRSTTYYHRVGALTRQGDVDFKAAR

SEQ ID NO: 3422 - protein, 526 aa, Unknown
  Kingdom: Fungi, Phylum: Ascomycota
MASPVASAALKQRIRNPALLKKLCKPEDMMQHFPNGAYIGWSGFTGVGYPKKMPTYMADHVEQNNLQGKLKYSLFVGASSGAETENRWAGLDMIDRRSPHQVGKQISKGINEGRINFFDKHLSMFPVDLVYGYYTKDRPNNKLDVTVVEATDIKEDGSIVPGASVGATPELIQMSNKIIVEVNTAIPSFDGLHDITGTDLPPHRKPINITGVQDRIGSTSIKVDPSKIVGVIESDYQDATLPNTDADEASFRIAGHLIEFLEHEVAHGRLPKNLLPLQSGIGNVANAIIGGLNNSNFRNLTVWTEVIQDTFLDLFDSGRLDYATATSIRFSPDGFKRFYDNWEAYHDKLLLRSQSISNSPEVIRRLGVIGMNTPVEVDIYAHANSTCVMGSRMLNGLGGSADFLRSSKYSIMHTPSTRPSKTDPHGVSCIVPMCTHIDQTEHDLDVIVTEQGLADVRGLSPRERARLIISKCAHPVYQPILKHYFEKAESDCLRKGMGHEPHLLFNSFDLHKALVEEGSMQKVKPW

SEQ ID NO: 3423 - protein, 335 aa, Unknown
  Kingdom: Fungi, Phylum: Ascomycota
MSLSLLHQRSCSRTEITSIGASPSNSVSSLTSIYAIYQGTSPTVSWIDVFDLRSGAALAKLSGSGASFAPTAPGSSQRRLAALKDWAAPIGKAGEEVRYGSSVLVRDVMANGGGRTLVEVKSVERGPVAWSSDARMIAAIEGDEGSRVGIWDARTGERRGRVMGHSERVTHLAFTPGGRLVSLGRDGLVRITNVNSGRTEGRLVLPVGGGAAKLLELSEDGRTIITVWGRGSVYIWNPAAGSVDSYEMDAKRTTEGWALTGGANGRYLVSRTEDGFDVMDLRSGEVIGEVKRAEEDNIIYTAATWVAGAGGSDQGVVVMGRMDGVVEVWEVRMKM

SEQ ID NO: 3424 - protein, 892 aa, Unknown
  Kingdom: Fungi, Phylum: Ascomycota
MDGMEGMDDGGGGHEHHQPAGVNAAQNHAFARNYWYIVAAITGLLLVLRGVGMLQARQRLSKCRTGSDPHPTRPHNLISQSWATTTAIFREIGHPQLYVPIRGFQWATPPPLGRIIVILIYLAVVLYMMLYQAIKNDLYFFERIGYRNAWVSITQLPMLYLLAMKVNPIGWLVGLSHERINWLHRWVARIMFITATVHGFHFWAQWEKADFVEFALEIMPLTKFGFGAWGIMLWNIITGFIPLRRLAYEFWVVQHVIGAILMIWLLYRHIPIKARYNLWMSVAFLVFDRLARWFVLAWQNIRLKPNTSSCQGGKGLGHHILLRAVGPSTTLVTVKNVHFPWQAGQFVYLWIPRIGPVESHPYTIACARRPATGGGCYCNSIQLIVRAHGGFSRRLHAYASKNPGQNVTGFLSGPFGAPPRWDIFETVVLIGASTGASFTVPYLEDMATKSQNTCVKKVELVLLAKSSEEIEYYVQRTRDAARMVRVSGIDVTVHVAITGEKRPDSPTIPQEKAALPSASTESDQDVIQEAPQTCCSGEGLCACCNGQQKDDETSSFLEDCCSSAPATATVTPYIREYNTRPDIEALIREPVEKASGETAVIVCGGKEVVSRTRNCVSRLSDERAVHKGTVLAVLQLNGVTLDDSILEYIPELQDDSEDAITSTRWEDVTIRGLMSHMSGITTNTVFDLTLLRDGPWFEKGLPKLSEGDGPVGSGKSMLTFGLLGELGLTGNLRSSLSTVSYCSQQTWLTKNSIKRNIVGPLADSVNETWDETVIEACALVKDLEALPSGDGANAVSLSGGQKQRIALARALYSRSKTLLVDDIFAGLDFDTRHLVWTRVFSPAGVLRRAGCTVVIATHFLEYAKDTDHIILLEKGRIVHQGAYAALCYTAAL

SEQ ID NO: 3425 - protein, 343 aa, Unknown
  Kingdom: Fungi, Phylum: Ascomycota
MRARYKSPSGTGTLELADDVTLEKLLAELKIRTGVESFTVKYGPPMAMKTLDLSRRRETARSLGLHGETLTIVPDEMRAVTPPAAVQRNDNAQVNQAAPQDKPEDINIPWPERDGTLLLRVMPSDNSCLFTAFGGALPEQIPAHKLRKMMADYISEHPDVYSAAVLGSSPTQYCRSIQDPDRWGGGIELSILSSIFDVQISTYDVQARNLINFGEGKRDRCVLLYSGIHYDRVAFSYSDYPHTNPTLPPEVDRTLWPTSDEDVLAQAQKLVAKLHSAHYYTDTEGLVLKCDVPGCDWIGSGQVEGKRHAEKTGHVALSEIRDEVEDNTLRPVIVMTRGIKGFP

SEQ ID NO: 3426 - protein, 191 aa, Unknown
  Kingdom: Fungi, Phylum: Ascomycota
MADTASKQVPATYVGTSKVAQTEFPLIDNDPHFKRVVGYARPSDYLAGGIAAAAGPGLMVAMEKFQPSEVGRGGFTKALRLSGFIGLAGGFLFFYQRSILRFYGATENSREIDMDMKEMVGKVKAGQPLYGETSLTPYIQGVAARQSRYSALLNDVIPWFNFVNHNQHGVDTAKYYQQAERELEAERQAKA

SEQ ID NO: 3427 - protein, 303 aa, Unknown
  Kingdom: Fungi, Phylum: Ascomycota
MSDNGSDTLVEEESHAAESESPNFALFRDCLSATLLKPASAPPSSAPNSKQRRLRRRARSSADATSITTSSSSSAAKSGTTITPASGVVDGREDDAEELADFIEYLASEIFDSLPDGLKELDHRSWREDEALQADYTLPLTVSSLSSLNLPIEITDSLRTYSLISPDPTLDSPLPSSTETFLIPILTPYIDTLTTPPPASYATRPDACEICGRDWIPLSYHHLIPRFVHDKAVKRGWHKKEDLQNVAWLCGACHRFVHSWRSHEELAREYYTVDLLLEEEEVRRFAAWAGKLRWKAGRSRTKR

SEQ ID NO: 3428 - protein, 257 aa, Unknown
  Kingdom: Fungi, Phylum: Ascomycota
MAGERPAKRQKAVHPIDAANVRTDEDFMKNYIRPSKNWQSWCHPTTDEEHTIRFAGAGRLSEQDLESCYRLVEETSRIDYENSSVGWDEEAKRTEMKSSELKYVLVEGTDEEVKNDEEEEEKREREKLRGFVSMMPTFENGEAVVYCYEIHIKPYLQGTGLAQLLMSHVTNTARNIPSVNKTMLTCFTSNIRGRRFYERLGFSVDERTSPRERKLRGGKVVKPDYVIMSKTESGDDVVVEVAVETDSEAVAGKGSGD

SEQ ID NO: 3429 - protein, 200 aa, Unknown
  Kingdom: Fungi, Phylum: Ascomycota
MSAKPQTKKFGKGSRDVPAQSERAQKWYPADDDSQPKTVRKSVRAWAPRKSLQPGTVLILLAGRFRGKRVVLVKALDQGVLLVTGPFKINGVPLRRVNARYVIATSYKVDVSGLDQKKVEEVSQPKYFTADKAQQKAGEEAFFKQGEKPQKKEINSNRAADQKAIDKALIASIKKVDLLPSYLASSFSLRSGDKPHEMQW

SEQ ID NO: 3430 - protein, 445 aa, Unknown
  Kingdom: Fungi, Phylum: Ascomycota
MGELADYLVEHDPNFRKARLPALYSDFRPQRTLNPDGYQANISAWRHALSRLASSGVLPARSSTSTAFILSSDNTLLRSLESRQFGQPLALGTAVRETVAERGLVPFQDFLKAPQSVYYHGWSEVPWNVLSWTLRRLGVVDPGRGEDKLPQGRFVIMENVEKAGKEIGERLSERTSKFERIFTKDQFRREFTQSEELQSLKEEDVEVLLKFLSRDKRLIEYDGKIVKVKATGEPDGLTEEDATIASIKELTTRLRHQIDLLNKRTEELEQAAKTAVARKQRVTALAALKSKKQAEASLAARYQSLASLDEVAAKIEQAGDQVQILKVMESSTSVLKGLNEQVGGVERVDNVMDKLKNEMDDVDEVAGMLAEGGRVVDEDELGEELEAMEREEREKEEEKNRKQEEREARKKMEELPEVPREVTPTTETGIGNLSIDEEMEAVKAT

SEQ ID NO: 3431 - protein, 84 aa, Unknown
  Kingdom: Fungi, Phylum: Ascomycota
MVRLTFIAGLLFAAASSAQLVPNESGASNVGNGQGQQFTTDAGICSGIGAEFQNGKTGCGFEDPNANQNIADAQDFAADQGFKA

SEQ ID NO: 3432 - protein, 503 aa, Unknown
  Kingdom: Fungi, Phylum: Ascomycota
MRASTTFAAIGALAQAVTAAAPEKPAVEAKNVIYIVPDGYGQASQTLARDLYSLLETGSTNGKPEILSLAADQLAAGLVKTWAANNLITDSAASGTAFAAGYKSNNGYISVTPDGKPVGSVLEAAKLAGLRTALVVTSTINHATPAVYASHTESRGNLDTIAAQEIGYSHPLGKMVDILFGGGRCSFYPQNHTDSCRSDDVDLWKYAEEEGYTIARNLSGFEDFEGGLGKVPLPWLGLFNDGDLRYEIDRKVTKDEPSLLEMVDTALNTLHRTTACREKGYFIMIEASRIDHAGHANDAASHAQETLMYNNVMDYVREWIDEHPDTIMMSAADHECGGLTLNGYNALRLSTAEHSGEYLQDMWNKRPSSADRRQFLVSEILPAAGLTDATDAEINTILGASSISAETLRLQARRAGVNWSTGGHTASDVTLFGYAASQQRRALQADLSGVWDNTQLPKYIAKVLGVDLDAVTEELRAAAEDDDAWLGKRGLEARGLDGCGHEH

SEQ ID NO: 3433 - protein, 273 aa, Unknown
  Kingdom: Fungi, Phylum: Ascomycota
MEESKYSLPSISNLISLADAGSPTSEAPPSQLSPRTEGSSTQRHRFETPALKNDSRPGSGYAPGPHGSRGLPPTPPMSVDASFESRNSPSAQSVSQLSTTSAPSGYYHETTPPLEADPRRPAPRTQLPHYPHQAPAPTSYPPGPPAGLYAQAHPPAQTLPQVHSLFYQRPLPQAFPPPMPVAVGGSNPWQHHHYLNPSHGPSYPQSQDRYICQTCNKAFSRPSSLRIHCHSHTGEKPFKCPHAGCGKAFSVRSNMKRHERGCHSFEVTPGMSR

SEQ ID NO: 3434 - protein, 567 aa, Unknown
  Kingdom: Fungi, Phylum: Ascomycota
MGNSNGKPVDLDGNVNLNHFRLLRVVGRGAFGKVRIVERKDTSLSFALKYIRKDEGMLSQHSTRNIDDPRVACIAVHRLAAYTESLWADSCAVVRSESVRNIIRERRMLEHVNHPFICNLRYSFQDIEYMYLVVDLMSGGDLRFHISRKTFTEEAVRFWIAELGCALRYIHGQNIIHRDVKPDNVLLDADGHVHLTDFNVASDVVSGRTLTSKSGTLAYLAPEVYAGKGYDIRADWWSLGVLFYECIYNKRPFDGNSENSLGTQIQAASPKYPVTQPPVSLPCLYSIGAALDPNPDTRMGATWESFIYNEFFKAIDFDLLEKKMIEPIFVPSSDKTNFDATYDLEELLLEEAPLEARARRQKPRERLKDDATDKQIREDELYRMIETDFRPFDYTLAAYKKITEASDSLREETPAATPGAELPQAVTTDDAIPATNNAQQATQGYQPNPPADSRLGRIPARPAPLPPAPAPPAPPSDYMSAVPQKPNRRITSPTGGVQVTLEAGGSWSDLARQDATLPADANTPADGKTEGSGGMFGFLKSKKGRNNSPKPKERGVLGKEGARVVIG

SEQ ID NO: 3435 - protein, 536 aa, Unknown
  Kingdom: Fungi, Phylum: Ascomycota
MAVKNGIKSSWEDIAAKKRSELADSIPVEWRVPEKLLPPESQDNVLDWAEKSGWFTSEELAITSCNAQELLPQLASGKLKSEVVTKAFCKRACAAQQLVNCLSETLFDRALESARALDEHLAKTGEPKGPLHGLPVSLKDNFNLKDRDSTVGFASHVGDRSKLDSTTVQLLEEAGAVVYVKTNVPTAMMIAESVNNVFGRTLNPRNRKTTSGGSSGGESALITFKGSCLGVGTDIGGSLRIPAACTGIFTIRPSFGRFPGRDCRSGMPGQEAVLAVNGPLARTLSDITLYSSTIVGSQPWLRDPKCLPIPWRSVELPSKLKIGVLWNDGMVLPTPPVARALNAAVEKLRKAGHEVVDWDPRDQFEGTELLKRMFLADGGKTIEHELRRTGEPWRDEMRDYSTAQELGTADMWKLHLERTAFQNKYLDRWNAEGLDAIICPTTAYTTTKNGNFKHVGYTGVFNVLDYPAVSFPSGLVADKSLDTESPSYAPLSDDCKSIHSSYDPALVDGHPINLQLVARRLEEEKALAMTELVINL

SEQ ID NO: 3436 - protein, 437 aa, Unknown
  Kingdom: Fungi, Phylum: Ascomycota
MPRDDLSIDFVRRMPQTEPLDPGIILDDWINRVQNLPEEVRFVQDEIADKDRQYNECIRLIEDRDAKIQKWIKTNGSHEPNPKEDALRAQIRDSYAKADQLSQDKITLTQKMQLAMDKHLRALDIQIKLLYDRAEPGFTDPDEVPSLLRPSAANHSAPSARSINPSHMVGAAGPTPAPRASGTGNPVMARLPSHPQIRQAQAQQQQASVQQHAQSAPATPAASIILNRQRESSAGPAPKRGVRANSGLANAPATSSGLARHASAGPGTPKAGPSVARAGSAGPRASSVKASSGPASRRGTPTAGGRKKPPNKSNLSRVKKASSRNSPSSTADSELSDAESASGDDDAGERQSRGTPAADGKDEDGDEVLEDAEDDDEDEGGDDKKYCLCQNVSHGDMVACDNDNCPYEWFHWTCVGLKSEPTGTWYCPVCEKSRKGK

SEQ ID NO: 3437 - protein, 1705 aa, Unknown
  Kingdom: Fungi, Phylum: Ascomycota
MASDMSDGSVFGLDDESDAYVPEVVNGAAGRLPSLPQPWRLSALQTPSAEPVMDHDGQSVHPGELELFAFMKWINPLTCPPQKPKAATAKKATAAKPAPKKKAVQTTLKTTKAAPKKRPNPPSDDESDLKMDESGFSNTPPSAKKQKPNPPPKKTGGVPLAELENDTLMPDTPEKGAPKTKKTATQMYQKLSQIEHIIKRPDTYIGSVEKTEQQMWVFNKETSLMEFKNVNFVPGLYKIFDEILVNAADNKQRHASMTHMKITIDRAEGTISVENNGQGIPVVIHEQEKIYIPELIFGHLLAGSNFDDDEKKTVGGRNGYGAKLCNVFSTEFTLECQDSEHGKRYKQTWTDNMQKMGKAKITSSKSADFTRVTFKPDFNRFGMPEGIDDDLEALLYRRIYDMAGTVRGIKVYLNGDLIKMKDFKSYCDLYAKSIAKERGAEEGGEPTCTVEIDKDKGHPRWEVGFAVSDGTFQQVSFVNSIATTSGGTHVNYIADQITGALLKTLNKKKKGHSLKQNQLKNHIFIFVNCAINNPAFTSQTKEQMTTKTSAFGSKCVLGEDFLKKIGKSEAIQNILEAADRKADKLMAKSDGSKRSRVSNAKLVEANLAGTRHGHQCTLILTEGDSAKGLAVSGRAILDPDRIGVFPLRGKLLNVRDASIDQITKNQEIQNIKQFLGLKHKQTYTDTKSLRYGHLMIMADQDHDGSHIKGLLINFLQVQYPSLLQIDDFFQEFITPIVKVWQGPPKEPTKSKAFFTQPEYEEWKEAHSGQLSKWESKYLKGLGTSTADDAKTYFSKLDEHLKNFETMKPEEADMFDLVFSKKKADARKEWLGNFVPGTYLDHSTSVISYNDFVNRELILFSMADNMRSIPSVLDGLKPGQRKVMYGIFKRNQTKDKKVVDLAGYVSGTTAYHHGETSLQQTIIGLAQNYVGSNNINCLEPSGMFGSRLQGGSDAASPRYIYTRLTPFARKIYSKLDEPNLVTQYEEGSPIEPEVYYPVIPMILVNGADGIGTGWSTSIPNYHPMDIVQNLRHRMGRVDGEVVEERPFKTMNPWFRGWKGTPEPAGPDRYKFNGIAEQSQTNPNEVVITELPIRMWTDDFKARLEKVISGVDGPSWIKDYKEFNDHNVVHFEIQVDEKYMPKILEEGLLERFKLTKQVATSNLVAFNARGQIRKYEKVEDILDEYYEHRLVMYTKRKEHWLSVYHAEYRKLSNQARFIKEIIDGELVVGRKRKDVLVQELRTRKYEAFPRGVDSKKKTTEDEINEDADDNDEAMEGGARDYDYLLSMPLWSLTLERLEKLKQAIANKKQEHDDLEKKSEKDLWCDDLDAFSDEWARHEVEEAQNATKMRRMGRRASKKIGAGPTGRKRVKNEDDDFEPGKKTKAKPKATAIKVEPKSSQRFAEVFSAKSKPKEPEAQPEPEPRVVELKDDFSDDDFSALSRNKPAAKPSQISKVAQAQPEPAADAGRNKRAAAAKSAKAFLIDSDSDDVDDMLGDVGAMVKGIGKTAGEDKGRVSLYAMARPQSSHDNGSENLPKLKTKPSKKFDVDSADETNYEMLANSSPYKSASKDNKLVDDFLSDDDEPIRPAAIKASVKAAVAAPEAKKRGRPAAAAKPKAKEAPKPKAAAKSTVLSPAAKAYAAKKKSVQDESDDEMAEADSPPPRPAARGRPGRAAAAKRPVIVDEDSSMMGTEEEEEEESDDPFDMDDD

SEQ ID NO: 3438 - protein, 532 aa, Unknown
  Kingdom: Fungi, Phylum: Ascomycota
MRTFTRAAPVGGTGLPRHCAFVSRSSTARCSFSTATRLARQHCSLRPKPKQIASRVYTGYVLSTRNYAGCACSAAAAAAQSRRKRTAYVALGSNLGDRVAEIEKACRKMDARGVKVKRTSSLWETEPMYVVDQDRFLNGACEVETDLEPLALLDVLQSIENDMGRMKVIDKGPRNIDLDILLYESEKVNHERLQIPHIGIKEREFVLRPLAELIPSQPLDATKPWTLIQDHLNDLTLGEPLSSFTPVSSSLSLTPLSPRRKTNVMGILNLTPDSFSDGGVNTSFTLRATLDSMLSNGATIIDIGGQSTAPGREQISGEKELSRILPAIELIRSMPNGHEVTISIDTYRASVAEQAIAAGADMINDVSAGTLDSEMLPTVARLGKTICLMHMRGDPLTMNSLTSYSPEGLLPTIASELLARVRAAEEAGIRRWRIILDPGLGFAKNHDQNLELLRDAAELRRWPGLEGLPWLWGPSRKRFVGTATGVEEPRQRIWGTAAAVTAAIQGGADVVRVHDVQEMGLVAKMSDAIWRV

SEQ ID NO: 3439 - protein, 525 aa, Unknown
  Kingdom: Fungi, Phylum: Ascomycota
MAPALDMTVDGTSTNGFGFETTRIERDGLGELEIPHDALYGINTARAVANFPFTGRTIATWPEFVRGFATVKKAAALANVEIGCLSEEQGRAIVMACEDVGAGLHDAHLVVDLLEGSGGTSTNMNFNEVIANAASKAIHRPLGDYTFIHPNDHVNMCQSTNDVVPAALKLGVYEALASAPTALLGLADAFAQKRKEYASTLRLGRTCLQDAQPMTYGQLFGGYEAVVRRHAEQLATLREGFLTLPLGGTAIGTGFGSRPGYKPAVYKHLSHLFGFKVKPCTDPFDGMQNMDCCARLSAELRNTANSLSKIATDLITLSSGPGGGIGEVALPAVQAGSSIMPGKVNPVIPMGVNQIAFAITGNDATVAMACHQGMLEINHFELVVCDRLFESIRLLTNGASTFRQRCIDGLVVNRDRSYEHILASSALATVLVPELGYAQVSSIVKSSQAEGRPFLKVAIESGHLKEDDLPAILQSSVQVDGGSCATQFDARAAHDGTVEDALIEDSMISVNGSHTTVTTEQSDDR

SEQ ID NO: 3440 - protein, 557 aa, Unknown
  Kingdom: Fungi, Phylum: Ascomycota
MASLVSGNDAKVTDTKGKVTTPTNASDQNSSSDENESQRTGHYGSVDDHVFADPATAEYWRLKYEKAGYENRHRFDPELTWTPDEERKIVRKVDKRIMVWAWVMFCALDLHRRNINRAISDNMLEELGMNTNDFNYGQTIFLVSFLSAELPSGLISKKLGADVWIPTIMCGWSIVAGSQAFLSNRAGFFAIKALLGLLMGGFIPDIVLWLTYYYKSNELPLRLAWFWTALSTVNIVGSLIAAGVLQMRGVAGWGGWRWLFLLEGIVTLIIGILSWGLMPPGPTQTKNWFRGKNGWFTDREEYIMVNRLLRDDPSKGDMNNRQAVGPSRLWLALKDWEQWPLYLVGLTTYIPPSPPGTYLSFILRNIGYSVFEANLLAIPSQFLFAVNLLIISWVSERIKERAIISSLANIWIFPWLVALVALPASVSPWIRYAMLTGLLSYPYCHAILVGWNARNSNSVRTRAVSAALYNMTVQSGNIVASNIYRDDDKPLYRRGNKILLAICCFNIVLLYGVKLFYIWRNKSRDKKWNAMSREEREYYILNTTDEGMKRLDFRFVH

SEQ ID NO: 3441 - protein, 600 aa, Unknown
  Kingdom: Fungi, Phylum: Ascomycota
MAKVASRLSDLERLLPSAPSTAEEGPQAIGSSPPTASLAIQGSSSHERENCSLHTASLEHRQAFGDEILVRRGSRSQYFSEGFLARVIERQQDIQSVLSTPQADRSDLDSATVPKPIAIFPRLLTSRGSLTLFPPSQVGLRLWNIYVERIDTCTGSKVLHIPTDEVRVCAAIENPDQAQSEDLAFCFAIFYAATVALQPYEARAILEEDVIAAQARFRNGIEQSLAEAEILEHPTLTLLRALSVYLPALRQCAFGKGIWILDGLAIRIAQSVGFHRNGERLKLSPFESELRRRVWWHLVAFDSRTAEDQGIHKSNGIRSDADLPLNINDSDLHPEMDTLPIPQPGLTTMTFSLVGYHVVCTENRLANVVASSTPSTPPEEALRLQIVKETRDHIEKWLQDCNPVIPRQRIAILTSRLAIRKLDLNSRQQWLALHHRNCCDALTTEDNLVDALEMLEIVLQMRNDKMLEPYSWLWKSHPEYHATMYLLWHLCTRTEGPNIERAWQMVDRLYALNQYFEACWGSRKVILSTLMSKAEKIRSGEREGSQESPCQRSAPMGASDGQVVEPDILMQDPDLDWGLFAEAFQLDAEPFNIDANWEQR

SEQ ID NO: 3442 - protein, 709 aa, Unknown
  Kingdom: Fungi, Phylum: Ascomycota
MTGNLGLEHEAFMSAISTAADHYKQSLAARKKPNVTRHARKQGLTCAVEYEARLVNLQKDHVEREREQAALIARLRAENNDLQSQLRKRAFDSPKPSTPGTSSTPKAVSPPPLLHEAASSKDLQTAYSKLLVKFQLVESNFKKAKDLLARRKSEREQWASHTATLQDKLDRLLQSGDVPHSVALEPQQTSATPLRSSEPAAPTTTTSLPVVNQLSTPQGLASEFAPPPGSSKSSAPIHQTPGSTQSEPDEGTEVTLPPLPGNANQREPAIKQEPSSDSPVVVSARPVRKRKRGSEKDEPSSAKIKLEAPADSSPIPRLDRIVMNSDDSLDLGDVAQRISTPRKRRDAAEGAEGLTPFAKPPASVPVMQAHPELYVKATPGVVKPSPLTPIDGNRKMRPGLRKHSGTKRAPKDIEHGIGILAEDGISYGLNDTVSHGNAKTPVPKNRLDGLLNALGVSDKRPDLPQSAARKVPNPATPRDDLLMPKPRALPFDRSARTGLQHSLADEAEPSPLAARRSKSPKKCEVKPPQRKSGTLRTKPPSDLKLEDFKINPRANEGVGFAFSDVVRDKSERAALPGCTDPHCCGEEFRALAISQKPNPPLTSEQRREEQRLLEEYLGEHAYQLGAMDKRERHKVWIDAKTHELANKYGKHRHRYSRMRSPPGFWNADFPSTQEIEDEKIEAAKRELRTIENRRREAMRPGGRWIFRDE

SEQ ID NO: 3443 - protein, 1395 aa, Unknown
  Kingdom: Fungi, Phylum: Ascomycota
MAASASSQAAALTSRKRKARRRRQDKPALAARLVLNDHVKGDVGILSEDLFSSLFPHLALDGEQNSTRDVLHVALAPWAPNATPDDAAWSIVPIVRSSAVSSSTLQFSPSSPALQSFAITLQQVAPSKLSSHSRSGIEILLLDVAPLPLETVYVSLESELTKRLENGEGTFFRDHPKAKLPKEQDGGGPEARLASALRAALGSLKVVHAGDLFPLPLPPHSVTHIPPNPGKIMLCEPVAQGILTETTKIILMRGRVHVKRQQNIPSNPRLNGVTEEDEEANTDQFFSAAEERYRTDATTEATETATETETDLSNSDPEDELSDDSMDDMISLQAPALPATNASGVSTMQPGTPMTLGTIRGRRTNGVATPGSVFSNFTATTARPDRPRGRLFKAQGLMRPIPSDLLHPKPAVEDDDEARIYVDTSSLSKIGCFSGDWVRVEVAEEPPANGFGAFGLGSFGQAEPDAASWRPVRVFGLPEGYSQRAVTRMPSSKPGERRLSFFESQIQRPTTSTAYASPILIANLEDASFVRIAPLKKSSYHGKGTNPKFASASRPPYARDITIHHIRTPISAERAYQTAVLGGLKRYFAQKTRLVRSGDLIAVPVDAQLGRVLQEVAGAGGSEVDDVVGLSVPESGSQAPTTHYDSVAWFKVGHIRVQRSEEDEDEASEGFWGSVASIDSSSVAMHGSGFETSKIPGIRQSTWQYYLGLKKNPRRNSDPTVPHLAERVQPYISPLRRQLRELLAAATSRRAVHLRMPPMAVLITSTHRNVGKATLAMDACADIGLHTYGIDAYDIISDDGGGGGDVKTEGFLRTRAERAASCGADCCALLIQHVEALTADRIESTMKEILEDTRVLIATTNDVDKVPDGVRGLFTHELEVGAPDEAEREAILKNVIDGRGVSLEPSIDLNAIALKTAALVAGDLVDVVERASVARQDRLEQLLTRLGGDTMTLTMRDIQVAGGPLARCLTKSDFDFAVEAARKNFSDSIGAPKIPNVTWDDVGGLGNVKDAITETIQLPLERPELFAKGMKKRSGILFYGPPGTGKTLLAKAIATEYSLNFFSVKGPELLNMYIGESEANVRRVFQRARDARPCVVFFDELDSVAPKRGNQGDSGGVMDRIVSQLLAELDGMSGGEDNGGGVFVIGATNRPDLLDPALLRPGRFDKMLYLGVSDTHEKQLTILQALTRKFTLHPSLSLPNVAQALPFTYTGADFYALCSDAMLKAVTRQATSVDTRLRALNASRPQDSPPMSTAYWFDHHATAEDVAVTVTEDDFLKANDELVPSVSAGELRHYEKVRETFEGGRGEAQAKKPAEPQRTDSSATVVAAGRSESKGKGRAVSGKGKGKAVATSDDEDEDYEGDTSVLGNGHVNEKGKGKAVAGFQDGTASDDDDLY

SEQ ID NO: 3444 - protein, 794 aa, Unknown
  Kingdom: Fungi, Phylum: Ascomycota
MAQDASTLSRKRPQSPDETDELAAKRPRLSDDPIPSTGFAGLNAIANKISQAFGYNSQANSGQPPPSLPPNGLHNPPNGQNGFHSPTQNFSPSASPRPAPLPTSTATSPSPAKYRPAIKLAALRGTKWDDGSGPKSPSPKKATARRKAGSSVQGTPTKGTPTPNKGSPLKRASAVGDGDSGDDLATPTKLLTSAAKAAGAKRLFSTGKGSTPKSILTPTKRRGRPPKNVKFGSRLDEGEVFFADARKPGRPSKAAKAATEEEEGEGDIVCGICARGHSKAPNQIILCDNCDFAVHQECYEVPEIPTGEWLCKSCAQEDVLKTPKKLEDIVETVKDVEVPHIPNLDKHVRSLQRVLLDRCTGQRALRIFGQQEAQDKARQLVEQTVVAGEGNSMLLIGARGSGKTTLIEGIISDLAAERRQDFHVVRLNGFIHTDDKLAVKEIWRQLGKEMEVDDDLININNYADTMTSLLALLSHPSEIMATADGITSQSVVFIIDEFDMFAAHPRQTLLYNLFDVAQSRKAPISVLGCTTRLDVVEMLEKRVKSRFSHRYVYLHLPRSLPAYWQMCKQGLLVDKDDAGSEGIDVELEGYEEFRNYWSHKIEALYKERAFQDLLQYHYYTSKSPTAFFSEWIMALSSISGADLTLAVPPVATPDSASLLPPDSRMHLLSTMSELDLGLLISAARLDIIAHTDTVNFAMAYDEYSALVGRQRAQSATSGMLAIGGGARAWSRGVAGIAWERLVSLGLLVPAGIGGSRSLGHGGLEGKMWKVDVALEEIPTGVKLNAMLGKWCREL

SEQ ID NO: 3445 - protein, 993 aa, Unknown
  Kingdom: Fungi, Phylum: Ascomycota
MSSRAGGAAPNEDAEHEDEIQYGSVGMTREELDQEYPNRPRNHSRTLNFSDLFRNLFNPLNENKKQPSAGQQRKRGPQGATKLSPQEQRRHIIERFIGRWRKEVGNDFYPALRLILPDKDRDRGVYGLKENTIGKLLVKLMKIDKNSEDGFNLLHWKLPGQTTASRLAGDFAGRCFEIISKRPILTEVGTMSIAEVNEQLDKLAASPGEAENLRVFEVFYNKMNAEEMMWLIRIVLKQMKVGATERTLLDLWHPDGEALFNVSSSLRRVCWELYSPEVRLESDEAGIAVMQCFQPQLAQFQMPASFQKMIDLLRPTEEDPEYWIEEKLDGERMQMHMVEDPSHPGGRRFCFWSRKAKDYTYLYGNGLEDDNSSLTRHLKNVFAKGVRNIILDGEMITWDMGVDKIVPFGTLKTAALSEQQNKTGSDATGHRPLFRVFDVLFLNDKQLTQYTLRDRHKALEKTINPVHRRLEIHSYTSATSADAIEPLLREVVANASEGLVLKNPRSMYRLNSRNDDWLKVKPEYMSEFGESLDCVIIGGYYGSGRRGGRLSSFLCGLRATQNHIRAGANPEKCFSFFKVGGGFRAEDYAEIRHRTEGKWIEWDQKNPPSEYIELGGGEARQYERPDMWIRPKDSIVISAKAASVGPSDQFAKGFTLRFPRFRRLRLDRSWDTALSLEEFVELKNRVEEEAKDKAMTVEDRKRRAPKRIKRELIIAGEDAAPAVFAGPKTKVFAGLEFCVLSESAKPFKKTKTQLESIVKENGGTVSQRAVPGSDMIIIADKRVVKVASLIKGGGVDVIRPKWIRDCTEQNFDAGTPLPYETSHLFHATEALTEAATLNTDQYGDSYARDVPVEELQEILDGMPKLEVADSFDKADFLEELESRGKGLSDLRGWMFSRCVLHFCAATTGDEKTADRLSGLVRYAGGRCVDDRDNDNVTHVVIVGDDAMEAGELADKVRRELSERRQMPRIVSGKWVEDSWAEKTVLDEERYTVQ

SEQ ID NO: 3446 - protein, 1593 aa, Unknown
  Kingdom: Fungi, Phylum: Ascomycota
MSVPSKSRSHARSAGTVAVAGRTPPQAEYGTMPTPKQLRYFEPTAATASMFLYAQGSSVVCCHHDTLKIERRFSKHSEEVQLLAVDNQSEKGGGRLVVSYDAGQTAIVWDLMTGDEVSRFVSFEDLTVASWMRSGNVAFGNTQGSIIMFEPTTSEHISTRTIDQIAITALAPSADCRTFAIGYQNGSLLIATLQPRFTIIHQLQTPSRLPSPVVTLSWHASSSRQRSDMLAVQAHDGDLRVWSVAKSSADDGAKVVRLLKRADDLTMGANWMGWSKNGRIIQFTDSQTHSWDVRTKHVTCDSIPTLEHVKGLAVYGPGATLFTLGPNGTVQQFDLNSPAIMVANVQHPVNPLPPSPPNSIEEPGVKSAHSATTINTSASESDLSSIPVGETVSESDEDHLSPFQRITRHQDTSSTDASNEMIESPASSRSGMSSLSRSSAGSGTPRRVPGSAISRGMSDHTYISAGSSVRTSTVGRKDMDTLSMGYTMPSSSFASQSSTRSRQRPSRLRNEVPRSPDDNKVHDLFMYTRARLTDIPYKHPASSDFSRLTNDHLRRQMLSTIFGWHKEVDDLIRDEMSRHPIGSTTRILLAKWLGDFDADGMVADSKNMSSSDWMLLALSGIGGQASQHKLGRTYVSRLLESGDIHAAVTIMLGMGDFNDAIEAYMAHKRYMEALILTCLEFPSVWERQAAIVRKWGEWAVQHNRQQLAIRCFACTDMESTEPWTSPSAQQLNFQNINASIPEILSPPLSPPGVQRGPQRSIAKSSALKLITTFGDQSKKSKFYSQGDGGQTPLAAGVTPIAESAVSPSGFEAATAFLRPSNNSRFNTPTSASVMSSRGRLPSIGEIPSDLNRDALRNEVRADRSEHRRGHGRRASSGQDNLAEGLSLQRAATASPMMMRDFQGATRARAATHGEAPPSPDKNVMAMMEKGDFARRNGSRDRMPQGLRLNLASEEDTEIISPEQSVSSSTRFHWPTRRRGPGSVSSSVTSSSAGRSLRGRVRHPDDYIHSLDAASTFKATRKAHSSRERAAAGRQASQERRTAKSRETSEDRGRSSARMWNKPKRSPTSPVPMSPEDIANLSNPLFTDANEPRTVRKSSVVKRKTGSRTSSRGSRRQSPDARPAPLDLRGRSKDRDGNARQRSPSSPLPMSATAMHYAGSEDDEDFKKAMQAQEEFRAKHSRSATRGLNSPIVTKMEHSQARHKGAVEAAGGLPPLPTIQNRTASTDQAGDLRRIKEERLRKKEQAARELEERRQSLAQRGLATPIPPPNQGQGFPRLGVETSNPESNADLPPRSATTSPPRSMYARGGPQLGLPATPKAMRLIIEGDPNIRVSQAMPEVPTIPAQYVQQPQQPATEIKPQAHAAEPELLTLLPSTVYQPPVRPPPRSMSAPIPDDPSKGRAGRKSSTGDVKPILERILDDEMMPPPPPPAPPMLKELQHLAIPPPPPPAPLPNAQRSQQNAALSSGMIEIVMDDEEGPAPVAVAAPNDNMVPVLSQPAPPHSRGRSIGDGSSIANTFAKAKDRLRSGSRGRKEPARNPGKESPYESVPNTQLQPTIRSPPPVMYDQDALRTPMGIDSKLNKHMSTGLHQSEMF

SEQ ID NO: 3447 - protein, 308 aa, Unknown
  Kingdom: Fungi, Phylum: Ascomycota
MDSLDSVMFKGLEPFTLTTQDGPPVSIYGVHSGNANADTSRRALLLLHGFPQSRHIWHRVAPQLLQDYTLVIPDLRGYGKSSKPRAVESYAKSAMARDFVSVMEQLGHKSFYVCAHDRGARVAHKMCVDFPDRVLKVMLLDICPTLAMYDSTNFEFAKAYFHWFFLIQAAPLPETMIAGDPRKVLDMFMGGRQGDCLEIFDKDCYEYYASIMQDPDAVHAMCNDYRAAATLDLEEARQDLKEGRKIKCPLRVLWGKYGVIERCFDALAEWRLVSDADAAVDGQAVESGHYIPEQQPDAVVAAIREFFV

SEQ ID NO: 3448 - protein, 390 aa, Unknown
  Kingdom: Fungi, Phylum: Ascomycota
MALDTTLTAGHQAGIPFRIFERDAHARARGQGWAITLHWALPFLRELVSPATFTAIESAQVDPNADRQGLGNFVFLNLATLEPKFIIPPGDRRRVNREKMRLALLSEVERHVCWSKRLSSVRETVDGVEAFFEDGTKAEGCLLVGAEGSNSRTRKTLAPETYRNIRLPIPCTGAALDLSPEQVKPLKSIDPLLFQGCHPATNVFFWFSMLETPLINGTAGTDKEHYRVQIIMSWPIESPEGEVESTNTTRLANMRTRAQGFHPVLRKVVDMIPEDTDITEIVLQDWPCLPWNGHGGRMTLAGDAAHAMTMYRGEAANHGIVDAHRLCKAIGDHVSGAITMKEAIDEYETELRERTSTAVLLSRQACLDAHDFAGLNENSAVLKKRVIAGA

SEQ ID NO: 3449 - protein, 446 aa, Unknown
  Kingdom: Fungi, Phylum: Ascomycota
MATETGGPATAGSAPESKVPQDKAAKNPAKEQQPAQGESGEKKLSNAELKKKAKEEKAARRAQAKSSGPGAPPGAQGAADGKGGKAKQKQEGSQAQQQQGRPPVRPAAPIPTIPKEVKPTIPECFSHLSVARRSDMTQADKDVHPAVLTLGQHMSTFAISDSITRLEATLLALKKVIDDYTPPHGTSFSRHFTSHVLNPQIEYLTACRPMCFSMGNAVRWLKLQISKIDIDLPDIDAKKLLSESIDNFISERISLADYVIVKTAAEMINDGEVILTYAHHHLIEKSLLRAKELGKSFEVIVVDDPYERVGVEHAKNLSAAGIRVSYSPDLGALRSNLRESTSLFVAAEAMFSNGAMYARAGTCDAAAAATDLGVQVVALCETINFTERVSIDSLTYNEIDPERSSGDGFRLLFDTTRDKFVTMVVTELGNTAPTSVPAILRKLEEL

SEQ ID NO: 3450 - protein, 407 aa, Unknown
  Kingdom: Fungi, Phylum: Ascomycota
MLVSLTVGKVDAGVTVLLTPDKRLIEFPSILLPPDISSGSIVDIAVSQNLEKEAKAEQEFRALQERIFSSFGASEPSVPVIRCLNATQTSVVLEWDKIQLATADLISLSLYRNGQKAGNIPRPLQMHSTKISGLAVDTKYVFHLVLRTTAGTFTSEKVEVATHKMTDLSGITITTGILPAATKETLAETVERIGAKLADTVRIDTTHFVTTEGRGQAWEKAVESNIPVVRPEWVDACEKNGRILGVTKFYLDAMRPGPPAEESQQPPQAPAAAPQTQKELPQAPKPADNEDGDAEDGADRNYAPLGEGQKNGDASSSRSSSEEDDEDEDVPEQKSRHPAPQDKQKVRTEDMQEQKLALRPADAESSRADNDAAAGKAENGNKSESEEEDDKKKAQTPDGASFTDVQL

SEQ ID NO: 3451 - protein, 806 aa, Unknown
  Kingdom: Fungi, Phylum: Ascomycota
MPGASVAVLPPPAASTPSSRKASLAPERKYKCQFCNRAFSRSEHRSRHERSHTKERPFKCMKCRSTFVRRDLLLRHDRTVHAKDGGVPLHSDGKRRAGPKTRAVGGPSKSSLALDAGALEQMEAGNDSIFDVEAAAMLVADLHHKATASMRDDNSYEDNPSMSYSPHNSSMMESTVTYPSGAIALPQVQWDGFMPQSVTEPKAHSITSSAGSFDSPQAYAAVPGRHAHPHQLPPLSVRNNNGFVPALHAMISSLPNSGAGTPVPQSPSMGEFSQTGFRVPQVSGDDERNMIIDNIRKHDIERSIPDTFRLPGLGSLNRYLSTYFGLFHHHLPFLHPTTFQPSQVSPPLLLAALSIGALYAFDQEQAYMLHIGSKMLVNQFLQNKESFSSRKCPLWTMQATLLNMVFASWSGDPKGLEWACSIKSLLANMVAGNKYELKLRQEARGGAKPSRAEWVEDEGCRRTYYAVYIFFGLLTLTYNHTPAIGFNEFEDLQLPSTEAMWNLTMVDEAAWPEQLQSSSVVSFIDAHDKLFQGENMRYSVFGARVMINALFLEVWYHKRSPEALQDVVTEYKLRLALETWEKSLEFCEPESSSVPLSSPHKGHPLVFNATAMLRNARVRLEVDLKSVQEALRYHDPYEVGAAMSNARERVKRSGEMIKVIEECYNCIQTAVVQGIRWVARTSPTNWSVEHPLCGLDLMIILSLWLYRLEHDEEPATQDELIMYNKVRQLFAKDIDEPLIGNLSSVVARLWGEMLDEVVVWGITRLMGESFKLHAQALVGYVDDPEASSNPSTPSMTSQGADEDSVY

SEQ ID NO: 3452 - protein, 799 aa, Unknown
  Kingdom: Fungi, Phylum: Ascomycota
MRLLTVLSLSTLALASTPSPAGRSVHIPLEKYFNNKGFSSRPGEAALNILNDSLPADEVGTNGLYTSSTTGISYLFPGYDPDPEADDNVICAGQTISIPSSDDYFSVSLLLTSDTRSTTISGNLTLLYSDGTNSSAEVRAHAFWWFLAIRRGEITYPYFHTSNGTNGNASHIYERWGPIEANKTLEGIMLPNTTNGTEGRLHLFSMSLWENSPLDSLSQGVEVQGVRPRQELDDQGHQLVEVLVNNFGTECVSNLDVSLKSGCKEVSTVSPTLVKRICPGDQKRVNIPVKGASNSTAVVSLSTRSDKNSTTAQSFYFEDVSIGIHNYTASAASLKQHEAPQWMDNGKFGIFIHWGPYSVPSWGNSTPHESYAEWFWWYSTRVGKMAPADRSGFNAYRLKTYGPDLNYDDFFPNFTASAYDPKAWVDLFADAGAKYFVLTTKHHDGFSLFDTGASTNRSSLHYGPKRDLLGELFDAAAEHQPHLKRGTYFSIPEWFNPDWAPYGFTQFDRVTSTSHPGIIARNPYTNETEPYTGRVPIDDFISDLMVLQMETLAYKYNTDIMWCDAGAANGTDAFASKWFNHARSESRHVAINDRCGSPWAADYDTPEYATFSVAQRRKWESNQGMDPFSYGFNRATKDEEYMKPQKLVTTLVDMISKNGNLLLNVGPKADGSIHEVMVDNLREGGKWIKAHDEAIYNTTYWYIASQDVTGDLRFTQSDDAFYIFSLTKPKAGEKLVVEVESHGHVPAMEGDKVVALGMEGEEDVEWGFDKEGRFWIEVTEEVVRGDKYAWVFKIEYKNR

SEQ ID NO: 3453 - protein, 361 aa, Unknown
  Kingdom: Fungi, Phylum: Ascomycota
MSSIDEIPRTHKAAIYDKPGKLSINVVDQDTPVPATGEVLVKLSHSGVCHSDLSLMTNGWELPFALPDTQIGGHEGAGSIVKMGPETDKYGFKVGDPVGVKWLRDICGTCVYCVAGEDGLCAKQSVSGMFQPGTFQQYVTLPAHYMTPLPRNLKPEIAAPMLCAGLTAYAALRRAGTKPGQWTVVSGAGGGVGHLVVQLAARAFGQRVIGVDQASKEDVVKESGAEAFIDVADGKDMLEQVKNLTDGLGAHTVIVCAAANAAYAQAVELLRPCGTVVGVGMPDGQQLPIASALPGAIVRKQLRIIGSVLGNRQDAIDVLELAARGIVTLHYQTRGLGELQTVFEEMKEGKLSGRVVLDLNK

SEQ ID NO: 3454 - protein, 272 aa, Unknown
  Kingdom: Fungi, Phylum: Ascomycota
MASKAVANAKVKQEPLDVDLVWQPEIDGELMQLFYLDVCWDFASMDKTNMFEVLVKLQGLETLIPAFEERIRHSDEGFRAWKRLHQFEMDAERAQRIQMFVQMVKRNPIDNTTKTIWNDKKWETRYAWIVRQREELAKIRVICLKQLAMKPSEEAAFFGRQEDRPARITVHKGKNMEVKTAGRRINGNWNLPIDQRLRIAAGGPGTRFDEFREVFWGPVLGREPRLPESRILLPERVIEVKMESDSEDASADEGDKENMVKVKMEPDDHIAT

SEQ ID NO: 3455 - protein, 293 aa, Unknown
  Kingdom: Fungi, Phylum: Ascomycota
MSEDLKDEIEALNSIYGDRTLGPAMGEAPCSNIWILQLPRGDEGEEDDASSLRIRFPPTYPESSAPQVLGTEHASGGRRGAGERDLRLFREAVEGSWQPGAVCLFDAVEDFGRRLQEEKEQEEEDAAEAEGIPPERPEKAEAQMEELLATMSPPPWTLSEVVTDMKSTFIAHVAPVTSPDQASLYIAHLLASDKRIRTATHNITAWRIREDENGSGTTYQDSDDDGETAAGARVLHLMQLMGLWNAVVVVTRWYGGVKLGPRRFAVINAVARDGFVRAGMVTEKSDGGKRKGK

SEQ ID NO: 3456 - protein, 248 aa, Unknown
  Kingdom: Fungi, Phylum: Ascomycota
MDENLNRSKSASSDCLHAGHSNGGKRSTMHLCVVVGDGAVGKTCLLISYTTNKFPSEYVPTVFDNYAVTVIHGISHVDPYEWDVCPAHASSAVLAIETSPKLRAGQRKEALANIESRIGDEPYTLGLFDTAGQEDYDRLRPLSYPQTDVFLVCFSVTSPASFENVREKWFPEVDLRDDPSVREKLSKQKMSPVRKEDGERMAKELGAVKYVECSALTQFKLKDVFDEAIVAALEPPAPKKKSKKCLVL

SEQ ID NO: 3457 - protein, 325 aa, Unknown
  Kingdom: Fungi, Phylum: Ascomycota
MTEGVSSSSDAAAERAAEQARLRKERREAKIKAGGSARLNKITGMGGRPAIDTTDAVPPNSAPMAPAPSATDADPEEVDISQHFYTPERTARTPQDGPQPAIGDEQLRQMMLGFERGNANASPSPMAGDMPPGAEEDPIMKMMAQMMGGSGGPGGAGGFPGMPGMGGMPGMPGMPGMPGMGQQQAAVPDPYTSLWRLLHALVALGLGLYITILTPFTGTKLSRERSVEAHIAGADDEDMHRKNLFFWVFATAEAVLLTTRFFLDKTRAPPSGIVWTVIGFLPEPIKGYAMAIMRYGQIFGTVRSDILALLSNEWRLQMLITRVPD

SEQ ID NO: 3458 - protein, 394 aa, Unknown
  Kingdom: Fungi, Phylum: Ascomycota
MAQFPPPPTNTIDWSNVGFRVREVNGHIESTYTRATGQWTPLRFVADPFMRIHGMAPALNYGQQAYEGLKAFRLPGDNAISIFRPDRNAARMQHSADVVSMPRVPVDMFVEAVKAAVALNAEFVPPHETGAAMYIRPQMYGSSAQLGLTAPEEYTFCVFVLPTGVYHGTHPVKALILDDFDRTAPKGTGNAKVGGNYAPVLRWSDGASKQGFGITLHLDSARHEEIDEFSTSGFIGVKRKSDDDITMVVPDSNCVIDSVTSDSIQEIARSYGWKVEKRVIKYAELPEFTEVMAAGTAAALVPIRSITRRASKGLPAGEKVTTTDEAEVVTYLPESQEEPGQFCVKLLSHLKGIQVGKEKDQFGWRFGVEQKDGGVEGAKGKANGDATPPVDQME

SEQ ID NO: 3459 - protein, 393 aa, Unknown
  Kingdom: Fungi, Phylum: Ascomycota
MVKTTIPIGLVALFLSVPVSAVKLWATTYNDGMVTTLDFSNGDLTVVDKNKDCGTEPTWLTLDKANSLLYCLNEGWGGSASLTSYQVNSDDSISTLDVLPVLKSPVAASLYGPNNGGLAVAHYDTSTFSSYDVSDPTTLVLSQSETYTNAAPGPDPDRQAEPHLHHTIIDPTGKYILSPDLGSDLIRVFEVKNPSTSIEWTQKAGGVATPGSGPRHGVWVESAGQNYVYTLNELTNTITGHKVQYKKNGLAFTKLFDIPSGGPGTTVPAGTSAAELVASPDGKFIIASSRKEASLTIPAFDGSGTIPSDPLITYKVNKNGKLTHVQTAPAGGMNPRGFSLNADGTLLASALQDDNRVVIIQRDVKTGKLGNFVGHATVGLEGETNGPNYVLFA

SEQ ID NO: 3460 - protein, 697 aa, Unknown
  Kingdom: Fungi, Phylum: Ascomycota
MSSDYSYDGEAQFFPFFILTLTGLVTLPLTYTLLRPSTDDDALAPRIKTDYKPEHGDVVQSLRSKQKRSQRRVKRALVAVLGWAIMGAMVYLIMVTQRTVLKIWNPYDILGISDSATEKQIKSHYKRLSVKFHPDKVRPDAAKNETVESMNDYYVELTKAYQALTDEEIRNNYIQYGHPDGKQSFSIGIALPQALVSDGNGKYVVLLYTALLGILLPYVVGSWWYGTKRRSKEGVLMESANSLFRQYDDSMDEAGVIAALSSGKEFDQILTGDQADSGLSKIESRIGAPTASGGYACGFSGKDKAKLEDLENGARRKTLALLWAYLGRTELDDAALTKAKFEVAPIAQALNQSFRAIALAYGNIKPIVGSFQASQHLVQALSPKSSPLLQLPHFTSEIAAAVDGDSKGQSTVQEFLDLSDARRRQLAVGNGLLSEQQYKTVLSVGRQLPYLRVAKAFFKVTGERVIIPSSLVNLVIKGRIVPPGAENVPEINELDLEDVDPAEDDLDAINGRKKTVKGPDGKLITVDSEPVLPPRTFAPNYARDHTPSWFVFLSDSKQGKMAVPPFPFTKFDQPIFDDDGKPTFNMQTLKAQFAAPPQAGHYTFVMHVVCDGYVGFDTRMEVTLVVEEASKAATMAAEDDISEPEEDSIAGQMHALKTGQAPTGGKTRRVDDDSDESGTDEEDDDTSATNTDTEDES

SEQ ID NO: 3461 - protein, 484 aa, Unknown
  Kingdom: Fungi, Phylum: Ascomycota
MLSKSLLAHAALLATALAAPLEEQFEERQACASQWGQCGGVSWSGATCCQSGSTCTKQNDYYFQCLPGAAATSSTTARTSTSSSSSTRVTSSAPISTTSSATRTTSASSSSTTRPPAGSGTATWSGNPFTGVDLWANEYYSSEIHTLAIPKLSGAMATAAAKVAEVPSFMWLDTLSKTPLMDKTLADIRAANKAGGNNAGQFVVYDLPDRDCAAAASNGEYAIADGGVAKYKNYIDTIREIVLRYSDIRILLVIEPDSLANMVTNMNVPKCAGAASAYQECTNYAIKQLDLPNVAMYLDAGHAGWLGWPANQGPAAEMYAKVWKDAGKPKSLRGLATNVSNYNGWLLSSAPSYTTPNPVYDESKFVHALGPLLANAGWDAKFIVDQGRSGKQPTGQTLTEWGEWCNQVGTGFGMRPTANTGDALVDAFVWIKPGGECDGTSDTTAARYDHHCGSASSLKPAPEAGAWFQAYFEQLLTNANPSFL

SEQ ID NO: 3462 - protein, 661 aa, Unknown
  Kingdom: Fungi, Phylum: Ascomycota
MDQDQMETGPHVGQTPSVACERCRYRKIKCDRRVPCSKPASRKHVEALENQVKSLETFISKLASSDDTTRSKLLVGRASASPGQSVHSPTNTRGDHVSPSTTTPDSGNLVLARVREGRMCKLNARKATQFYGGTSLFQLPLSDQAIPVRGNPPGSSMSIQENGTLSTPSTTGQFPFPFSPKDDTCRQLMATFFQHVYQYNMHIYREYFLRDYAASGGPYYSDALMYSICAVGALISTDPELKKLSSTFARHAEAIVFQNLELPDLTTLQSLITLGNLEIGQGRSSKGWLFCGMAFRLTHEMGLHLDPANWSSSSNKSESSLDREILRRVYWAVFIVDKQLSLYFGRPPALYPHEADVRNTIRIPYPPEWESLLDKYISKGTSATAFEDGIRLVGCFVHQVELAKVFHTLIVDVFENRLRRNDATAAAATAHQVHTSLVRWLALLPQSLHWNQWTVGQVPFYVLHLHMLFHTCMIILHRPPRHHLDDEAVAKSEGVEVCYQSLAAILRLLKSYQRYYRFEYLPLTFVQTLSAAAEVVMLKRYLEKSSWDDKDISKPLAQILEAMEAVQDVYPCIQEIKQSIVSSKQQPQTSQDDQEVQDSAPPELDLMDFLQAGAIPFGSWFPGADQDSSSTDLGFLVTDDSLNEPQAWSANLGAGYTQPWG

SEQ ID NO: 3463 - protein, 473 aa, Unknown
  Kingdom: Fungi, Phylum: Ascomycota
MSYGIQRLNVKRSQPNPKIVFIKPLAGPDEKIAQDFLERIAAQCLPVMRDNTLSVMSLEEFPPNREFVGRNFNAGEVIQLVLKSPSTGRWLPFEYVQMVMMHELAHCKQMNHSRAFWAVRNQYATQMYGLWSKGYTGDGIWGRGASLQTGEWEKNTVLADEVLPEHLCGGTYRSRGRKRKAKPKLSYQEQKERRILKKFGKNGMALGADEDTKVKLEKGKKVQGKPRVAGSARGRELRAAAALARFDQAKSEPDIKDEDATASGSESEFEDADIDFKDALDLDGSRLTDGKGRGMIKICEDEVQDDSGARDETKELRDVLRGKVKTEFVDIDDDTGGTSPGDSQHKVTTEPRQPLSLWDIPAAPSALSKGKTQVKDTSPSKDRGSTQPKTKGPTNGRRGSSAAQSVEAPRQVECPICTFSNDSTATRCDMCANVLKRTADSKAWACNSEMCKTKEYVNAGDCGLCGLCGKKKP

SEQ ID NO: 3464 - protein, 968 aa, Unknown
  Kingdom: Fungi, Phylum: Ascomycota
MFTFCPLQGALSEGLSSQSLLELDGGVKILVDVGWDDSFDTEKLKELEKQVPTLSLILLTHATASHLAAFVHCCKNIPLFTRIPVYATRPVIDLGRTLTQDLYSSTPAAATTIPQSSLSETAYAYTQTASTAHNLLLQSPTPEEIARYFSLVQALKYSQPLEPLPSPFSPPLNGLTITAYNSGHTLGGTIWHIQHGLESIVYAVDWNQARENVFAGAAWLGGAGGGGAEVIEQLRKPTALICSSRGGNKNSSGGRAKRDEHLIDMIKTCVTRGGTVLIPVDSSARVLEMAYLLEHAWRADAADENSDGALRSTKLYLAGRNMSSTMRYARSMLEWMDDSIVQEFEAFAEDQRRTNGNDSKKLGGPFDFKYLRLLERRAQIAKLLSRDAENVETHGRVILASDSSLEWGLSKDLLKGLAKDSRNLVILTDRPSGGSTEKPSIARTLWEWWKERKDGVAVEQSRDGSNMELIYAGGRDIEVKEARREALEGEELALYQQWLATQRQLQATQQAGGAAGLEATADAVDDASSESSSDSEDDGEQQGKALNVSTALGTAGRKNVVVRDEDLGVNILIKKKGAYDFETRGKKGRERSFPLAVRRKRNDDFGELIRPEDFLRAEEKEDDNADGMNIAADDDKLGKKRKWDDVVKGARSANARRPQMNRAGSAEQGEGEGGTTADGFVADELDDVEDAEPEEPVGPSKLVWQSENVTANLRIGYVDFSGLHDKRSLNMLIPLIQPRKLILIAGSQEETMTLAEDCRVAMGLGGSEQGKHIGDVLTPAVGELVDASVDTNAWVVKLADPLVKKLKWQNVRGLGIVTISGRLLASALAAQSQDDNLDEDASNKRQKTEPSSAVVPLSSNLATTTSLPTLDALPPTQQQRISASRPLHVGDLRLADLRRAMQGAGHHVEFRGEGVLVVDGTVAVRKTAEGRVEVESVGLPMAARGRGRGTMYEVKRVIYENLAVVAGA

SEQ ID NO: 3465 - protein, 87 aa, Unknown
  Kingdom: Fungi, Phylum: Ascomycota
MDMLSQSEQRTLEQRMQKRQVKEFMSAYGGLVEHCFDSCVNDFTSKALSTSENGCISRCVQKWMVTQQRVSDRFQEHNAQLSQQQQR

SEQ ID NO: 3466 - protein, 362 aa, Unknown
  Kingdom: Fungi, Phylum: Ascomycota
MGPGGKNVNFDRDPNLDLTGEPEGKLARASEKYKVDAEEPARINATMLALVRNNEVDAMVRSMVDLERTWNHKFNYPWTFFNDEPFSEEFKKKTSGATKAKCRYEQIPDEHWAMPNWIDDQIYEESAKVLKENGVQYGNTSSYHRMCRWNSGMFYKHPALDNMQYYWRVEPDVRFFCDVDYDVFRYMKDNDKTYGFTINLYDDPKTLPTLWPETVKFLAEHPDYLHEESAIKWLTDDIARPKHNQKAQGYSTCHFWSNFEIAKLDFWRSPQYEEYFAHLDRAGGFFYERWGDAPVHSIALGLFEDRKKIHWFRDIGYQHTPFFQCPNSPKCSGCTPGRLTDGEKWLHQDDCRPNWFKYVGMG

SEQ ID NO: 3467 - protein, 293 aa, Unknown
  Kingdom: Fungi, Phylum: Ascomycota
MATSTYLLVLATALISLLLSRSPYLMSSPAPTKIWADSPMRLVTTPQFETQKTDLFTTGATHMALLHNSIIRSFNSIYNQANHVSEADKPDFVGYALTWHRFVVSHHDDEEANLFPKVEEVLDDKTIWGETREEHESFLGGLEEFRSYLTDLPAPSDFSGPALVRIMDSFKAPFEHHFHHEIAVIASFASHPNVPAPSTPAADTAAAIFKTWGKKTVSKAGMTDVIPFFLMNLDRTSEGGLWANWPPMPGPIRWMMVNVVGSWYGSWWKFASCDAAGQPQELYALRGADDAKA

SEQ ID NO: 3468 - protein, 460 aa, Unknown
  Kingdom: Fungi, Phylum: Ascomycota
MVQTTSLSQGQLEAISIIERVNSVLSLLGSLFIIVTFCFSKAFHKPINRLVFYATFGNMLTNVGTLMSRSYNSEPNSVGCQFQSFLIQMFMPADAFWILAMAINVYLTFYFKFDSRRLRKMEIPYFITCYGIPMIPAIVYLFLENKDGQRVYGNATLWCWVVPEWGLMRIATFYGPVWILILLTFFIYIRAGRTIYEKRRQLHDFSNSDPDPLSVNGEGMGTIKTTEVRITTEIRNEPENFDPMSRRRRESDAPADGRSARDAYTITISAETDPYAHHNAAMTQAVEPSFPRRPVTTARRRTYEVNNAAWAYTKCALLFFTALLITWIPSSANRVYSFVHAKSSSPPLEFMSAFVLPLQGWWNAVIYVVTSWKACKNLRYDWRLTRRPSLAELVIGKHTDDSGGASGMRSQARSQNHLRSGVQLSDLRPGNKSSPKNSETESMTEFAHTRDTSEDEGPRV

SEQ ID NO: 3469 - protein, 615 aa, Unknown
  Kingdom: Fungi, Phylum: Ascomycota
MAALGVGSLATAPDSEIMSGLDDPKIARSSSDDNKEGRLGRIGSSNTIHTRPQARKLHDKNVSFEEYYYYAQKTRAEEDLQPQTKREQSWLSILFPSKNSSGVAQVDSHGDSHKGKNLADPRVRANISDKEWANASRALRTASRGAIFYLITTDILGPFGLPYAFATMGWGPGIALFTVFAVMAGYSGYLLWDVFLGLDSYQYPIRGFSDLGYRLYGPWMRHLFNLLQAIQLILNVGLIVISNGEALSQAAKFKLCFAICCLIWAVAGFVLGQVRTLQKFGWLANASVWINLICMFITMGGAAHSAPNYQGAAQAAGASIGDGSSVKPNAQGIFPPVTTTGGLPPSPEFYGSVSGAMQAIFAYGGSMIFPEFMAEMQRPRDFLKAMWCAQAFIYISYMFYGLFMYGYQGQYTVNPSYLGISKYSIQTAGNAFAMASALIAAALYGNIGVKVIYNNILMEWFKAPSLNSRGGKFIFAAVIPIYWAIAFVIAAGIPNFSGLTSVVAAFCILQFTYTFPPLLSIAFWMKKYSMQHGEGWDPATGEVTHHDRGFGRAMRGFMGGKDNRRRGFISIFNVLYCGGALAMAGLGAYASITVLKNAFAANTTNSYVCKSPLQG

SEQ ID NO: 3470 - protein, 608 aa, Unknown
  Kingdom: Fungi, Phylum: Ascomycota
MTVNHSASTNGHTETSDGHNASGNCLDVPVLVIGGGPAGLLQGYLLAKLGIQTLIVERYPERLGAPKAHALSPRSLEICRQFGLDLEHIRSLGAQRDDAYWVNFLTTLSGDVVGRLPYERMDAGVLDHTPEMIHNISQPDFEQYVAEEIAKLDNIEIRKGVSFVALQDAGNVVTTTVEERATGRFYQIKSKFVISCDGARSKVREYMGIESDGEDSYETMMTIHFSANLRSIVGDRVGMLHWLFDPLASGFIIAYDLSGNAVLITNFDSEKYPPHAWTDALCKEVLTGAIGQSHSAKILSYRPWILSRRVAKSYRKGNVFLAGDAAHSFPPTGGLGLNSGLADVHNLAFKIAAVWKNEAEDSLLDSYEMERRHVAEVNSRQSVKNGRAIFGLLKTLGTAGIADVEEARHNLKAAIFDPEQMKKVAIGVEEQREHFDNLNLHIGYVYGDTSIPSSASHFTPSFQRGARLPHTWLGDKLPSFVREQLKPVNLGYVHELSQEEVEAKKYSSLDLCSPGAWTLLRPSTASSTEEAFVSIKKKQKGFELNILKLGRDFNVLSGPAGDTWLRDSGLESGRGLLIRPDQHILCSLSSDATPEDLLHTVKGFLGVS

SEQ ID NO: 3471 - protein, 630 aa, Unknown
  Kingdom: Fungi, Phylum: Ascomycota
MRLIQAFAIGASVLVGIVEALPSRAQAFAKRQVTELRDEYDFVIVGGGTAGLTVAHRVSAAFPKKTVLVIEYGKIEGTVGYFDPPEDGRGASRLVISSPPVASVNNRAATVILGMTVGGGSAVNGQFLDRPSKYDYDEWANLFEDSAESWDWENFGPFLEKSLTLTEPSDELIDQYGYTFDSSYYKGSEIEGSFPPFQWPIQRIAYDAYEEFGLDTPATCDDGDKHGVCWVPSAQNSQTVERSHAGVGHYTRVADSLPNLDLLVSHKVLRLVVDKDEKVPAVEFRPVAGGDVKTIRPKHEVILSAGAIHTPQILQRSGIADAKYLESEGIEVVEDLSGVGQNFQDHSGVPIVFSFDSPSPSEAEINSNETYAAEAVEQFRERPARGPYTLAMGNSAAYQSLQEVTPEWENIVADIRAQISDRSALKFLPSTAGETVQEGYLAQLEILAQALEHPEHPILEMPFHTGPGTAFLLKPLSRGSVVLDSSDHDATPIVNYATGANPVDLDIMATYADYFRRLYSTPIWAERNAVEVAPGANVTSHSALVEFVKNTVIQSLMHPCCTAAMLPREMGGVVDTKLKVYGVRGLRVADCSIIPTIPAAHTTTTAYAIGERAADIIIKKWKKCTSKRKA

SEQ ID NO: 3472 - protein, 675 aa, Unknown
  Kingdom: Fungi, Phylum: Ascomycota
MVKAAAASKVAAGPGVYSATYSGIPVYEFQFGGDLKEHVMRRRHDDWINATHILKAAQFDKPARTRILERDVQKDTHEKIQGGYGKYQGTWIPLESGVNLAQRHNVYDRLRPIFEYVPGNESPPPAPRHASKPKAPKSKPPLPKWTNPVPIPEEYDNGDTLMEDDTPDNITIASASYMGEDDRFDMSHMSTGHRKRKKEEQAQDFIEAQHSLYGDELLDYFLLSRNEQPAVKPDPPANFQPNWFIDADNHTALHWAAAMGDVDVIKQLKRFNASSSVQNKRGETPLMRSLHFTNCYEKQTFPVIMKELFDTVDARDSTGCTVIHHAAVMKNGRAYSPSCSRYYLDNILNKLQEALDPSAFQQLIDAQDNDGNTALHLAVQANARKCIRALLGRHASTSIANHEGVRAEDLIMELNASKRERGPQRSSSPFAPDSQRHASFRDALSNDRSTSRRAVAFHSAAALSVQSRVTPAIQDKFQELAKSYDAEWHEKNTAESEAQRILANSQAELHLVRQQIAELEAQLESDEAAAKVKNEANLATHQVLSLITHQNRIHVQQAVDSELSKMNGDTSDDSASYEDRLALARHLSQILADQRAAEVEYVDALSMVGTGDKIEKYRRLLRRCLDPKDGEELDANLDSLIEMMEEDRPGPAADVDGAAAPPIAVGETMDFSVGA

SEQ ID NO: 3473 - protein, 529 aa, Unknown
  Kingdom: Fungi, Phylum: Ascomycota
  misc_feature (240)..(240): Xaa can be any naturally occurring amino acid
MLDLIHLTELPPHDLEAARESDNMTESFGIGLNTLSNLRDEWVNEFDWDTEQVELYKLNQYETTIESLKIHFVHHKSSEPNAIPLIALHGWPGSFMELTPLIPRFTKAPKGRHEPTFDLVIPSLISYGWSSPAPDGWSITDSAHMFNTLMTKVLGYDKYAVHGTNWGAVVAYQMYTNFNESNRAAHFTIIPFTPQSEAQLEEKNITLTEGEKFQSQRSNDWSLEDPVAVAEDIRQIAKYXYSAATSSASSAEAASDRAGPTQIQSSGKTKDGRTLKPRSYPKFDNLEDERLYRKQHLAAAFRVFADRGFDEGVAGHISVRDPILTDHFWLNPLSMHFSLIKVSDLILCDEDGNVVEGNECVNGAAFAIHSEIHKARPDVTAACHAHSVHGKAFAAFGRELEMITQDALRFYKSHGVYREFHGVAVDADEGKQIAAALGDGKAAILQNHGLITVGKSVDEAAFWFISLDKTCQAQLLADAAAAGGYEKQIINDEEAAFTAQQVGGPEKGWLAFQPYYDEQLAKTKGDFLN

SEQ ID NO: 3474 - protein, 467 aa, Unknown
  Kingdom: Fungi, Phylum: Ascomycota
MTIIGIPVATKKQHPIASVVPESGIPEKLIKPWKLPPRKTYILKNARIVDPLEHSSTPLTVVRISGGTIESIDGSKESLCELRGNVETVDLEGRYLCPGLIDCHVHITAVAGDASLSGAISSADQEPSHFRQPYLCGQMLSRGFTTIRDTGGGTLALKEALDDDVFPGPRLFTANKALSQTGGHGDVRGTHDVDQGCCSKASGISVVVDGVPECIRAAREQLRTGGDFIKIMSGGGVASPTDRLENTQFTAKEIQAISEVAESFGTWVTAHAYTPKAIRHAVDNGVLGIEHGNMIDKETAEYMAERKIWLTPTLVTYDAMGSDKYAGFLPPANRAKNQAVLKAGLESLRIAHAAGVVICHGSDLLGPLQAEQSREFEIRAQALSSTTVLQGATVNAAKMLRQEKFLGQIKVGFAADFLILNQNPHEDVSILSQPEKSVLAVVKDGRVHISRWSKLPVDVQQITALIE

SEQ ID NO: 3475 - protein, 2050 aa, Unknown
  Kingdom: Fungi, Phylum: Ascomycota
MARDDLRDSTWEEDTVMLHHDDVSDFNQDNILPLEADKLAKVRAWLQPTVSEGEGSEFTKHSTAHLPGTGEWLLQSPTYQEWHEGKDKGLLWIRGIPGSGKSVFAATLINHLRQDRVPVLFFFFKQIIDANHQPIAAVHDWLVQVLPYSPPLQVKLMTYLTARQTLESLSIVQLWRDLLMALRDIPRAFIVVDALDEMDRGDEMQVFLQHIAELASWRPAHTKMLITSRPVAYIETALRRANAVNIRLVENAVDVDIAAYVSHHLATSAIKAEDQALIRAAVPGRANGLFIYAKLAMVAFLQPGADVRSVLDILPRDLNVMYNDLLRQHAARSGLPDTIQLLILQFVTHATRPLRLLEIASLINVSQYPPEKRDLKAMKELVRVACGPLLEVLPDETVSVIHHSLTEFLTGATRDIEDGGYPILDGGITHHQLSLACLGYLDMEYLGNANLKGENGTREDAIYDGLRRDTFARYAGANWFVHARKAALAGADQADLLPLLDDIFGSHKLAEIWSMSKGGTSSIQRWMDGEEGHTSQIRPVYIACTFGLNEYVKILLSGASVEANKGPRLYSESLLLAATKGDAEIVDALLKAGADPDERDRKPFSGKAPLHYAVEHNHPKVIKILLDGGADPMRLTFFNDPSSFGHRDPSAFEWACTKGHLAALQTFLPYIKSERAISEALSWVASTGRADMLAAVLAHPLARVNDKTCCLTPLFLASGKRDAPMVRALLAAGADAKTLHDSPGWGVGRDEPDFGNTALHAWAAFETRLDYDADYYHEMYKEYDAEATVEVFRLLVDAGADINQRNMGHCTPLHFAQDAMAARLLVEAGADVDAVSRRDRTPVELSRDRATVQYLLEEGGASKHLEKAMSSLLFNRNDWNSQFVCEEDAVEMVQLLLDHGADPNIVDREGRTPLHHLVNHGAGNGAMRIELMKGFLRAGLDVNVRNAKGQRPLHVLSLKTEHEQDDAVFLDAMLEAGADIEAKDDLGRTPLFFRIDNLERSMHQKTMLSACKVMASKGARLDTRDSSGRTLLHAAMNQGTGAVITWLLDHGVDPKLTDNDGNTLFHEMMKPQMMYRNEHSRTYSICQNLVSLGVDTQEANSAGRTPLHMAISEGAWRFDNRQPEDTGPATMLDWILGRQHDVDVADRYGITPLHLAATFSEGSAEKLAEKLLEAGADPLKPTVEGLNCLHLAARARQANIIAIMLETVAARNCKGKVLPLSTGTGSTTQHQRSPLFYACASGQPESVEVLLKAGMAVHTGKYLDSALQAVVGFEEEAGHWPSEPTEYQDDRRCVGSVTLEDRFRKAANSSPRPTARIEEILHMLVVKDELFIKEHIGEAIEEATERKAAYILECLLRIRTRLGVERGASDTDAIEALLETRQEIRNSFEEKLATRGSLTDREFIAAMTGRFFDIVVKSMSPENSLKLVKEDSHTLTRLQYLALGGYAALLSEVGHVESIKLLEDAKWVEKVEKETYIQQSGIRSLLITACARSLPNMAVVKVLVEKFGVGVNRSDSSPRMGYHYQGDESASALHALAMGARWWQLAEGIPYLISHGADMNVRDGGGSSPLNTVLDRLKCCRWDFSKRAFQVLLDHGADVTSTDNQGVSCVQRAIHDPEIHRLTLFHVPSISSHDLISAIESKNPVAVETLLEAGADPNGRDVLEVNEFHSGSPMLLKTKHNEMFPLEVAMTFFKYYDDPSVQPKILESLLKYGADILATYGESTLIHQLLAQHVGEPFRQLLEKGIPGLNPNCTDANGVTIFHMACTYRGNVKTSRNEAGEIVYSRTDDRPSPAAVLLSLDADIYARDKSGRNALHHLVSQSYGYIDVDMVRRVATLAPELTNERDETGKTPLNMAVDDKWLTGTKVVNSLLDAGADPTIADSHGNTALHLLLGHKFHIDKLTSTVESPRATIIDSLLAVPGVDLNAPNSEGETPLFAYIRRGGSACNNTKDHVHTLDNDEKWEGAMMDYLDARGANWSARNGAGKTLLHVTVEAKEWDLRKQNFKVPRTKYLLRKGVDPAAEDLHHRTALDYATSLGCEEVLNLFRHEA

SEQ ID NO: 3476 - protein, 265 aa, Unknown
  Kingdom: Fungi, Phylum: Ascomycota
MLMDPSQMGDHRLGHSPFGGPSSVVASLYNTMPPTTQAPQSQHSSNRLKRPRLDDLDISVATMSPLDQPGLDSIHNTPIAGPYSQSQAAPQQHHHHHLPDSGPPSKLARREEGGGGAPSVVGQVGMPQPAARPRGPKLKFTPEDDQLLIDLKEHKNLTWKQIADFFPGRTSGTLQVRYCTKLKAKTTLWTDETDHKLRTALQDYENEKWRIVANKVGTGFTPAACRERFEQFLTGMPPSSDANLTSPPVSAATMGESTMYTQQLR

SEQ ID NO: 3477 - protein, 489 aa, Unknown
  Kingdom: Fungi, Phylum: Ascomycota
MDKLKLILEGFPLLDDAYSSLKDQDVQCRKQADAVTKQLPETARALISAHPREALEHLSLSKNTISYAAVLDVVVKPSGIDAGPDRIWLQEKVAEFLGGFDPIQIRFVGDTLVRLLTRVAGNGLFTPQRTIQLLATAILRVDPSGSVFTSTHLLLANHALTLGIIELALPVLDKYITAYPSLTSLRGNRPLSDPELPPAYYVNTFTGLTEPVKAATVLDYGATLAQIYISRKEWRKARAALEQVITHPCKDKGVVKAMAAAHKRWLLVSLLDIGKAGTLPSYTPSNAKSYYKAQAAYTSLAEAFVASDPEQLQTEINTHGITYEEDGNTGLVSQVLQAYQKWQVINLRMTYSRISISRIREETFSGETGQRLPSTEAADSLLREMINSGILKARFEVDEHGNETYLAFQDDTDHVSEEEFMKEIARRQQSVEDLTIEYKLVNQRLTMNKEYAKFVAREQKRQPDEGTQPAGYDASLEDEDLMSGILKAN

SEQ ID NO: 3478 - protein, 586 aa, Unknown
  Kingdom: Fungi, Phylum: Ascomycota
MAPPSPRRSSRAARPTNSQSNQSSVSSSTTGRSERNTRSVNKPASGKSTPSGSLSSEPPDEFEDTLLSRRRKRGVEEDSERTSRIDDYEMATTNDEDLQDEEDEAVRCICGAEDYPGRPPVEGPEAEFFAGIELTEEVTGFFVQCDVCKVWQHGACVGIFSAEASPDEYFCEQCRKDLHKVHTASNGQKYSKFLPLHQTSRTTSRATSLAKEGTRSPRSGSKGARARQGSVNHLGKRRSTMNSRDAAYDDEQLRRAIEASKEDPSVDGLEGVIRRPKRGRSDSEDGATNVKRQRTSSRSASPTVEGPEPANGDDSDDEGNARNSNKKARTSRPQREKTEREERERQRQEAADKRKGRAERRRADDSDPSDELPLAAKSIKKSVEPSHPAESHNTTARPTPDTPPPVPAVVASTLKRGARSTHKKTKGRNQYTKDRELDNDDSPARSMSRDIAKATEDSTPTTHSKPSTDHKHGPKSKTGLPNKMTMLDMKRRVAAIMDFISRTQIDLATEEIATTSSNSTSASASDSPTKKDTPGPENGVTGADDESRSLGVTAGEAQDKEFKNLNCMEMMDVLTRDMVKWQNQYV

SEQ ID NO: 3479 - protein, 547 aa, Unknown
  Kingdom: Fungi, Phylum: Ascomycota
MQPEQFFTAVCGGPLTANTAINKDIGIYHQNLIPYSVSHAFKKSSAPPHCLAVSDTHVFTAQENKATVHVYSRAKGNQECFVSFPERIRCIALIGNVLVLGTIEGRLILWEVFTGRQVITPACHVQGVTCLAVTPYHILSGSDDANVNVWSLARLLELDTQAEHEPEQILSNHRGAITSLVVSPSPNPETNFCVSASKDKTCIVWNYHTGQVLRTLLYPTTPLCITLDPAARALAAITESGDFFCTEFFGDAPMLGSRAAEQASIVMQVVSPLGNALDEAGAANCLAMNYDGTCVLSGHTKGKVMRWTLREAEHPTEVASLNSSVSNIVFIPRTTAKVVPIQQYVIKPHLGLKKYNISAQLSASTESESRFSRLSRGEGFSADVLEESISSFMREKEGKATTMSNGEGSGSYDDDALRAILALQLLTYTFDRSIMSAVGTLRGDMPQQVRSLYRQLLRQGGQFTAYNFREYAKRRTRDAFHDNKSIEDPRKVQELVQKGLSELQVMKRQTVIGQFYQLDRLVVEGGISGKDSGGEGQIVRQKIPGYD

SEQ ID NO: 3480 - protein, 1230 aa, Unknown
  Kingdom: Fungi, Phylum: Ascomycota
MTSGGRRTMPPNNQRPATNTPASPRSTAKYTNKDGSKFITVPKAAGGQLATTTSDPSATSPLATPASSNPSADANFDAEPAPAVNRKKQKRRQKAAAKAAAEHAANGHPTPTSKATRTEHGTVDDDAGESDNDDDHDDGDDGTEPALNGHSSYQASSKGKKNKKKKKKAGAHSNEDLLPSETIPESHTPHTLMHRGPSFSRDKIWSTSNHEERERIKEFWLGLGEDERKSLVKVEKDAVLKKMKEQQKHTCSCTVCGRKRTAIEEELEGLYDAYYLELEQFANQGEGPPMLAPPPRDYPTRPLRGLPSPYPTQPPARGRIVEHVDLEAEDDEVEEIYSEDEVDDDDYSDDEPPDDYDDSHERDVADFLTFGNSLQVKGTQLLDSFLSKYGNKDLGGILTVADDLLKNDGKRFIEMMEQLAERRMAREEDAREHVSRGGYGHPNGSYSSPHNQPPPDEDDYEDDEDEEEDYDDSQDEEYEEEEVYSNPSVMPPGPHAECCCQDQMTEEQRMEEGRRMFQIFAARMFEQRVLSAYKEKVAKERQQKLLEELEEESRQVDEQKAKKAKNAQKKKDKAAQKKQALAEEKARKEAEKAAEEAARIEAEQRRINEQKQKAEDKRKAREAQKRAEEEARLKKEADRQRRLHEQREKQAEQERKAREAKEREKKLKEEQRLKDKESREQREREAQERKDKQERDKRDKEARAAKAAKDAQEAREAKEKAREEKSSAQKPQPAPSQQAAQPPTQPAKRTSASTIPVPTVLPQHPPNPANFASPKIAVATPAIPKVPTPIRPRNASQQHDGTQSASQSASASASSQNPSPHPMTPGQASPGPIGGQRKSSGSTPGASHIPQSTSPPDGHPAPFQMPLMGMQPPPGLSHHGPPPGFPGRMPQDPNFSPAFRPGPNMMMPPIGMNGPAGRGFPPMPMGPPPGFAPGPADGFGMGGPPIPQHGRQGSAGFDGPLHATTPAQPIGRPAPIGRPGSVVHGHSREEKDDETKHLGSSALVDDEDDTPELNVGSFRNNHQPPGPRGFGASPYLESAFPMTGHANPWGPPAPAPNPFASPAFGHAAAAWGVTGPTAPPGFHVGSPVGGMPGFRPVAQPPRHVAVRLMLCQACRDLGNSQSSDKDGFVDISAVKSHVDSLSGGDTSISEQDLLDLCDTEGSHSNGGGTFDVRRDEAASKDKIRFVPDQHPALAGLNGSMSGGPQQFRAVGAPGEIGSPLMGQASIRGGV

SEQ ID NO: 3481 - protein, 765 aa, Unknown
  Kingdom: Fungi, Phylum: Ascomycota
MRQHLCPTLILQRPTTTRAPIARTFKMGDDGMLLNFDLGSAPVKSRIQFKGGNWRDRKRAEKLANAGAPKASRDAPDDDLDGAQGPSKRRRVDDDDLPAAYNPNTGGENYSGGRPGYTGKQEKRQPQDPSKPAKQVVSKLFSFNPQQKTVFEDEEPEWKAPEATNAPLELANFGSLKISSRLVEELGKMRLVRPTAIQNKVVPHMMSSSGDAFVQAETGSGKTFAYLLPILHRVLLLSSKVGGQKIHRDSGLFAIIVAPTRELAKQTHIVLEQLIRPFPWLVSTAITGGESKKAEKSRIRKGVNFLVATPGRLADHIDNTKALNLGTVRWLIFDEGDRLMDLGFEDDLKKTIDALKKIQVVMRTPDGTPLDALPERRVTVLCSATMKMNVQKLGEMTLADATFLAADKGEDDTIETANKGVHKAPAQLHQSYSIVPAKLRLITLITYLKATFARRGRTMKAIVFMACADSVDFHYELLKVPAEASFGEPLPKEAELISKTVGKAAYVTSPASPEVVLHRMHGSLSQPVRTATLKSFSACKSPSVLITTDVSSRGLDIPSVDLVVEYDPAFSFSDHIHRVGRTARAGRSGDALLFLLPGTEEGYIELLKASSPPSHQTYEAILQKAFMNKMEFPVDTQAEMSEMGTSHNKAETLQLHLEQRLLADTKLLELARNGFKSHIRAYATHTREERVHFDITELHLGHTAKSFGLREAPGGIGSGLDRKSKKGGKDKGKKQEDGEGRPAHHILNQKSRMLMSSAADEFNIG

SEQ ID NO: 3482 - protein, 684 aa, Unknown
  Kingdom: Fungi, Phylum: Ascomycota
MARNGIRSRSGCFTCRQRKKKCNEEKPTCSGCKRNCLQCYWPSADSVRGCVKKTTKEKAGVVRRPLHPSRNADEDPAPEEAAASADPLSPSRRHATQITSVDTQHQAVTASVARSDSMSSARRDSYSPRSPGGSFHMFMLPDLAIPQAEPLPEAQASLPVTVSCEWEEDDDNVFELEIGHGAFTAGDLEAVSSYSSISASSSKKTGSTPSPTHPIHSGMLRPEQVDAETIAGDMIAGGSEIIHDSIITDSDNNVDTLAAPGCLEAIGEAELVLGSPAHEEEPTAGTDTSMSIAMPGRMSLLPQQDPDAFHILSFYLSRTANCMGNGSTDSNPFLSTLIPLAFSDQLVLQLLLAQGAAHRQVGQAQTNGDQIAQRYYTGSLRLFRSAIREYISGKFTDKLVLATGSLILSLTEVARGDIEGNIFDHIIAAKSLLVELSVEKKSSVPDDFMDFLIEYYTHMSVLSMMSVKPQLSANPLLDPTIETLARKLIEKKYIGQLVGCWLELLLAIPHTFDLGQKMRSSDGPSPDDMVMFGLLQAQLIAFEPDTRASKETRLAALVFKQACLLYLWSILGCPQEGDTDGTHSNLMKTAVTEGIALLEQIPPTSRVNTSLCWPLTIIGCCTTERSLQSILRTRLQTMFSIIGLGNMGETLLLIELVWAFPSDKRSPWVLCELMQEQQRWVSFA

SEQ ID NO: 3483 - protein, 647 aa, Unknown
  Kingdom: Fungi, Phylum: Ascomycota
MSDVSAGPAHKVRKLRKGTHSCQQCRRRKAKCVFDAGTARACIGCTSRGLECYSQVRSAVADETTRPGPTQEEAPVEDLTDRLSRLEQLISNMASSGDPSNEPLPLGSVAFDPEQVFASPPSTSVSSISYQDVLDTSVVQNARIVTSSDNAIFLSGTPLAASIFGSSPSIGHSLSGAPSPISTKLYALLPSEATSSILISNGPSMFLGPHGPVSHAAPTRPTDHPTLIARRLMMLALCLQQLPSSFDISTLTFHGTNGTKDPATIIRDWVQNVSSFVTSDDSLISNAEGVETLILQAIVQADSGHLRKAWMIGRRAICIAMLLGFQHDQPSHATTASSCNPGEFVPSQTMESLWFRANCIDRYASLVLGLPPTSTDNKFASEPRIRNNSPEDRLGKAYAVAAGSISERNNRIAAGQDGLELTRSVELELESVAHLMDSAWWHSPGLRGAGSGLSDELMVMNLQVRHYVLTVLLHFPYMLQQTQQDTSAQEYSRSACMHACRAVVHRFLCFRRVYKSIATGRQIDYAALLSAMTLLQGHVLHQQTAGPYPEGRDSLQTADVELVDSARQIMQDIGTCNAGDSLSSEAARSLQELLDYLLCHGGQQGSMTDFGAEMINEVDWRQDLLATPADDFSNGLDPALVFPVKTF

SEQ ID NO: 3484 - protein, 490 aa, Unknown
  Kingdom: Fungi, Phylum: Ascomycota
MPSVLPQVNMLGGLGASASATGPVVSSPASTDPYVYQNGFGNRFATEALPNVLPYGCNTPQNLKYDLISEQLNGTPFVSPRASLLHAWFYRIQPSVVHGHLTDLPQNPDLQAVFSKSNPEICFSPQDRGWDPFPISDAEEGVDFIRGMKTISGHGDPTVKDGLAVHVFTANCDMKNRAFCNNDGDMLILPQQGRLDIQTEFGRLMVRPGELFVIQAGMRFTVGLPDGPARGYIQEVYGSHYELPELGPMGSNGMALPRDFEYPMASFDIDQSKWQVVVKLAGELFSYEQNHTPYDVVAWHGNYAPYKYALEKFINTATVDRDQSDPSVYCVLTAKSKLPGVALSEFLVFTPKWSVTRDTFRPPYYHRNVATEIMGVIYGTWGGSSTQLSPGGLTYEPSYMPHGETYDRWKEATSADLQPTRVGENTMGFMMHISGHCSLTKYALERTGCLQPLQDGMWDDFKPGLLNHLDQIQADLAKAGLPGLSATPKQ

SEQ ID NO: 3485 - protein, 1063 aa, Unknown
  Kingdom: Fungi, Phylum: Ascomycota
  misc_feature (944)..(949): Xaa can be any naturally occurring amino acid
MLTPDPRSDQDSLRSYRRLVERDQCALFFTKMARRWLKDVKRTFKRPPQAAPSESVPAPSLQSPSLTDALCVSPKTTRSMSQSARSAGTSTYTETVTLPGLQERLWNDAYDRLKSSEPKLVEVYEQILSSILDGNETNSTTCEPTENVIGATKETRSLQMQQLVRKGLDQTQKQASVKQAINEGLQVWQAVRGTVDKAVQMAPEAAVAWAGVCLGLEILSNPITESRENRNGIAYVLSRMEWYWSLVSLLLGENTSAESTAGLRDQLRQSIQQLYEKLLLYQMQSVRLYHRQWAVSIARDLLKIDNWSGQLSDIKDAESAVQRDMEQYNTEESKTQLRELSDTAKTMQKSLQGIYSVIQDQTEQQGNWRRDDKYEQIMKHLRETDPRDDKTRIQNAKGGLLWDSYRWILDHEDFRKWRSDPQRQLLWIKGDPGKGKTMLLCGIIDELEKEPSNLLSYFFCQATDERLSNATAVLRGLIYLLVARMPSLVSHVRAKYDHAGKQAFEDGNAWEALSKILASILNDPSLDGAILVIDALDECKTNRHQLLSFITRPSRVKWVVSGRNWQDIEESLSSTEHKVWLQLELNQDSISKAVDTYIGFKVDQLASLKNYDKPTKDAVRDHLSTNADGTFLWVALVCEELADRTIIRNRHTLSQLKKFPSGLGPLYIQMMKQISDSRDAKVCKEILAIASVVYRPIALEELKIFVESMEQDDYDDLPQIIKACGSFLTLRKDMIYLVHQSAKDFLLDKASDEILMSGAAHQHHGIFSNSLAALSKTLQRDLCKLGAPGFPIDQVSSRDLDASASIHYACVFWVDHLHGSNTTTIRTVLQDNGEVHRFIREKYLYWLESLSLLRSLEEGVKAMQKLEALTRALGGQQLTELLRDARRFILSHKSPIELAPLQAYASALVFSPERSLIRSLFHHEEPDWMRLGDLSSVLSGWPAXXXXXXIWDPATGSCLQMLEGHSDQVTSVVFSADSQRLASGSHDNTVKIWDPATGSCLQTLEGHSDWVTSVVFSADGQRLASGSWDKTVKIWDPATGSCLQTLDVGKPLYRLSFDPTTST

SEQ ID NO: 3486 - protein, 91 aa, Unknown
  Kingdom: Fungi, Phylum: Ascomycota
MTGSNNNVGNQAADAGQFVTSTLGNTLGGLGRTVGNVTGAATRGVGDTVTSATGNTGRPVGDGLGNIGTGLQDGLNGVSKGVEDAGQWKKQ

SEQ ID NO: 3487 - protein, 612 aa, Unknown
  Kingdom: Fungi, Phylum: Ascomycota
MGDRGQLPDNLIVFGPDANCTLAICPIEWSVYQYRPSVPASAVFLALFSIAMIVHTYLGIRWKQYFFMSFMLLGCLVEIIGYIGRILLHKNPFDFIGFIIQICFITTGPVFYTAAIYVTLSKTINALAPEVSRIKPKLFYWIFIPADIICLVLQGAGGALSSISSGSSQTGIDIAMAGLILQVIILAIFVVALGDYMIRYFRSGATGAFNTRTRLYFGGLTAAIVLILARCFYRCYELSQGYQDSELITDEALFIALEGVLIVLAVFALCVGHPGLVQDGKVNKIVSSDEEAMSERKRNTSSPSTPSPSSKTAPPGNAWGRFGPNDQLGTLNLLTPALTKKVAQEQILEGTRIPTDWPLNSMLKPCFDRKPLDHIIKSRSDMTANDDELHLNTQSSSQWDGFRHFGYQKERCYFNGMTQEEVKTSTRNGVQAWVEAGGIAGRGVLIDYAAWCESKGQTPDHFSRSIVTTTTLQEIATSQNLTFQPGDILFIRTGWTRAYTALSPASKISIASHSSPPSIGLESSRETLRWIWENKFAACAGDQPAFEAWPCAGLEVTLHEWMLAGWGCPIGELFDLERLSEECRKRNRYTFFFSSMPLNASHSAQFYRETRG

SEQ ID NO: 3488 - protein, 573 aa, Unknown
  Kingdom: Fungi, Phylum: Ascomycota
MADSVISERSPGQKPQFHNSARHSAADPHVIFDSKSGLYYAYSTEGADEGYNFAIYSSPDLATWHRHPGGVLKACRDQDGNEIEGGQACWARDWYWAPETYHNEKTGWYFFFFAGRLREDLAKDHFRYSDFEEPSKLGVAVSRSPTGPFEEIESRPVDYYPFDPDYYDVNLIMDKKQMLPPQTLEEGHTAPKGTYIPHIDVNIFFDDDNRIYLYVSRNAYRNWNWEKKLNKYIEESNIIMVEMEREWWDDPTASTMPEIIAAQRNIHAKDAPKLPCNITSYNGTGELGNPPRKDGWKTVISYGADPQEWENYHVDDYAKFDGEKKDRRWSEGSTLIKRTGKDGKPVYMLTYSANNFEASNYGVGFATAESPFGPFKKSANNPVLAQKPDGEHPIYSTGHGSIVASPPRRGHEDIGAQDVTLFTPEGAELFYVHHGRNDTGRSRSMYTTRMEIHDSKVYFGSDDAISMSLTPLDQTLPKHTYPLKLEAKCVGGKDEPVYNVRVVSKVGAAFDLTEGTNRVIGRPGDVAAELLVAKDEKSYEASFEGKKLKEIVYQRLSVDGKWEDVTARKVHCK

SEQ ID NO: 3489 - protein, 200 aa, Unknown
  Kingdom: Fungi, Phylum: Ascomycota
MSNANQQNVIRRKLVIIGDGACGKTSLLSVFTLGYFPTHYIPTVFENYVTDCRVDGKSVQLALWDTAGQEDYERLRPLAYSKAHVILVGFSIDMPDSLDNVKHKWVEEATRLCTGVPIILVGLKKDLREDPIAIEEMRRKSQRFVTTHDGEAAAREIGAKRYLECSSLSGEGVDDVFEAATRAALLKFEKGEGGGCCVVL

SEQ ID NO: 3490 - protein, 235 aa, Unknown
  Kingdom: Fungi, Phylum: Ascomycota
MPRHPLQRLTAPSRSLSLIVHALGIASFSYNFNFLYNWETPISVSYGSHFQFLTILGLTASLIAFILGLAADLTLNQALFDAKNAIAVIATPLEVVVSILYWGIRMIDPELLFAGDEFVLPLLTDMGFHLAPAVFLTADLILFSPPWTIPAYGVMLMSTGLAFGYWYWIELCFSVNGWYPYPIFAVLNTTQRALLFTFAAFLSTMSSIGLKWVYSKVNGYEIGRREAHKPLKKVQ

SEQ ID NO: 3491 - protein, 459 aa, Unknown
  Kingdom: Fungi, Phylum: Ascomycota
MFAFGAASLIMALFFAELDFTDVQIGLFMTLTLVGDVALSFVMSLMADGLGRRRVLIAGGLLMALSGIVFAVFENFWVLLLAAVIGVISASGSDFGPFRAIEESTLSHLTNPKTRSDVLSWYVTVSSLGSAAGTEVSGRIIEWLRGLDGWDILSAYHALFWVYVIMGLLNVILALSMSAKCELHSNEPESEAEAIGESAQGLLDPSQQDDEDDRDAAASKEEQKAPPKKARFSQISASTRSVMYKLWFLLTVDSLADGMVSYTLTNYYLDRKFHLSKSRLGDIMSICYILGAISTVFAGPLARHIGLVNTMVFTHVPSSLAVLLFPAPPGLALTIVLLFIRTGLNNMDQAPRTAFIAAVVKPEERTAVMGITSTLRTMAATIGPTLTGALAHTDKFWVAFVIGGALRLAYDFGLWAMFINMKLYENEESGEEHGDSRGRESDEESLEMQPVRPRDRDEQ

SEQ ID NO: 3492 - protein, 411 aa, Unknown
  Kingdom: Fungi, Phylum: Ascomycota
MSTLAIPPPLPLPAFRREPHWDSIRSASSLPRLDTRNVLPSIRELVPEHLLNSQPQERSTSSGPKTLLTSPATAAPGLQTSPGYTHAPQGQKRRRLSAEDIRETERARQVPRLYHPSDASSSYPPRRESPPAAASAPTSSRLDGYFSDSQARPVSSGKYGTPGEPSERPELRHPVPSLTPSSRPYERDGHSPYRPDGPPDAYHSRGPPPPPAQARAASTEQPPPSSSPYRSEYGYSSFQPSNRYGSTPSSASTYERTPFTAPPYAMQYGEYSRFGPEMGPGGLVGETKQRKRRGNLPKETTDKLRAWFVAHLQHPYPTEDEKQELMRQTGLQMNQISNWFINARRRQLPNMINDARAESEAMSGRSLGSKTELGRYERGSRDHLNLSDGEGRQYEDDLRLRRAQAQSRESI

SEQ ID NO: 3493 - protein, 523 aa, Unknown
  Kingdom: Fungi, Phylum: Ascomycota
MATLSIGLGHLTRRQALGPVTKRVCSRCTSSHLQPTRWAPNSIRSFASNSGKRPRFSQRLGEALRNSKVQWYPIPVGLGIGFLGLVQFYKVSSRESEKQKKLENGEFEDGAPAKRPRVKLEGPWQVRVMSTLPLKAMSRLWGKFNELTIPYYLRVPGFKLYSFIFGVNLNEVDEDDLHVYPNLAAFFYRKLKPGSRPLHPDPHMLLSPADGRVLQFGQIEGGDIEQVKGMTYSIDALLGKHTPSPSVSDASLASEPQTIEQKAHRELSKDEKLVKQEEEFAKVNGISYTLPDIMSGPGNRVSAQDASTESNPRTVSEVRAELALGERPWYDILSGDKTTSLYYAVVYLAPGDYHRFHSPTNWVVERRRHFAGELYSVSPYLQRTLPGLFTLNERVVLLGRWRWGFFSYIPVGATNVGSIKVNFDKELRTNSLTTDTAADRAAEAANKRGEPWLGFVEATYENASPVLGGHALRRGDEMGGFQLGSTIVLVFEAPSEDKGGWKWMVQKGQQVVMGQAMGRVIEE

SEQ ID NO: 3494 - protein, 308 aa, Unknown
  Kingdom: Fungi, Phylum: Ascomycota
MPTPERYDRHQLEQYYVRVQVPESARVYDVSSMAADAQLSHLELLVKHQLVTVPFENLTLHYSWHRVVNTDAHHLFDKIVNQKRGGYCMENNSLFHVVLVSLGFDVYMAGARVHESDKTGYGGTTHCLNIITVGDVRYVTDVGFGPNGPIRPYVLEPNLEQEHIAPAHVRYRRGQLPGTTNEAGLVWIYEHRQEDTWAPMYCFADIEILPADVRTMNLAPSTSRTSIFQKIIMCVRFTAGTIQSQVDGDIDGVVILGASLKWRRHGKEEKQFATETERIEALEEYFGVVLDSKDQAAIQGTATAINSP

SEQ ID NO: 3495 - protein, 315 aa, Unknown
  Kingdom: Fungi, Phylum: Ascomycota
MPPRLTSSLRFPILRRLYSTAADSGPLIRVTNLPASGSGHVRVLELNRPSARNAISRSLLAALRAEVDDLHKQYTSEGNETPHATATSDGPTRALVLASAVDQSFCAGADLKERKTFTQKDTADFLFNIRETFNLISALPIPSICAISSLAFGGGLELALTTDLRVFSSNAVVGLTETRLGIIPGGGGCHRLPPLIGPSRSRDVILTGRRVPAPEAYFLGIADRLVEVKPEEVPAGGDKKDILPLARKAALNEAVRLAQEICEGAPIAIRASLEAARWSTEAKENEMSSRVVVTEDRNEALRAFAEKRKPVFKGH

SEQ ID NO: 3496 - protein, 197 aa, Unknown
  Kingdom: Fungi, Phylum: Ascomycota
MQLKSRIEEANQEEACGRHGLTRAAVSVMSQSLRPYLQCVRSSLTAALTLTNFASQSAERHNVPEIEAQTSPEVLLQPLTVARNENERVLIESSINSVRVSIKIKQADEIEHILVHKFARFLTQRAEAFFILRRKPVPGYDISFLITNFHTSEMLKHKLVDFIIEFMEEVDKEISEMKLFLNARARFVAESFLTPFD

SEQ ID NO: 3497 - protein, 883 aa, Unknown
  Kingdom: Fungi, Phylum: Ascomycota
MASERLPTRERRPSMGAPIVDIQGAVGPAGISRPKHKRTVTGFGPGEIKNVEASIPEPQREAWKRSQIPAFETPEDFEKEVVRHVETSLARSMFNCDEYAAYAATSLAFRDKLVLDWNRTQQRQTFSDPKRVYYLSLEFLMGRTLDNAMLNVGLKDTAKSGLNELGFRIEDVITQEHDAALGNGGLGRLAACFLDSLASLDFPAWGYGLRYRYGIFKQEIIDGYQVEVPDYWLDFNPWEFPRHDVTVDIQFFGNVRKEVNSEGKTISQWEGGEVVRAVAYDVPIPGYDTPTTNNLRLWSSKASHGEFDFQKFNSGDYESSVADQQRAETISAVLYPNDNLERGKELRLKQQYFWVAASLYDIVRRFKKSKRPWKEFPDQVAIQLNDTHPTLAIVELQRILIDIEGLEWSEAWDIVTSTFGYTNHTVLPEALEKWPVGLVQHLLPRHLQIIYDINLYFLQSVEKAFPNDRDILRRVSIIEESQPKMVRMAFLAIVGSHKVNGVAELHSDLIKTTIFKDFVEIYGPDKFTNVTNGITPRRWLHQANPRLSELIASKCGGNGFLKDLTNLNQLEKFIDDKEFRKEWAEIKYANKVRLAQHIKKSTGVTVNPAALFDVQVKRIHEYKRQQLNIFGVIHRYLTLKALSPEERKKQQPRVSIFGGKAAPGYWMAKQIIHLINAVGSVVNNDADIGDLLKVIFLEDYNVSKAEIITPASDLSEHISTAGTEASGTSNMKFVLNGGLIIGTCDGANIEITREIGENNIFLFGNLAEDVDDLRHSHTYGSHSIDPDLAKVFEEIQKGTFGSSHDFQAMINAVKDHGDYYLVSDDFHSYIETHAMVDEAYKNQDDWIEKCITAVARMGFFSSDRCINEYAEGIWNIEPQSTKD

SEQ ID NO: 3498 - protein, 511 aa, Unknown
  Kingdom: Fungi, Phylum: Ascomycota
MAQLPTSVGHFLKNLALIFISLVLLPLDTTIFAAADLYNRLHTRIYGDDGVIKHISAEKRKTILVTGVNMTKGIVLARLFHRAGHRVIGADTNFLAPGRLSRALDHFYSLPHSRPGTGAEDPYIKKLVAIVQDEEVDLWVSASDVNGAVADALAKDIIEAGTSAKAVQFGADAINTLHEKDVFMQHTKNIGLTTPDTETIKTREDIISFLQQRCGLELKPNGTQYLVKPIGVDDLGRNDMPLLPLPSESETRRRIDLMPFPETDTAPYIIQQFVSGTEYCTHALIVRGKVRSFVACPSSDMLMHYTALPATTALHHAMLEFTEKQAASFGKDLTGHMSFDFLVRHSPPSTDETQINGEKEEDLPILYPIECNPRVHTAIVLLKDTIDTVDEYLSVLSPSATHTPLHLSSIHFIPTHLQQYYWIGHDLVNLVLYHLYLTVVVGTMTPGQYCESLRVFAHHVVSWQDGLFEMWDPWPCWWLYHVYWPLQFAGYLVQGRWLKLNVSTGKAFRAA

SEQ ID NO: 3499 - protein, 509 aa, Unknown
  Kingdom: Fungi, Phylum: Ascomycota
MTFKSAIHTFYDGKPQPESSSSSDTFSSIDPATAKPLATIHTTTSQQLDKAIASAHAAFAEWSSTPAPQRSAILLRAAAILRERNNELALTETLDTGKAFSETSTVDVITGVDVLEYYAHHIAGSQPGQHTRLRSDAFILTTHEPLGVCAGIGAWNYPIQIALWKSAPCLAAGNCMVYKPSEVTPLHANTLAEIYIEAGVPAGVFNVVYGDGPSVGVPLVAHPDIAKVSFTGQVSTGSKVASQAAKDMKGITMELGGKSPLVVLPDANVEEAADVAMVANFFSTGQVCTNGTRVFVPDNLLSRVEKALVQRCRDGVRMGMPQDESTNFGPVVSKPHQQKVLGYINHGKNVDKAKVLYDGASDAQKSPPTKDGYWVPPVIFTNCTDNMKVAREEIFGPVMCILPYKTQGLSQDQWLPELVRRANDTEMGLAAGVVSTDIGLAQDIVRQLHAGITWVNTWGESPAEMPVGGWKMSGIGLENGEEGIRAYMRTKSTLVQLGRDACKGVFAKL

SEQ ID NO: 3500 - protein, 1257 aa, Unknown
  Kingdom: Fungi, Phylum: Ascomycota
MTPLQPPPYDSDKSRTAWCHALHLAVLGAAVLPSATANIVARDLAPPKAPQKGWQYVGCYVDSVEERALDLARHYDTEALTGESCVEWCSDNGYTYAGTEYSAECFCGNTRPATQADEADCDMPCTGDDEQPCGAGNRLTVYTSDIMAPAVGGWQYSGCYADSPAKRVLTGDAYVSGTEMAPETCINFCDDGGFKYAGIEYGAECFCGNTLPPKKEDEDDCSMACSGDSERKCGNADRLSLFVSDKDAPPEPGAPPEIEGWLYAGCIKEGNGGRTLTHQVYLSGGASSMTNERCVAACDAQGYNYAGTEYAGECFCGNEYENEGGELVDEGCNMKCLGNRQQFCGGSNRLSAWSVNDLPPPSTDTTTDVTATATETDSETETETATETETDAVTETDAATETEAATETEDNTTATETEGETVVETEVSTTEIEVETETEVEVTSTDVASETEVLVTETNDATAIETETETEVTETEAATETEATETETATATDEETEVSATVSETETAAPEETEVAEGWTYKGCYVDPPGRAMTGAPGSPSRDMTPEKCIATCVANGFKIAGLEYSEECFCGNALNNGAPKTAESDCNMACAGDATQMCGAGNRLSIYSDGEVTVHPVPQVQDEDLPEDWEYKGCVFDNANPYILQWLWEDAPNYDSSKMTIPLCLKRCQKFGYSAAGVEYGRQCVCGDLGKVEERGDVWKDDGFCSMPCPGDREHTCGAGNHISYYEWTGEALNTFHYASGNEAGEYQHFSTSPIVPLISSVGINDKVVFVEKHGTSLDNTEGSFEFDYKTDTYRELALKTDVFCSASFTLPDKAGRMINIGGWSAESIYGIRFFTPDSPQGVNNGTNVWEEDYGQLRLFDPRWYPTAIVLSNGSLLAMGGESGSDAPIVPSAEVLPHPPGVTESTYIDYLARAEAIGRTNSYPHMAIMPSGNIFFTQFNESRLISQVDFQTVRKLPDMPGSPVNDLTGRNYPLQGTMMIMPQKAPYGAPLKVVICGGTTHEPGNDALDNCVSMHPDNAGEQWAIERMPSKRVMPTMIGLPDGRYLICNGAHVGRGGFGLADDENLNAVMYDPEQPIGSRMTVLANTTIARLYHSEGVLLSDGKVLISGSDPQDQGKHPQEKRLEYFIPDYLMSGAAQPTFTIADRDWDYGGSYDFKLTSPLAEGVGKMRVSLMASIGSTHGITMGQRTLFPAVSCSGTTCTVQAPPNAYVSPPSWYQMFVLDGPTPSHAIWVRIGGDPAGLGNWPKLPGFTTPGV

SEQ ID NO: 3501 - protein, 568 aa, Unknown
  Kingdom: Fungi, Phylum: Ascomycota
MASTGSGGSLPPNFLLTPQQQSLLFAALNSNKQSNAVNNPPTASPAVFNNAGAPASGHLNGLSDSPFLDNLDNLDYTDFGDSSFDFSFANGDQPLVGDDSTLVKSESPENDIHEKRSHPDDDDDDEGSPTENGSKRRESTDKVPKKPGRKPLTSEPSSKRKAQNRAAQRAFRERKEQHLKDLETKVEELQKASEDANNENSALRAKVEQMTSELNQYKKKVTLMTQTSPQSREKSSSFGSGTLTGLNSDFHFDFPTFGVPTPPTDKSQRSNSQPISPQQNTPGSSAISKNAVNGQDAGFNAQFNEELARFNTGFTPSMSSSITNASRASLDSASFSVGGATSSPSASSQSNAGPSSSCGTSPEPVTQSPMGFKPVETLTTIGEEQPAMSTSTQPFTQFSNLNYGTTNFDWLAQQNGGQFDPQLFGDYREPQNNILANPSFDDFFNDAIDTDFLTPFNVAPSPNISQKKNICDEIDAQQDKVHEDPEQPDKSSMSCNQIWEKLQACPNAQSGEFDLDALCSDLTKKAKCSGNGPVVGEADFNTILKKYMGGKDASCVASKLGIEVEKAT

SEQ ID NO: 3502 - protein, 390 aa, Unknown
  Kingdom: Fungi, Phylum: Ascomycota
MDPTLLIGDIVERDDKELKKPVEFSDEPFTSTPTGFPKHRRRWRPTKKPDAEAAASKAGDETKTPGSFDEVEKQRIDAENKQRINDMTPEEIAQAQEDIMSGLNPALVQRLLRRANIDQDPANDAPKKPAESQPQEEIRKKEGKKVTFEAEPEPEPQPSKPTNPRSNAIDDRPPPQIPPDLFPITEQPDRTHFPVPPSLPDLDPSDPNFLETLHKKYFPDLPADPSKMAWMAPVPTPDSVADKESPYYPGEDIAVSALRFDFLGRFLSPRVSRNIASTKGLHHHGLAPEAAGYTVAELARLARSAVPAQRCMAFQTLGRILYRLGNGEWGKTKDDPIAMGVWNAAKEGKVLDSLMHAAMEEGGHRGSRAYATEALWLFEKGGWREQHEGR

SEQ ID NO: 3503 - protein, 452 aa, Unknown
  Kingdom: Fungi, Phylum: Ascomycota
MSKIPGAKVDMYEALPVPFGLVRHGVAPDHPEVKNCQDKFDEVASSPSFEFIGNVSVGQHAHQAEHTSVELQSLLDNYDSVLFAYGASQDKKLGVPGESTLKGIYSAREFVGWYNGHPDCAGLAPDLTRGEEAVVIGQGNVALDVARMLLEDVDVLRKTDITDHALAEIARSKIKRVHVAAFTIKEVRELMRLQNVSFHGVNRSLIPSDIKSLPRASKRLMEVLVKGTPGAPTSTARSWSLDSCLAPTHFLAQTDRTDSVSSTKFDVTRLKDPFDPLSGTETTGEATILPSSVVFRSVGYKSTPLAGFSEAGIQFHERRGVVDNDGLGRVTRLVSEESGSHVTTQQVPGIYCAGWLKNGPTGVIASTMQDAFTTGDAIAQDWATGAEFLQRRNRSAAGGWATVRKALPDNGQSAVTWDQWRKIDRAERERGQTQGKEREKFTDTSDMLAVLG

SEQ ID NO: 3504 - protein, 916 aa, Unknown
  Kingdom: Fungi, Phylum: Ascomycota
MSPHLPKFHLSYDSPSETDHWLQLSHLEPNRTPATPSAVAYSLRNLLCQRNGHYAASETREFARSGQYAQERRPRTQRERTLQRWVPDAGDGFDGSLEKASTGGGGWDQFAENERLFGLKTDYDENMYTTVINKSHPQYRERQAIADKKAQEIERSTAATAHVAEERVMDYVPGQQRDEEKENEEDKYSGVRRQDFPPLSDGRGNKYTPPAKRAPVGQSTVKGAPVDPAIISSQIKAPSKKQTSQAPSEEIPKARASDSGPSTDSQSTLEVAKSEGQPAITESKSNTASPAPVDSKLADSKPLDNGTTTAKSSATPSRNLSPSKREPGSPANLAPSATSTVEVDVLKEFKNFASQQRMNAERARSTKARHDKESKLADLKKFANQFKLTTPVPEDLVSIIAKDPAKQKEIQARASKNAEEMAKKADSTSKDSTTPSKEAQPQPAEPKAAGNDGKAARAPTAPQNAANGPSGNRHQNARQQYPQQGMYHGQQQYRNNRAGPQHAPMQHQQPGTLAQRLRHVEQQRYSQAPATQPHASAPDVRVPPTGPANNLDANYNRRASAVPVHLSAAKALNPNTQEFQPRASAAPFNPNGHGISASSSPRSAVNNASELSSSAAPQSPLIRRKTKAIDAKKCCILAHVKTFKPPQGRNWDDNGGLRPSYDTLPTWRQLRDDEKAESTMHLTLKEHFDRQPFSGPSLTTPNPQHAMPQIPHQHQLPFHLQQGAHHMGMRQSPHMGHMQMHNGQHGPGPHPQFGNDDHRMIPSSSSQSFASPRMGQAPMAYNGMGSPAHVQYNQPVFIPQGTPQMGYRSFSNSQQYMPPQQGHQPMMMQPQFMHAPQGMVGGPQMMYPGAHPQFMPPAGPHQPMPGTNGYPSPGRPQAPMMVHQGSQQGQAMYGMSPNVQYNQPAYGPAQGGAPSQ

SEQ ID NO: 3505 - protein, 361 aa, Unknown
  Kingdom: Fungi, Phylum: Ascomycota
MPSKSKLRSIFPVRGNTVRKQGQRRHGAPDPIRNALTVITGEFCGTFMFLLLSFVGAQTAILTNDPANPDAPLRAFSLMYISASFGCALAVNVWIFYRVTGGMFNPAVTLGLLLVGAIKPMRALLIIPTQLVAGIAAAAVTHGLLPGPLLVRNALASNVSIVRGLFLEMFLTAQLVLTVYFLAVEKHRATFLAPIGIGIAVFMAHMCGTNYTGTSINPARSFGPAVIAGFHGYHWIYWLGPFMGALLSFGVYSIFKWLEFWTANPGQDADDVERANRAMTNSPKSGHFFDGNLKDADGEFLARKSETRPRNDSVMDGQSVSPTARTAFPATRQGNVPPTVPPTIPQTGPAAVDPACTARGA

SEQ ID NO: 3506 - protein, 831 aa, Unknown
  Kingdom: Fungi, Phylum: Ascomycota
MLRQLPRPVLRVNSSHTNATKRQLVQRFHQPAARAFSSSRRWQADETIGSAESVEQFVRDTKQRFRDTLPKGYLNEEELALYLRLYGPPLRETEPDDVGIPSHADMGSEAPKPVNEGTVLRELEGGEFEEITFELPPEQLLKQEELVDQENPEAENDEELIEITPEIAEALMAQEAAQAEEMDLMETEPDYIDTVAKNQREHDALSKLKEDFEAAREKQKQEEEATQEEAEVAEEVAAQDTSWPPERELPWHGLPEEDTGSSEKRRFHPLTIEGRFHGSPVEISLPRDELIAPVREMLERTHIKHVRNAAEASFGGVGLPLSPTTQDGQKNGKMDAVGLPPGQRHMTEVEGDAFLAGYLPPAYASSMAVLREVRKRLGSGWLQSMLKRTDGEGPRILDAGAGGGSLVAWNQIVRAEWEILKEKREVTAKEPTGKNTVLVASNRLRDRLKGILHNTTFLPRLPDYQHSGDMDGAHLDAGSQPQARKTYDIVIASHLLMAEKYDHHRQAVLNNLWNLTDKDGGVLIFVEKAHPRGFEAVAHARETLLRRYLNPQPGQPTEAPAEFNPAFHRVLEDGHIIAPCTTHATCPMYKHHGKSAGRRDFCHFSQRFVAPTFYSKMLSGSSQGEVEFSYVAFQRGVSKNHAMSPEEATEKAMRGYEHHNESPSMQQLPRMIMPPLKRTGHITLDLCTPEGKTERWTVPKSFSKLAYHDARKARWGDLWALGAKTRVERTVRIGRGQDDGGLRTGRDGKKGPRRVTITMDGENISAEEKNVGRQRRGKKGKKAKTDDILRELEEDDADAEREVDEEMEAVWAEQEAEEAAEREMRRRGGRN

SEQ ID NO: 3507 - protein, 257 aa, Unknown
  Kingdom: Fungi, Phylum: Ascomycota
MMYTSALSVLGLLVAETLAHGAVTSYRIAGTTYPGYQGFSPSNTPNVIQWQWPDYNPVLSCSSAQLRCNNGRSATLSAPAAPGDSVTAIWQQWTHSQGPILVWMYKCSGAFSSCTGDGAGWFKIAEAGFSGDGKSVFLDTENPSGWAIAKLNGGGEFTTTIPQGLAPGNYLIRHELIALHQANAPQFYPECAQIVVSGSGTSQPSSSQKASIPGYCSDSDSNIRVPINDHSIPQTYKVPGPAVFRGTGSKKARDFSA

SEQ ID NO: 3508 - protein, 504 aa, Unknown
  Kingdom: Fungi, Phylum: Ascomycota
MLPLAAPIPWTSPSRSSITSIALQHNQIQSDLKPFLRQAQALWSFSRENGQSGMGGDGGREDKDKKKDKPKYEPPPRPTTRVGRKKRKQGGTSAAAKLPAIYPTSRCKLRLLRMQRVHDHLLLEEEYVENQERLRKAKAAKEGNAAATDAETGDRMADERGRVDDMRGSPMGVGTLEELIDDDHAIVSSTTGPEYYVSIMSFVDKDLLEPGASVLLHHKSVSIVGVLTDDADPIVSVMKLDKAPTESYADIGGLEQQIQEVRESVELPLLHPELYEEMGIKPPKGVILYGAPGTGKTLLAKAVANQTSATFLRIVGSELIQKYLGDGPRLVRQLFQVAGENAPSIVFIDEIDAIGTKRYDSTSGGEREVQRTMLELLNQLDGFDDRGDVKVIMATNKIETLDPALIRPGRIDRKILFENPDQNTKRKIFTLHTSKMNLNDDVDLEEFISQKDDLSGADIKAICSEAGMMALRERRMRVQMADFRAARERVLKTKQEGEPEGLYL

SEQ ID NO: 3509 - protein, 268 aa, Unknown
  Kingdom: Fungi, Phylum: Ascomycota
MAASLLKGTAFITGAASGIGQATAIAFARHGITKLALADINFQALQASNADLKKNFPNVEILDLQMDVRNTADVKRGIAETVERFGRLDVALNNAGLGGAGRQTHETDEEEWDRVIDVDLNGVRRCQREEISVMLKQEDLGPRIGRGRIINVASMYGIVAPAGTMHHTAYAAAKHGVMGLTKGDANSYGGEHGIRINAICPGYVETPLLKQAMDAERDSPLALDIRRTPLRRMCKMDEIADAIVFLASPMSSFMQGAGLVADGGFTTN

SEQ ID NO: 3510 - protein, 551 aa, Unknown
  Kingdom: Fungi, Phylum: Ascomycota
MASSLPVDLYAPFEYDSLIELRTGAMKKLKGLDVLSGIDKGLCTGPMKMGKLGLEGDEHDPVFHGGPDKAILGYCSSHYPDWREAYPDRSDVFVPGGFGENFVTAKMNERNVCIGDIIQVGSEVQLQVSLPRQPCFKLNHRFSIKKFAPTTSQTSRTGWYYRVVREGTVTAGDEIKLVERKWPKWTIEKIQQYLVREPDNHAMNEELAGIEALGDECKGQFRKRVAKAKKKNESRPDDTWTDMRIIERKMETPRIVSLVLQSESEHPDKGTSAMGAHAKLKLPNGLVRSYSVVSDDNEDFVFDDKIALGVALDEKSRGGSRYLHEQAQVGDIIKVGRVTKDVGPAGAASNHIFIAGGIGITAFLRMMEGYRLMHWGLDLHYAVRSQQDVPFVDRLAAFGEDVRYYQKSEGSRMNIADIIKNRPWNSHIYVCGPSRMMEAAKAAVQEHGVSPDEVHYEAFGADITGDPFEVEVVNKEGAVLQVGSEDSLLEVLRQRYKDVSSSCEVGNCGTCKVTLKSGRVDHRGTALLPKEQREAMLSCVSRGIGRIAIEI

SEQ ID NO: 3511 - protein, 1038 aa, Unknown
  Kingdom: Fungi, Phylum: Ascomycota
MQLPSSPSLLALLPLAGALLPAVAAVPETNWETYTNDLGYTAVRFKDGFEPGSFDYTDRMGGNTTEAVVKRQDNRNTEPLVGSTKIPYGCDTDIQFDVIPKLHDVCSDLGCDSGTTATHDVTWSSWGEETGGTVHMKATGRWPSGMKDAMIEAVQAEVIPEAVEFNEKETRGGGNSPYNPIRIHRCTVSEASNFLSIVVRGDNDALVANLDVEVTFTSSDGTGLICGTVGSAGAVIVGLINGIAGGIFGFMSNFCHVHIVTQSAGSQSESTKRIKANQEAQASIFDYDLDISLDDISQAIHGHDSVCSSFPNNSSPGLQSMGGVPLSEPAGQLPNFGISYTDPGTGSQVDQHGIGIDSWTDLIGHLSPWDTVDMNSLTGQSASHATQHEFQYDWATDGLPGAHDELALTDLTSNYFTNLGKRKGRRRSSVNQERAFSEYSTESMISVAANNNFIIGNLLGIYHDVLENNLACWLAEENCPYKLRQATNASLADGQMICSRLDASPQPEATIKAWGRDWSNRIYRRVTQLDRTAMRTGNVKISRAQSQAASRALNLVIMAFATQWSQGSRQSQAQSFASPAGPFEEKMEADFERHLQLSVWKQAKRALQDVEDVESFRVAYAEMVFGLMEKPWDEEDEMPDIDACSLIHETGEQTMHSRAADILSQDGPPVMLDRAARKMQVLKFRFEKEVMAPNTSRKAPHASSKDVSDEDRETIGLLYWLAVMFDTVSAPMNERPVALGDEDCQHDAAKEPQPSGQIGEKPTDSRSRLQWNVQTFVVGDHDVATSNLQWPCSYDVAAAAIARSAPIKILIFRHLSYLQNILRRKEFGQPIEDALWEATLVYRYWNTIFAPFYRDLVQTYDTVPTRLRAWFVCIYIPWHLACLMLADIVELVDCNELGLSANSSTRAKADMVSRIRRQSAYELSELARVTAPGDGSEQLPDYHHAVNEGPLLTEPWTVLLVRAFTKTALFYLDRARELQTGADSASGHPSQELQEKFMRAEFCTRALFTLGRKSTMSRQMSRVLYRALENRDVQQVVC

SEQ ID NO: 3512 - protein, 240 aa, Unknown
  Kingdom: Fungi, Phylum: Ascomycota
MRFTSQLQGLNASVNSAQKAAQYALRYKEMDEDLHSCILEQVERTNMNTRANIMFFIEHFLDQAQRDGHSDYVRMMQRDIIRVVDAVAPDDGSGAANVKVVRKGKGLLELQVVTQIEDVIKERESTNDDFDAGSPIGDLPDAPPSQTIPRPDKKGAPPRLEKRQIEQRIEEDRERHKRERESIWAVPTGMDQEQTKLWEETSDYGDDDDRLLAEEARDFEAEMELQRCDHQRRATNGQRH

SEQ ID NO: 3513 - protein, 543 aa, Unknown
  Kingdom: Fungi, Phylum: Ascomycota
MPQIPPPQTPQSQDASLPPNSAAGAYVGATPVPAPAPPKTTPTKSTLKALPTVRDHTTDQLNPTGDEYIPRETDEFGEKKVMANGQLLGGRSYRCRTFLVPHRGDKLFMLATECARVLGYRDSYLLFNKNRSLFKIIASQPEKDDLVQQEILPFSYRSRQIAIVTARSMFRQFGSRVIENGRRVRDDYWETKARKQGFTEADLAGEKRPGAAKAREAAAEQAQNSVMMAGPHTEIVYNNNPGPYPGPPQPHLVQPGMLGATPGNAARMPGLTTGPELTDARPRDYGSIVKGGPRQEITGPPYQDQTRPAPLGEIHSQANHAADFSRSVNQQRDMRGDYLQGVWRRPHEQPANTLPQPVGSSDSTVPTTRTSGSPHTTATGMSQPPVVSTQSPQMMMTNPPYSQSIHAQNTLGQAPLRGSSGSLSQGGAPSYNYQSNQAMWSQNPQNPQQNYGSYAPQNQPPHPPQSPASHVRQPGSSQMQPGMQFPGMAGMQYGAGQGGMYATDQTPRGYMPQGQQGGPAVTQSWSGHHSPPQQWWAPSQQPQ

SEQ ID NO: 3514 - protein, 478 aa, Unknown
  Kingdom: Fungi, Phylum: Ascomycota
MSNSGADAGGVAVPTIPNLFCSPPPIKDDLITDSSTLQDDTVDECLPFLTNSTNIHAHVNAHGIPHLDRARHVAFLHKQLGKLPPQFMAADPSRPWFFYWCLAALAILGENVEEYRSRLVGTVQPMQNEGGGFAGGFGQMSHLATTYATILGLVLVGGEEAYESVDRRAMWRWLSSLKQPDGGFQMAVGGEEDVRGAYCAAVIISLLNLPLDLAPESPARAGGHTRLFDGLAEWVRRCQTYEGGVSAKPGVEAHGAYAFCALGCLSILDSPTRSFSRYLDVPKLISWLSSRQDAPAAGFSGRTNKLVDGCYSHWVGGCWPLIEASLNTSQAAKGGSSPPPPDEQQPTPAAGRPSAATSTATSTATLFSRDGLIRYILCCCQDQSKRGGLRDKPSKFSDAYHTCYVLSGLSSAQHKWNLVTARSGEGIPDLDEWAASLFCEGEQIFDEEDRVKPVHPVFVIPQDKADAARQYFMAKAGF

SEQ ID NO: 3515 - protein, 505 aa, Unknown
  Kingdom: Fungi, Phylum: Ascomycota
MQQHHAPYGYPSPPASPAYDNSKCTNQAAYASRQYQPRSVPLAPEERLGKLLQGKLHLTEILGTGAYGVVYSAYDIDTGIRYAVKCLSKYNPDGTPLERRQALYQQREIRLHYLASAHQNVVSMLKIVDDADCIYVILEYCPEGDLFLNITERGRYVGKDDLSKKIFLQILDAVEYCHNLGIYHRDLKPENILVTDHGDTVKLADFGLATSDDRSEDYGCGSTFYMSPECLQPSSRKPFYRCAPNDVWGLGVILVNLTCGRNPWKQASFQDSTYRAFARDSSFLKSILPLTDELNDILGRIFHPTPEQRITLPELRNRILNCSQFTMPAMSASAPTPPVTPNNINAYVAPEEAIMDDCDYDSPLSPASTNSDEGSLTSSAPTIDDFDDEVFIDCQTQQPCMTQDLNPITFETDMPQENSAFHVQEFMPQQHYTGPVPTAPLVVHSQPLASQLPPQAPIHVPVQAPCQPKSYFPFWDVVKYVQQTPVIPGHAPFHQQVSFFPVQGY

SEQ ID NO: 3516 - protein, 565 aa, Unknown
  Kingdom: Fungi, Phylum: Ascomycota
MASMFEQPRNGTLFLGGTKISGSDIRDQNVLATQAIANVVKSSFGPSGLDKMMVDDIGDVTVTNDGATILSLLDVEDAAGKILVDLAQQQDKEVGDGTTSVVLIAAELLRRGNELMKNRIHPTTIITGYRLALREAVKFLNDNVSVQVENLGRESLLNIAKTSMSSKIIGADSDFFSNMVVDAMQAVKTTNPRGETKYPVKAVNILKAHGKSVLESLLVKGYALNCTVASQAMPTNVSDAKIAILDMNLQKERMKLGVQITVDDPQQLEQIRARESGMVLDRVELILKAGANVILTTKGIDDLVLKMLIERGCMGVRRCKKEDLRRIAKATGGTLLSTLSDLNGDEKFEPSYLGTADEVSQERISDDELILVKGTKVHSSASIILRGPNDFSLDEMERSVHDSLCAVKRTLESGSIVPGGGAVETALHIYLEEFAGTVGSREQLAIAEFAQSLLVIPKTLAVNAAKDATELVAQLRSRHALSQRTQEGDGSEDEKTIARKKNYKNYGLDLARGKVVDEIKLGVLEPSMSKVRQLKSAVEACISIMRIDTLIKLDPEAPADDGHGH

SEQ ID NO: 3517 - protein, 1452 aa, Unknown
  Kingdom: Fungi, Phylum: Ascomycota
MPRVNHRAKLAELKALRQSGKKAFENYQVDDADNLYDEVDEDGYKKIVRDRLNQDDFVVDDNGEGYADDGREDWDRVQRYDSDSQDESLPARGGRPSKTAKKALQEEQAARDANDRDISEYFTKGAGKTQPKTKVVKTKADDDFLQDLLGEVDTNIPAPLPRHSKHERSGERRKARALSPAPEPLSKKKKTLDTRLPSPAPAGDLHDDDGYMPTMDDDLPSAADVPMSDPAPSSPAAKVAQRKRAQIKQEPKDDDEEEDMMEVAHASAVATASVNMAGARPVKKLIKSEPLPTPATSSPLKPTQTDVDSSSWNALTDKLNVVSSPSETRTVGKIDHNDAVEADGSLNFFWTDYTEVNGSLCLFGKVLNKKTSSYVSCFVKVDNILRKLYFLPRQNRVRGGEETDEEVEMMDVYSEVDEIMTKMNVGMHKIKQCTRKYAFEVQGIPKEAQYMKLLYPYTKPQVDPSATGETFSHVFGSNTSLFEQFVLWKNIMGPCWLRIEDADFGSIKNASHCKLEVLAEHPNMVSTLTESDNLDAPPLTIMSLALRTAFNAKENKQEILAISARIYEKVLLSDTTPADKLPCRTFTVIRPHGQAFPLGFDQLVQKRRKGLIATKKTEAEILSFFLAQVDVADPDVIMGHQLEGVDYSILLSRLHEKKTPQWSRLGRLRRTQWPASLGKMGGNVFAERQIMSGRLLCDLANDAGNLYLTGDNRRREIDNEAALDSWAKEKQGLMDYITHMEADTHFVAALGLGVQMLPLTKVLTNLAGNSWARTLTGTRAERNEYILLHEFHRNKYICPDKQTFRGRQKAEEEREGEGADSKKKDKFKGGLVFEPEKGLYDKFVLVMDFNSLYPSIIQEFNICFTTVDRTPTVGDEDAVPEVPTDQDQGILPRLIATLVSRRRQVKKLMKDKNATPEELATWDIKQLALKLTANSMYGCLGYTKSRFYARPLAVLTTFKGREILRSTKQLAEEKSLQVIYGDTDSVMINANVDSVADAFRVGHEFKKAVNEQYRLLEIDIDNVFRRILLQAKKKYAAINLVEKDGKFVEKMEIKGLDMRRREYCALSKEISQHLLNEILSGDETETSVARIHEYLRDIATKMREQTIAIPKYTIYTQLGKGPKEYPNADSMPQVQVALRDIARGKTVRKGDVVSYIITGDKSSSEPAPKRAYAPQDLKTDPSLTVDVEWYIGKQIFPPVERLCANIVGTSSSQLAEQLGLDVRRYTNTSASSGNGTGEDLEIHPLDSQVPDDVRFADCSRLLLRCRKCKASSTFEGLLQDGATTRTTAAGIICPACEAVISTLSVVAQVESAVRAQTSRYYEGWLTCDDAQCGIRTRQMSVYGTRCLGRNGLARDCLGRMRYEYSEKAIYNQLVYFASLFDVDRAKASASPAASQLSGQDRDRILALAEHNRVRFGTVKSVVDKYLDKCGRQWVAMDTLFAKLGFNKLVTPV

SEQ ID NO: 3518 - protein, 137 aa, Unknown
  Kingdom: Fungi, Phylum: Ascomycota
MASTGKDPITCHVLDTTAGKPAKGIRVQLEGPSQPSTSSTLPKTFEALTDDDGRVRVWLPYSPEDASGEIPVHTLVDVLETVKGPSRWTLRFDTAGYFGDEATFFPEATVVFRVEEGQSYHVPLLLSPYSYTTYRGS

SEQ ID NO: 3519 - protein, 396 aa, Unknown
  Kingdom: Fungi, Phylum: Ascomycota
MLTRRFGQEVVNYYSGSCANRYSFLRADGLFLRRAAAAPRTRYVALSGLNPLTNAEGTHLTRFTLKDMSSLIGDQPFAISEDDAVKQWDSTKKVPLIVFLGMVEEKEAETIESSEHGPIRGNPIFAVDVTTTGPLASEAEAFIEKHNQDGGQLQTNPRAMSLEAHDAALFAQSRSIIDWNLRIPFCAGCGNPTLSVHAGYKRVCPPTDLRGNASSLVELPTCPSRKGITNIAFPRTDPTMIAAIVSADGQRVLLGRQKSWPEHMYSTLAGFLEPGESIEEAVRREAWEESGVKVGRVVVHSSQPWPYPASLMIGAIAQTLPGEGEKIHLNDKELDTAKWFEFDEIRKALETSAGPLHLPPPEGYQAGTLRLPPQQAIANRLIAAVVNGYLSGVPKM

SEQ ID NO: 3520 - protein, 2492 aa, Unknown
  Kingdom: Fungi, Phylum: Ascomycota
MGSILLQPDEEPQPNGIATDESVFNNVCELVTRASSEHGDKKAIICGEECITYAQLEEYSNNLASALVERNVGHESLVAICLDRSVDMVVAILGVWKAGAAYVPIEPSLPSDRIKQMLDDADPRFIITKSGKPLDLQSETTAEFLSVQLARQHHSNPTQFSSETRKSDLAYVMYTSGSTGRPKGVEVTQGGVINLLQAMQERPGCTVEDVLLAITTISFDMAIPELFLPLICGATTVIARRHEILDTPVLVEMLERHHITILQGTPAIYRMLLDSGWNVRPRLRQIWCGGEALPKTLANRLLDLCDVMWNLYGPTEATVYGSMWRVQRGEEIIIGSPILNGHLYVLDESLQAVPFGQVGELYIGGAGVAKGYRNNRELTRTRFLNNPFHGGLIYKTGDAARFVGHMQVSVLGRLDGQIKIRGHRIEPGDIEAAMTTVDEISAAIVISRDDRLIAYYVRKDAHMARNGRHEVHQFNSELRSILVELLPTYMVPAFFVELGTLPITPNGKVDRKALPDPIESSRKGENGGRSRTLEAQLLDIWADVLGHQSFGVQDNFFEVGGDSLRLVRLQKQLQTSLGKLVPAHILFEKYTINALAKHLEEPHTAPGEQLRSAQPQSSSDTQEDIAIISTACRLPGGIESPKDLWDLLDTGRDAITTVPDGRWGQPDLDDHLKCQKGGFISSIHEFDLSFFGISPREGQRLDPAQYMILETSWEAFERAGYTMDQLRDSQTGVFIGTSNILSHQGLNDNAVHNPGDLDGYTVTGSAAATMSGRIAYILGLQGPAMTVDTACSSSLVATHLACNALRLRECDVALVGGVSLLTNPGLHVEFERLQGMSPDGRCRSFSSDTEGTGWSEGSVSILLKRLSDARRDGDVIHGVIRGSALNHDGRSASLTAPSGRAQQQLINKALSVARLQPHDIDYIEAHGTGTKLGDPIEANAIAEVFSKDRQGREPLLIGSAKSNLGHTQAAAGLVGMLKVILAMKHATLPESIHITTPTAAVDWMASNMAPVAKRQSWNVSEGAPRRAGVSAFGIGGTNAHVILEEDWLPQSQAKHSLPLTQALPFLLSGDSDAAVRAQAKRLMRHLNDETQPSKLEDVSSTLAMKRSHFRKRITLWAIDREGLIQNLQALSVDFGGVNGLGDNYNLRDQPPNLALLFTGQGSQWSGMARDLYDQYPVFRAALDEIAGFFNTALEIPLLDIMWADAGTLNAKLLSTTEYGQPAIFAVEASLWQLWQDWGITPDFVLGHSLGELTAAYAAGIFELSDACRLVAARGRLMQAQSGDYLMAAIEANAEEASNAIVQLALQDTVEIALYNSPIQIVLSGQTGSVDALMNHFQASGRKTSVVVDGHAFHSRCMDGMLSEYAKIVESVHFHIPGKIQVVSGVKARVMETQDLTDPYYWIRQVREPVRFCESVQALASLDANVFLELGPDQVLCGIAAASLSEGAPGAYAWLSSIKRGDDSGTLTQMQRAASSLHLRHMSVNWEAVLRPYCGERADLPTYAFQRDYKQPSSAPRKRQPLSDGNAVSDNTHDDFTFKVSWIPAMSHSYQTGATLGLLILARNSAWVETVKTGCAQAGIKILQVEDFEPTQNLNGIICLWDSTADNHVQGQELMAKALTQLQTASKMDSQKLLIWVTRQAVGTNTEPDDRVTELGIGPQLWGLMRTARSELPHLHLRLIDVGRDATASAIKSALVLKDEPEIAVRQDLVLAPRLERVGPGQRSPAVRQLLRTDGAVLITGGLGHLGGCVAQWLVSQHGVEDIVLVSRKGLETEGAEQAIRKLTALGAKVTAIACDVANATEIKQIMATFSTGRPLRGVVHAAGLSDSGVLTSLTPERCERVIAPKAHGAWLLHDATKHLNLDIFVLFSSVSGVLGMPGLANYTAANTYLDALAHFRRANGLPATSVAFGTLGHRGGMASRLAQNTQSYLSQYGLDALSERQGLDTIATAIRSQRALTVAAALDMGRVRRYYDEQKQPIPPLLSSLLEPVDMHKGPAPASDKSLQDVVADAPAAQRLDIVLETVRKIAAIVLGFKSPLEVDIDRSLKAIGIDSLAAVQLRNRLASATGLSLSANIAFAHPSIRGLGQALCDQLQASQATPPSSNASSSPMDELDMAAIRAGCVDETFAFESVGSLERPRSVLLTGATGFVGAFILNELIKTGFIVHCLVRASSPDEAAHRVFDALRHYGLDYPAKEMPIKPLVGDISRPLLGLSSQDFDELADSVDAICHSAGLVDWARPLEEYVGPNLVSTHEILRLASRGRPKAIHLISTISTLPKHMGLNFTEQDLEYGYGTSKFLAERMVAAARWRDASATVYRLPYVTASSIKGHFRRDQGDFLHNLIIGCRELKYFPQIDADLSSVLPVDYVAQTVVSVIFDDRDKQGQDYDFRNANAPTCKEFFNAVIAADQLSATIIPFEEWKQKALAAAEESPGGSLAKISMVLDSYTAETAHTMFKGQKLGRNVLGVDEYPIPLMDERFVARYIGQIKPPRQQ

SEQ ID NO: 3521 - protein, 1223 aa, Unknown
  Kingdom: Fungi, Phylum: Ascomycota
MDEPDASRSSLSSSESYETALCILPPQDSWPPIDRFRALNDKGYGRWPPHISLIYPFVPPNELDKAVKILAEVEHSAVLPHRVTLTDVDTFAHRHDSIIFLRPNAEDTNHALEALATRLNEALDSVGRKPYRPHMTVAQSPDSRSDRHQFLLDKARLLSPISWELSEIAVLVREKQESSGEGVSSRAMRLWGTIDLITGNINRESIHPGCYQRGLDAHDVRGPLLRSQASFGFCKSTKSWKPLPTASPAANPGQLSQPVERLIVASYNVLADFEWPPSSARHPHLVRNICSARARADVIVLQEVTDAFLEHLLSNSAVCGQYPFATHGKPSNVEVGPLPNLLNIVVLSRYPIQWEYLEHSRKHKGSAIVVFPTLRVRQAEGEVSPPVVVAACHLSHGLTDAAVVAKKQEVHDLMKHLQSAFAGNPCIMAGDFNLTSSSYTIDMARKKGVLTNHTLKHLRDFDSCFLENGFRDVWLETRLKTGESSGIQTVQQNLDQLHEGEQGATFEPLINTLAAKQVGFGLGTRPQRYDRIFVNDKLGLHPIGFNMFGQETEEGATQYASDHWGVRCLLQAMESNSAAVPGLALTRPVTLRRAAESLGGLEDLTACLSTRGMLPSKEDEASRVEALELLRRVLVDEMTSQGHGDRHFKPVLVLIPVGSTALGVWTPKSDIDCLCVGGISSKTFFALATKRLKKAAPEGIAILRKVRANSGTMLELLVHGIRFDLQYCPSIMIAEQYPDVLNRPSTDGVFSLPMQTLLKLKPARDLSYLRRSIPDTAQYRAAHLLIKAWAMSRGLYAAKFGFLGGIHLSILLVPICKSLVHAGHSPTVADVVATFFSHYAGFDWEKHMVFDPFFHKKLKYHRSFREPLCLLGWHAPSLNTAATASVPTVRTLVAEFERADQLLSRSGQSWDDFLGYTVGEADFLSKFKQYVRINVHYWGSSPSKGNRLVGWIESRCAMLLVDLDRRVASLLPRMWPARFVPRRVDPVESTVAECQACYLIGLDRKPASTEHGSISDVDAVEAALIAVLQDFEVKLKGAETYYDPQTCWLNVTMQRGSELGPLEADTASWGGHSPDQEQWEDTSDSEEEEDELGGEEEHAVDNEGAAAPPTLRPRAETSTTIGSNASKAAKPSFAGLGKFRTATDVLNRLKWDPAMDSSDFIVGYEDRFAGAQEKALDKWKSDLTHEEFIPQHRILYFKRRSDGSKVWERSTRTDSIFGSGVRS

SEQ ID NO: 3522 - protein, 651 aa, Unknown
  Kingdom: Fungi, Phylum: Ascomycota
MRITIIGAGPSGLVQLKTLLDAHIRFPSRLPTLEVRLFESHDQLGGVFLHHSYEDGELVSSKFLTTFSDFRPRSDDPDFFSSERYREYLAEYATQFGLWEHIHFGTKVESVRRGKDGEGHVVKYVTKEGKEEEWECDAIAVCSGVHHTPNSPTIPGIEHVPVVMHSEKFKERKQFGEDKTVMILGSGETGADLAYLAITSPTKRAILCHKDGWIGAPKKLPNQHWLSPIFGPNTSTKPGLPLDVSQVTLFDTMYVHPMVRDSMIVWNFYHWVAIPFGCWLTTGTPRGMDQWVGQVPDNRFHASNQETVFFNKAWQRIQAATSEPYRPKDLPLSSRIRRFFLHTDFPPPSRILDIAPFPTHITPDGVAHFQANPARPESTLINAQGPIKPDVIVFATGYIPSFPFLSHSDNEGSRPYPTAHDADVRQVWKRDDPTIGFIGFVRPGFGAIPPLAEMQSLLFTSHLLGLLPQDQPLDPDDEWHYRLLHRPDARVTYGVEHDSYAYQLAKDMGIAASFTDIIRMSFTTPRGWRLPYIWGAGACLNTKFRLVGPWAWDGAGSVMTGEFWETVTRRSGAWGNLPLSGTPLLYLGTMNLYYALYSGFWNGMAKLGLCKPLKRVIEPKRMMEEMARVDAKQNLSGKDMEWEEVKANGSM

SEQ ID NO: 3523 - protein, 371 aa, Unknown
  Kingdom: Fungi, Phylum: Ascomycota
MTLFNAVPPPPELASTPKKPTTATTSTVRSPPIATPPPAGYVFPSPARSTPIDIDAWTISALESLSVSPLARGTRSPLSINIDEQRQRKVKPSTVGTAEPRVARIYVEEDEDVDGREPIRRPPSRRDSMRKREMLLKGTEGSRQRRRWENDRLVGVPNAQPPTPSDWQPHPTHPVHHIPYALASYWDQHQLRTTSNSQRNPIDSLQKLHLDRTSAIQAASKRAQLARGTATGLGAGEVPRDLREAAKRSQVVKGWVKDLEIPIREWVRRERKGEEEDVGSDEEEIVFKGRGQTNGEELVDERKHKSSDSKMVLDSFGDVENASYKYAFTHAFIALAWFRSAFANFSGSLPQALAHAFYLSLLWPSIAICRS

SEQ ID NO: 3524 - protein, 166 aa, Unknown
  Kingdom: Fungi, Phylum: Ascomycota
MSGRHSGQSRGSSSRRTFRRSRSIKSDDPLVIQGPLDIQGSVKSGGSIRFDGDFMVKDKIDAYGAITIDGNVSCDGKMKAYGNIVVNGCLVAGDKIKGYGKLKIVGNVQGTELEIYGNLSITGYLQRLIVYGSLTLVGRESSYSVSEYEEIAGAKLIRDQEADWDW

SEQ ID NO: 3525 - protein, 558 aa, Unknown
  Kingdom: Fungi, Phylum: Ascomycota
MSASTFTVLQPKPVPRGTDDFEVKRAAILKEFKDKVPTEYYIPKDLIDNAGRDVSGIPAKCGILTPEELRITEDYDAVSLAEAIASRKLTAVEVAKAFSKRAIIAHQLTCCLTQWFMDDAVAQAQKLDEHLATHGKTVGPLHGVPISIKDHMPVAGTKASGACLSSIVQSDEDAHLIRILRDLGAVFYCKTNQPQSLMHLESDSLWGRVLNPYNIDLSAGGSTGGEAALIAMKGSVLGMGSDIGGSIRGPSAFCGIYGFKPTSYTLPFDQMLAKPFGGELNVLCCVGPMGRSIRDMDLVLRSVLATKPHLDDPKLVPIPWTGLTTPINRVLKIGIIDNDGLVDPQPPVKRAIAWARKMLSDPKYANIIEVKPFKPHGAPEALQKIRRMYFPDGGAAVCDAITSTGEPIHPLTEYTVRDAAEDGMRTATDAIYMRRDRDTFRNAFAKSWNEQDVDVVLGPAYVGPASAHDTAFTWTYTSLYNFVDYPGVVVPTPIVTEVGEEYDESYKPLSKECKQVHQLWGETNFEGAPINLQLVARKYHDNELFGALQILKDVLQLS

SEQ ID NO: 3526 - protein, 397 aa, Unknown
  Kingdom: Fungi, Phylum: Ascomycota
MTSSSLSSPNAIPPRTSSTSAAHARPSDNIASSPPPSKSVLRPVPEGDWLSQKQQQQRFGRDATATTGPLSMTGMQPPNGPPNPQRYADDDFDFTAKKSWTGDKEKVVRGPFEYVISHPGKDFRSQLIGAFNAWLEVPADSLEIITKVIGMLHESSLLVDDVQDSSELRRGFPVAHNIFGVAQTINSANYIYFVALQELQKLNNPLAISMFAEELVNLHRGQGMDLFWRDTLTCPSEDDYLEMVGNKTGGLFRLGIKLMQAESKTPFNCVPLVNLFGLIFQIRDDYMNLSSSEYSNNKGMCEDLTEGKFSFPVIHSIRTNPSNLQLVNILKQKTTDVQVKRYAVAYMESTGSFEYCRSVLAVLIERARKVADGIDEGRGGSKAFQKILDKMVVASEG

SEQ ID NO: 3527 - protein, 312 aa, Unknown
  Kingdom: Fungi, Phylum: Ascomycota
MATSRSAMRICARSARLPSCARHSTRSFSNTQSLAVAPDSTNSTQQQTKSTHFGFETVPESEKEGRVAGVFTNVAESYDKMNDFMSLGIHRLWKDHFVSSLNPGATTPQGQPQKILDVAGGTGDIAFRMLQHSHSQNLNPNIHVTISDINPAMLSVGQQRSLELPASHQACLSFLEANAEVLPKQVEDNSLDLYTVAFGIRNFTNIPAALREAHRVLKPGGVFACLEFSKVDKYPLFNAIYKQWSFSAIPLIGQLVAGDRDSYQYLVESIERFPSQEEFRGMIQDAGFQVAGKGYEDLTGGIAAIHRGIKPL

SEQ ID NO: 3528 - protein, 1214 aa, Unknown
  Kingdom: Fungi, Phylum: Ascomycota
MASEEVAATAQTPAKDAKTATPAAGSAKQRTIMSFFQKSSPGGPAPASSPLAKVSPRTQASPSSCLQETTKANALPKIRKPSKMSTPVASSDAVEPTSSQENHDAAATASDDAPTPKPKLKSAARTATEKKTPSGGSPGRKAKKAVNYAESSDEEEPFTFASSKTRRQNRIRPVVKEEDEDEFDLGDDDDEEDDLMEDFVVSDESEDSNAQSKKRKRPSKPQSSRKRSSMMPEQEPEDVAGKDEDMSLADIPPTSTGQWSYDPDSSDKRPVTKPADRTPKNSNVKEKAYTKEPEQRYTWLAKIQDKEKRTPGDPEYDPRTIFIPPMAWAKFSPFEKQYWAIKQNLWDTIVFFKKGKFYELYEKDATIGHQEFDFKMTDRVNMRMVGVPESSLDHWVNQFIAKQYKVARVDQMETNLGKEMRERQDKDTKKDKVITRELACVLTGGTLVDGGMLQDDMAAYCVAIKEQIIDDCPTFGITFVDTATGRFHLSSFTDDVDYTKFETIVAQTGPRELVLEKSQLSTKALRILKNNTSPTTIWTHLKPGSEFWDADMTRRELNRGKYFANEEEDEEVWPEVLQQVKDDDLLFSALGGLVSYLTFLKLERPLLSQGSFELYSPIQKNGTLVLDGQTLVNLELFSNSVNGGSDGTLFSLLNRCITPFGKRLFRQWVAHPLCDIDRINDRLDAVEMLNKDPTIREQFASQLVKMPDLERLISRIHAGACRPEDFVRVLEGFEQIEYTMTLLEPYKGGNGIVDQLIRAMPDLDEPLSYWRTAFNRQKAKQEKILIPEVGIDEDFDQSLTQMDEIKGQLNELLASKKAELKCRSLKFTDIGKEIYQMETPKNVKVPSSWRQMSATKDLKRWYFPELTNLVRELQEAEETHSQLVREVASRFFRKFDVDYDTWIKAIRIVAQLDCLVSLAKASASLGEPSCRPRFVDEERSVVEFEELRHPCMINTVGDFIPNDIKLGGDQARISLLTGANAAGKSTVLRMSCIAVIMAQIGCFVPAQSARLTPVDRIMSRLGANDNIFAAQSTFFVELSETKKILSEATPRSLVILDELGRGTSSYDGVAVAQAVLHQVATHIGCIGYFATHYHSLATEFENHPEIRARRMQIHVDDEERKVTFLYKLEDGVAEGSFGMHCAAMCGISNRVIERAEVAARDWEHTSRLKDSLEKAKTGCYIPLGMLSDVSSLLSDKSEVGEDALDVVLKAIGRL

SEQ ID NO: 3529 - protein, 293 aa, Unknown
  Kingdom: Fungi, Phylum: Ascomycota
MSATSSEISVRSELPPGYDVGERHGDTPVFSCPEHGCDGMTFYTVEECKVHQNDWHEGPYLCTCSEKFAARPALKRHIRLCLHQEVKPETLACDAICCPKFEEPIKGSSTLSSHNRTATHQAAVERNKYFDNIREAVEKSIQDRILAFRSLICDAPNCPEFDRQWSSPYSFLKHVGSEEHARYNAAFEKAMTSGSARLANQEKRSWIFQCHRERCDEFRQRFRTNLDYREHCATDSHIQASKVVRSRLQTPDPRTQVDDLQDTGLLSPPLTEPSGTPRKPTRVLIDLTGSPNW

SEQ ID NO: 3530 - protein, 752 aa, Unknown
  Kingdom: Fungi, Phylum: Ascomycota
MLAVTSAGQTALWLRPITYVSLDLASPYFAEPSEANFTLVQNVPTTSRKALKDIASFIEEDDSRTQCVTLEENVKEFGLTYFGLGDKRQGIVHVIGPEQGFTLPGTTVVCGDSHTSTHGAFGALAFGIGTSEVEHVLATQCLITKRSKNMRIQVDGELAPGVSSKDVVLHAIGKIGTAGGTGAVIEFCGSVIRKLSMEARMSICNMSIEGGARAGMVAPDEVTFEYLKGRPLAPKYESEEWKRATAYWTSLQSDADAKYDIDVFIDAKDIIPTVTWGTSPEDVIPITGCVPDPETFKDEAKKATGRRMLEYMGLTAGTPMQDIVVDKVFIGSCTNSRIEDMRAAANVVKGKKIAANIKRAMIVPGSGLVKKQAENEGLDQIFVDAGFEWREAGCSMCLGMNPDILAPKERCASTSNRNFEGRQGAGGRTHLMSPVMAAAAALTGKLADVRNLSQYTDSPHVAAQITPSGKAHVDERVEESAEELEAIADQPEDSQPHTNTSAAAAAAGSGDSAGLPKFLSWKGIAAPLEKSNVDTDAIIPKQFLKTIKRTGLGSALFHAWRFNEDGSENSSFVLNQEPYRSAKILVCTGDNFGCGSSREHAPWALLDFGIKCVIAPSFADIFFNNTFKNGMLPMRIPDKKDIDAIATEARAGREIEVDLPNQLVKNAAGETICSFEVEEFRKHCLTNGLDDIGLTMQMEDKIADFERQMSIKTPWLDGTGYLRRGKDGRLAAKAVPVPKTNRGEEKKEPLDW

SEQ ID NO: 3531 - protein, 858 aa, Unknown
  Kingdom: Fungi, Phylum: Ascomycota
MAPKQDTPFRSADMSMVQLYVSNEIGREVVTALGELGLCQFRDLNEEVSAFQRTYTQEIRRLDNVERQLRYFYAQMEKTGIPLRKLDLDVERLASPSTSEIDELAERSQKLEQRVFDLNESYETLKKREGELTEWRWVLREAGSFFDRAHGNVEDIRASTDNDDAPLLSDVEQHNSAPDVERSFSGMNIGFVAGVINRDRVGAFERILWRTLRGNLYMNQSEIPEPLIDPSNNEPINKNVFVIFAHGKEILAKIRKISESMGADVHQVDENSDLRRDQIHDVNNRLEDVQNVLHNTQATLQAELNQISQSLSAWMVLISKEKAVYNTLNLFSYDRARRTLIAEGWCPTNDLPLIRSTLQDVTNRAGLSVPSIINEIHTNKTPPTYLKTNKFTEGFQTIVNAYGTATYQEVNPAMPVIVTFPFLFAVMFGDFGHATIMLAAAVAMIYWEKPLKKVTFELFAMIFYGRYIALVMAVFSLYTGLIYNDSFSLSMTLFDSAWEFKKPENWSERMPVIATLNDKGYRYPFGLDYAWHGTDNDLLFSNSYKMKMSIVLGWAHMTYSLCFAYINARHFKKPIDIWGNFVPGMIFFQSIFGYLVMCILYKWTVDWNAIGKPAPGLLNMLIYMFLQPGQIEEGMNLYPGQAVVQVILLLVAFAQVPVLLFLKPFYLRWEHNRARAQGYRGIGETSRVSALDGDDDEPRANGHGDSFDDGEGVAMLSQNIDEEHEEFEFSEVMIHQVIHTIEFCLNCVSHTASYLRLWALSLAHQQLSTVLWSMTLGPCLKMTGVTGVIAIVIGFTAWFFLTIAILVCMEGTSAMLHSLRLAWVESFSKFAEFGGWPFAPFSFDTLLEESEDLKEYLG

SEQ ID NO: 3532 - protein, 79 aa, Unknown
  Kingdom: Fungi, Phylum: Ascomycota
MDSSLHEVWQGAAGSPFLPAIGKNSQFFVGFTLFVIGLLLTGVFALNRSLINVGVLGVPASVAVAFGTVYMFCAVGVYV

SEQ ID NO: 3533 - protein, 560 aa, Unknown
  Kingdom: Fungi, Phylum: Ascomycota
MSASHFPEKGPPADSGASQANSNDNGEYVDINGQPDLTAGSQALHRKLRGREVQLFAIGGAIGTSLYVQMGSALPKGGPAGLFIAFVIWGTIMWCVNECFAEMVTYVPVPSPFIRFGGEWVDQALGFAMAWNFFLNMAFLVPFEIVALNIMITFWTDKVPVEAIIVAMIVLYTLLNIITVRYFGISEFYLSIFKVILMLGLFAYTFITMVGGNPKGDRYGFRYWKDPGAFVEHLAPGDIGRFLGILSCIYQASFSICGPEYISMVAAETERPRTILPPAFRAFVWRILIFFVGSAFCMGIVIPYNDPTLNAILGGEQSGSGTGAASPYIISMQRLNIGVLPDIVNALIMTSIISAGNGLLFAATRTLHGMSLQGHAPKVFSKCTNAGVPIYALLFSLLFTLLAFLQSSKSSVEVMNYLIYLVTCCQLINYLCTAVTYRHFYSALKKQGIDRNTLPYKGRLQPYTSYVAMFGTTFMMLASGYTLFMNGGWDVMWFFLDYGMIGFFIVAFVFWKIFRRSTYVRPGNADISLGGLKEEIDNYELLYVPRPRSKASRWFNKIFE

SEQ ID NO: 3534 - protein, 1228 aa, Unknown
  Kingdom: Fungi, Phylum: Ascomycota
MDATDADQDVKLQKISHDLLHQFDAGLSNFLRKPDGNGGTTPRSRVRSRELFRLTSQVLDPFQELPQLLDPHLPRWIPFLSETYLDLLLHAQPQQAGRGVDPSQHLVSAEYAICKLLYTFCKIRGEKVIVRFLNVEARYLELLTTAIEAAEEESDEESEAKKGWAWEQRYIVLLWISHLLLAPFDLSTISSVDLDDMVVPSIPHLSWPADLPGIAMRVIPLGIKYLASPGRERDAAKALIVRISMRRDMQQLGLLDRLVAWALACLKAGEDAEEKAPYYYIGVLSFLAGALRSSSDTSDMDKHLQIIFETVHTISVDESSSSKAIISLALARKMILKVMRSVVVSLLRQPGQTETNTELTETAIGYLLESVADNDTPVRLLASKSLSIITLKLDPFMASQVVEAVLESLNRNVLWSKPSAASGEKPTRDLSAVNCLEWHGLMLTLSHLLYRRSPPAAQLSDIVHALLLGLSFEQRSTSGGSVGSNVRDAACFGVWAVARRYTTEELLAVPTQSVFAARAHSSTSSIIQVLATELVTTACLDPAGNIRRGASAALQELIGRHPNTVQEGIEVVQRVDYHAVARRSRALDEVAHGAAELSAQYGVAVVDSILGWRGIGDVDAASRRDAARGYGKLVAELASRSPEPISQLSTAIKSIDVRLKLLAKRQVEERHGLLLCYAAVVEQIPPLQVREKPGQSLDEETVIKVIDSVISILRECSEIAFRKPDLIAEGCSRLVVALVPLLTSMALNDYQAPMPILSEHLTTSHSDGSSMVKSIDSAYAPIVPAPIAAFTAALLSALPAWLARDEQFLLEPISEAAVTFLLFSQSEQRQKTIQEWTDAIRKKPTSRNSAYGDGYMHALAMAQTALPSPIDIGQAIVERWADDDDVGTRIAILQSLTRSYLLREDMDKLLPLLNDGLNDYTTNARGDIGSHVRVQALRVVHALWSSRGDAFRSQLVLSALFGNVLRLAAEKLDRVRPEAQAALALALRDEHRAAFQAITFSSETYFSTLLSFLSNGDRFHPAIQAHIKSDMSTLASQLMVGFTTSADTGNEDLVIASRAALCDFMTSSVDNACLIGSALLQNLRSYQGNDRIIIPTLEIIAFLFHVGLLGSADQTQLDLKALCLQTQKAGYKSGSMRKIEACVKVYAGIAFLKQPGAAQGARKRLGALLLHPWPKVRSTVVDEIWGLLCATESEMTDGSDKGERLLSVDWAKADKAQIRGVVEALGLV

SEQ ID NO: 3535 - protein, 607 aa, Unknown
  Kingdom: Fungi, Phylum: Ascomycota
MQEDAYGVRRRDTTKGPPLRVLSLDGGGVRGYSTMIIIQELMHRTFVEIEGRAPRRHEIPKPCDHFDLIVGTGTGGLIALMLGRLRLDLETCKELYVQLTRRVFQTDKTIAGIPYRSTLFKASKLEEAIKEAVRANTGENAQYGTSEDLTSPLNGGRQTGHPRRNLSNASTVSFSARSPAAQMARPMFATRGGDPNAKLYDPRENRTKTAVTAVYKGSPKGSPAALLRTYDSRHEPPPEFDCTIWQAGRATSAVGLAFKPIQIGQSVFHDDGAGTFNPAPEALDEAVVNEWPGREVGVFVSVGTGKRPKSSDSNTNLWYEGFLGEFAEARKRLIAKIENCETIHEFMLRDYLAKRGVLADNYYRLNVEIGVGEFGMNEWNRLGEISTSTRRYMARHEEQKMVRGISTKLAKIQKARVRNERSARGIPEIVKSTSTTTMENPFAVELPGDIPPSPSYSQSPNRPSFDSGISDGLQVVQPQTHGSPRSSRSHEHLSAHNGASPLSSGAPTPSDDPDRLLGHAPTPSQYRTASGNDKIAIMSPDEHPRPPMVKQSGPPSTRIEPPPLPPKTPLPERQQDARSARTATPPYPMDEAPPPVNMARKPDLRGR

SEQ ID NO: 3536 - protein, 847 aa, Unknown
  Kingdom: Fungi, Phylum: Ascomycota
MGASDSKLVFKQGIFKLSEERHIAADDPYWTSFWELPESSEDVFSLFAAADIRRTRDKALENLETLILAVTSRLFILRHHPSFPDADIAPERDALNCIRVLTRILPFIYEKDSLKTWEEKFFWGARRKKTRKASIANEVLFDESQQDKAQVDSEVVEYEDAKPLAEELIDTLVDLLFFSSLTLPEQPQGRSKVTYAIWQSGVGCNTAVATTKEFESNRAEILRLLLTLAGQSLYTTPAVLPQEGTLKYNPATWRVPYNTLVFKDAKEVLVTYSLQLLLAILVYPIPEHSDTQKNYYRHYLGRLHRPQDFQFIVDGMSRILNQPLQEKSSYLPGSQTSAVFAPEVLMLFWEVTQCNKRFRSFIIDTDRAHDFMVLILFYALEYKNEATKQGLVRMCAFMLQTLSVETNFGTSLNKTFEGQDSLPASIRIQGFRGSYADFLIQSIYHLITTSQGKLKAVYPALLAIINNVAPHVERLSPSTSSEIMQLLSSMSSPSFLLANDTNHTLLFALLEAVSSIVEHKYRKNPQLLLAIVRHRKKIEGLRTFTLESGQQEIEKRNRNRKDSGAPLDSLDEGSMRSSVDSTRSPATTPTRPQALAGVPEDDAFAIGDDEDDSDEEPMPTPAQSTTSENPSQASSAGNADEAVPVQLRGMSEKARGKMPAAARSFSRQNSTTSLAAHSITGHSPSGSFEPTAHWIDSWLPELPLHTILTVVQQLSSLSPRQISSRDMTNPEVVQRVQKVDLVGIEPTDAKVHSFEWSQLALGWYESLLWGIIFTSELQLAKGSMGTWIGTSIKLFRVQETAPTGPSLTSPRGAVDAVGSNIVNRIGQINLRGTGGTGSQPAAPRASP

SEQ ID NO: 3537 - protein, 472 aa, Unknown
  Kingdom: Fungi, Phylum: Ascomycota
MQLKATLIALAGLSAVCEAGVLSRRTPLDRALARRQFGGGFGGGNNGGNNGGNNGGDNNNNNNGGNGGNNNGGGGGGATLLDENRQDGSNQDGQADQDAGQSPSATDPDNFINFCTGQDVTNGEQKEGGSCNGIPMGRIPGTGNMVASIITNPLNGADIQADQDFTIEVRMNNFAPGTFTNPANTYYSAPQDLDGGGNIIGHTHVTVQDTGADTNPTQPLDSTQFVFFKGINTPANDQGLLTADVEGGLPAGNYRLCTMASSANHQPVLMPVAQRGAQDDCVRFTVGGNGGGGNNNGGNNGGDQGGDQNAGGDQGGDQNAGGDQGGDQNAGGDQGGDNNGGGNGGNSENPSDNDGGNNNADGGDQTGSEEDSAGSGDSGAGDGAAEGTNGGNGGGNNGAIGGITAPEVTDTGDGDRPFGVNGNSFVNREAAVQRACDIQNNACSDAVNRGEVNGSTLADCNAQVATCVSNLS

SEQ ID NO: 3538 - protein, 586 aa, Unknown
  Kingdom: Fungi, Phylum: Ascomycota
MHVDELTTEGRPRSSTHPDSHPVEDLPLSLSSSLHSSTDDDDDNLDGHRPALREIRSSYSYRNRSSSRSVSRHNSQAIGATGTSLYASPTRRTSVLDRIRSRPQNVFTHPLAHTPTSQGSIVDFDGPDDPYRPMNWPMRKKIVTTLLYGLVTMSATWASSSYSAGTEQVAKEFKVGTQVAVLGTTLFLFGFGLGPLIWAPLSEVFGRRPAVMAPMFVAICFSFGSATAKDLQTLMLTRFFGAFFASAPVTNTGGVLGDLFSPAHRGIAMAGYAMAVVGGPSLGPIVSAAVVIQPSLGWRWTEYLTGILQSFILIIAIIFIDESYPPKLLVYKASRLRHETGNWSLHAEFEEWDVSIVELSKKFLIRPVQLLCTPICFLVALYASFCYGILYMQLGGIPFIFGELRGWKPLVATLPFLCIFIGATVGAAANVYNQILYNKAYHAAGNRAVPEKRLPPMMLGSLLFSGGQFLTGWCAKPDIHWIVPCLGLVMLGSGFFMIFQAALNYLVDTFTAYAASAVAANTFLRSCFAGGFPLAVTPLYRNIGVGPGSSITGGFAALLIPVPFVFYAFGKRIRASSKWSKASVYD

SEQ ID NO: 3539 - protein, 128 aa, Unknown
  Kingdom: Fungi, Phylum: Ascomycota
MSSFPDTIKYLLNLIMPGKDITPESGHATATIEGQPVATTTSWLRCEGNVYFPRDTLVGKEDGVVFDNTELLTYCPWKGHAGYYTVKIGGTTYKNAAWSYEDPYDKALAIKDYVAFGYKSKVSIKVNE

SEQ ID NO: 3540 - protein, 404 aa, Unknown
  Kingdom: Fungi, Phylum: Ascomycota
MHFSIALVAATIAGLGQVQAAPLEGSGLENRQADPLLPEIDPSSDAVDALLELQKAAEEALADQEDSRDGSSKCTLANARVRKNWSRLSSQERKDYIKAVQCLRELPSKGPAEWSAAQNRYDDFVAQHVDLTIEAHGSGPFLTWHRSFVWSYETALIEECGYKGTQPYWNWFEDTEDLTKSPVFDGSDTSMGGDGEYVAHNGSLGGARHIYLPSGAGGGCIKSGPFKHAQANIGPFNPAMDGLGPIVQELWDHNPRCIARDLNSYAMGQWYRTEYLLNVTIGEASRTHRTFWSEIQGRYPDQFLGLHTTGHYAINGDNTDLYSSPNDPAFFLHHTMFDRLYWIHQLLHPKEATKVTGTMTLQNNPPSRNATVDDPIRMGAVGETRPIKDFFDPLGGTPLCYTYQ

SEQ ID NO: 3541 - protein, 467 aa, Unknown
  Kingdom: Fungi, Phylum: Ascomycota
MPPPPGCPLRTSANDDNITNSSTTSNYIANKPPLPTAVVRGGFNRRTGVEVLVPPLVSGALVAAFARAVAEGLGNELLTHYYFTTSTTGGTSSTVNVDRVLDRLLAEFTRALWDELFDFYTGNGRGYTRQVARLFDGPIRQIAVVLNGPETATCLLDHIGPGLSRRKLTWSKDATGIELGLALQLICGYWHREYPDHSPGGSPEEISRVLCGRLVNGQAARGLVNNIKKVLLSPHYVQLHILETTVWDRILKRRRPPPTDGFHVAQFRFECQLAIKPGEYASPEDIDLSARQTITGTSTECQLSTVLEYVDKRWQRCGRLVLAGLNNAVKAAYCASEEGEGFSGMFIWDGSNDDGQGDFCPGLRLLHFEVENGLIQLTACAWALSLVEIFQQMAWMCAALGSAPTLEDGRATESAVDISEGSYEGDTMFFNCSMAHQLVANGGAGVPWLREIPGAVMARGFPVDVGQ

SEQ ID NO: 3542 - protein, 480 aa, Unknown
  Kingdom: Fungi, Phylum: Ascomycota
MKVGANITYIIMITELMVRKDVLKRRDSLAANLGAKLTGPRLLKGIDNFFEGSIVIVSQPNYPVTVTWSDVVLFAKGNADEFKLSSHPDGTRRCQFPCKGCQVEIGEDDWRLISSGALEGLALEQSFDDDEKAEVATLDIIEQRASILYKKADEVAARARILHHTLGQRRSEITRRRESQDPPSHRQHARKSGFGGTYDLHADLLQQFVAATNSYSQSRSTSGAGLPLTPVGQRSPSMPMPFSRQASSFSRPPTTSGTATNTTTNNHNPDTTRTTPGANSPSDAFRALITQKTDKLFKGDIINPPCDRCRRLRLACVKHLTACQGCTKKHAKCSWKAVPEEEAVRLRQDLGVSSADSDAEPPGEPRLPTWSGGAQIFQFSGHASGRGQGEEGTRPESREEGTATPTPVFNRVHNANAGYELAPIKSRTGLPNGPDSDNSSLPRLNEHALGHIANMATQANHEGHSHHIDYHGDISHPSSR

SEQ ID NO: 3543 - protein, 435 aa, Unknown
  Kingdom: Fungi, Phylum: Ascomycota
MLRLFILSFIQKKRNESNPEITLSMPSSPPTFVDGLDLSGTIRTGLTRHFHRKSRTGCQKCRARRVKCDETKPHCRNCIKHGSDCIYDRPDRNVVARATRRSNHASPSNPGDVDAVEPGESMERRMAELELMHFYVTETGPSIPFDKETSHNLYVKAIPRMALKSTALLYSLFAMAALHKSTSEHNSEPKPEATNVRDEHELYSRLAFQHHRQEVSNMEVENMDLLFMTGNLMRLMASFILSQRVLEPYSPPVEWLRITKSHYKLYETAWSMVGDDHATQTSAMIQSTLQDWREITGSGSATGPQRFGHLLEPLPGVQDDPSLWDPPTREAYTSTVTYICELSQSAERKDHFPVVARRIIIFPVMVDANFVALVEEAKPRALVVLAHYFALLTMLSEWWYVGDTGTQEITALAKHLSPPWDELLEWPLRVVREGV

SEQ ID NO: 3544 - protein, 1092 aa, Unknown
  Kingdom: Fungi, Phylum: Ascomycota
MAQTGSMDDFVNWDQAGAAFDSSQNQQQSGHPSASPDAPFDDNIDLVLANVNEDDFSFHALQHFTNELSAPFDLIDPGLQDANIGASGPIDFPAMQWETPAVPCAQCALGGYSCKKIREGAYQGFCTSCVALMIDCSFGGVVPSSLNPASTTLPPVESTAAWASSGVATPLIEDGEHHVTDPLQPLSSASALELFNMANTSSDTTDARAQGPSAANANPKVGARLSRESVRVLKNWLSTHNRHPYPSDEEKEMLQRNTGLSKTQITNWLANARRRGKVQPNRSTSPQVGNWSSGVDIPKRRGTPALESMNPLQRWQHSPPEHEPASVTAIARAVTTSSSAISSGLNSPFSSFPYTDDGSGRSLCNQSSASSIGTSHSSNGSRGSAYSHGSRNSFGSFGSAPFSNRSHRRRRRRAAPRQSPEGLRPSGPLKTFQCTFCTETYRTKHDWQRHEKSLHLSLERWVCAPEGARILRPETGQICCAFCSESDPSDAHIESHNHSSCQERTLEERTFYRKDHLNQHLRLVHNVKFADWSMKSWKVAAPEIRSRCGFCGIVLDNWTTRVDHLAEHFKTGKSMADWEGDWGFEAPVLAMVENSVPPYLIHHERLSPLPYVAGRASPESPRTAYELIKLELAYYAANYQQQSQNDTAPTDEEMMIEACRIIFASETLSLQGIATQVSWLRDLIMKNSDIAQKARFSPLRSAVENRLATLKINGKDNLFEECPMEQQLHEFVKAKRLLGLTAMDNELQEEALKIVGRVEEVSTNPSESVANWLVRLATSSTEWLAPFRQRASLPRTDDIKHAIIRSTDPTLIDSTIHSYSRLERELADFLRAQRSLGIEPTDEDLQRQARIIIYEFDDGWNQTAADSIFWLAGFRSRHQADGTSPAASGVSSAFSHLRQTGSTASTVPSTTGPQVAGVVHATVNQGYHHMMGDRIVLNQSNCYRGLDRELIRFVKSMMSPNNPNQHIPTDAELQHQARWIIHNDDDPWNWTAADSPEWLANFKRQAGIAPAEPSITAATIDSWASLSQPNTEGGVVSHNTLTQPVAPVPRSAAEVTMAPLAMEGNAGLQGMDWDFGDELQAFGGVPLGSLNE

SEQ ID NO: 3545 - protein, 360 aa, Unknown
  Kingdom: Fungi, Phylum: Ascomycota
MVNYPEKFAGFQSPGLENWTDFKKNDFTPRPFNEEDIDVEIECCGVCASDMHKINGDWGDCPYPLAVGHEVVGKVVKVGSKVTLAKVGQRVGVGAQIYSCLKCKQCKNDNETYCAHQIDTWGQEYMDTGHITQGGYSSHIRVHEYWVYPIPEKLNSVQAAPMLCAGITVYSPLKRFGAGPGKKVGIVGIGGLGHYGVIFAKAMGAEVWAISRSRSKEEDARKMGADGFIATSEKDWNVPHKMTFDLIVNTANTTDGFDLNQYLSLLDVHGRWNSVGMPGGEGFSVKNQDFTENGCFIGSTHLGSRSEMLEMLQLAADKGLQSWVEELPIGQPGLKEAMNKLETSKARYRSCMVGYNKEFA

SEQ ID NO: 3546 - protein, 643 aa, Unknown
  Kingdom: Fungi, Phylum: Ascomycota
MSAFTALNGGSPSRSEPPSAISETNFNPDDRPRSSAAHSQAGTENSTQRENWTTQGAEGSATRNSPKADQDPSLKRKRSTSIELRREHPTQERTPDTATAPPHGEARDPFDTPQRDREQWYAHQAREDRSHYDVPQSARTSPGHMEDHIGDALRRATQGDRSEYDHTSPDGDERSTGAYGSPHTTHRQGSMLQHDPKKRKRNFSNRTKTGCMTCRGRKKKCDETKPECVNCVKGGFVCAGYPAQKGAQWQKPNDKTPTVPLESKDPSYVPPGAYGMPQPGSYPSQSGKREPLPPYRGQALRIDPPQGRSLTTEDDRPTASTIPSASVASPDNKLSAISTFTAGNMFPTPVSANTQPPPFGERMSKEYQRVPPLHDLARNNEPETPHPGGHLPQINILHASRKNSPTQGGQQHSSTNPQVAAQLALSHPGFPGRRTQKEEMLSGRSYYPFDKELCLERERCASACWRFNNLTVPSHGVSHEERGRLFLDMLQPRDPVRVSPTEASPVTNVGRVGREVAVETPFTCDYGYNITIGSHVAVGRNCHINDVCEVKIGDHCVIGPNVNIYTATMSTDPKRRMGGQGPQTGKPVVIEQDCWIGGGAIILPGKTIGKGATVGAGSVVTKDVPPFTVVAGNPARVLRGIAS

SEQ ID NO: 3547 - protein, 474 aa, Unknown
  Kingdom: Fungi, Phylum: Ascomycota
MSQAPDYQNIFHWAETQKDGAIPSFATRKNDPYEYLPGFNNHFESEAVPGTIPQGQNNPRCVRFGLYTEQMTASAFNAPRGANKNAWLYRARPAVAHQGFTDLPTVEGTESCFLPLNPKVKVSPTQLAWLPFDVVDGADFVSGLRTIAGSGDPTLREGLATHVFTATKSMENRAFVNSDGDYLIVPQQGSLDIQTEFGPLYVQPGEICVIQRGQRFRVSVEGPTRGYILEIWGSNFELPELGPLGANGLANSRDFLHPKAKYNITKDDPWEIVYKMGGKYFSSKQNHCPFDVVAWHGNYVPYKYDLTKFVNVGSISVDHIDPSIFCVLTAKSRDQNAPLADFLIFSPRWDVASHTYRPPYYHRNVASELMGLIYGEYGGRSDEFQPGGVSFECGMVPHGVAYQEFKAASAQPPPEMQISKGAIAFMFESSRQFTVAEWAWDSEKKHVHEPKMWDDLVDNFSSHLDEVTEILAKK

SEQ ID NO: 3548 - protein, 369 aa, Unknown
  Kingdom: Fungi, Phylum: Ascomycota
MSFFFNRARTKPAADLPRQARELITRLDGPGGQAKADELARILSQMKFVLQGTQEAESSPEQIYQLVTSLIDEDLLLLLATNLHRLPFESRKDTQVIFSYVFRFRPAAAAPKSDPIALSYVVCNRPQVLVELCRAYDHKESAPPAGSVLRELLKNEAAAAVILYDDGDVEGSSSKGLNAIDRDRPQSGRGVFWRFFDWIDKSSFEVSADAFTTFRELLTRHKDLVPRYLTVNFDLFFQKYNTTLVQSNSYVTKRQSIKLLGEILLDRSNYSVMTAYVDRGEHLKICMNLLRDDRKMVQYEGFHVFKVFVANPHKSIAVQKILLMNREKLLTFLSHFLEDRTDDEQFIDEREFLIKQIRNMPPTPVAPQR

SEQ ID NO: 3549 - protein, 384 aa, Unknown
  Kingdom: Fungi, Phylum: Ascomycota
MASLGNALWPAEPSTSLIITTTAIATIGALFLGRAAGWPTRPKVLPNPLKTFPEGSARRDELEKLIYKPDTFPGARDVETPYGSTRVYEWGPEDGPKVLFVHGISTSCITLMHIANALVKRGCRVMLFDLFGRGFSDGVGDLPHDPRLYTTQILLVLASSPLAWTGNNAMRLVGYSLGGGIAVHFANAFPDLVESLVLLAPAGLVRTESFGIVTRVLFLSGLVPESILSRLTRQRLQQPIAAPKMPRGTKPSDPQADIALSEAAQSNNEEKLIPLERHVLFYVRWMVAHHSGFVNAFMSCVRYAPLTYQHEYWTGLAKRKPGTTAIYFAQADEIIDSDYYAKEALPLVGGKDHVDWRVLPGAHDFVMTHTSELMAALDEFWSKP

SEQ ID NO: 3550 - protein, 810 aa, Unknown
  Kingdom: Fungi, Phylum: Ascomycota
MTSAASAANQAGPPPAIQEPTASSPPSKRDLRSWWKNFKLQPKNQQEPAVAEQKPKGIFGVPLRQSITYANVAISLIDENGQSYIYGYVPIVVAKCGVFLKETATTVPGIFRLSGSEKRIKDLKTIFDSPDRYGKGLDWEGYNVHDAANVLRRYLNDLPEPVVPLDLYEKFREPLRGATKQAVGDAEGPQFVENFDEKAAIEKYQHLITELPPLNRQLLLYILDLLAVFAAKSEENLMTSHNLAAIFQPGMLSHPVHAMAPEEYRLNQCVLIFLIENQDHFLIGMQGTAADEKTKNDIERGTPIVNTPLTPTPNRKSGIGRSASNASAGADSVRREGKVRRHRSVSSRNSRQEGDLTPSSPAPVATPTSGGLGRSNTVPSKKSPALMGSKFKNASPGHHSPAYLEPVAQTPLEEVATPPEQHPAAAGSGTTLGAPVPSSVNARSQERLLDVPQEGLSTPSKERGNLVGIFQRSPTESSDKRQPRKLQKKKLPGSLNPSAQSSTTSLGQQHLAVSPAHELTASPLDQVQPIAPTPEHPIAPIAEQHFATIPEQTQGHEEQVTTQQAAVLPHESGDQSAELTPRASHVPSNNSLRPELVLRGKKSPPTSLHSSFNEGSDLEHTIDETVEGGGNETEEKEKKRRWRLSRRKDDGGSPEVRPTGELGVNQAADVSSTSIGSSTNKARKSFTNESSDPTLSGTEGPDGGKDGRDESKGLFGRIRNKYREAKERTKSPPANDGHNTGLLGRGKSIDIKREPPTTESHQSVPPPQQSATTQEPAPAPAPAPTPAPTHAPSIPEQPAPAVGEAETQKQ

SEQ ID NO: 3551 - protein, 519 aa, Unknown
  Kingdom: Fungi, Phylum: Ascomycota
MEKFPELDTPPPRFEHPSGTSSNGTANWAMRRDASQGRAVRWAAASRSGAEAGPRHSRQKSLGDAFRTIRSRNGSVSQNAHELADALRAPLSPKLIILCLAWYASSALTNTSSKSILNAFNKPATLTLIQFAFVSSLCVVMAWLATIFPVLRTKITALKHPIRAPSKDVIMITLPLAAFQIGGHLLSSTATARIPVSLVHTIKGLSPLFTVSAYRFVYNIKYPRATYYSLIPLTAGVMLACSGKSGFDGQSLGIIEALFATIIFVTQNIFSKKLFNEAAKAEADHAMGGAPSKKLDKLNLLCHSAGMAFVLTLPIWFWSEGMGLISEFLQDGNVDLSNPDAMDHGRLTMEFVFNGVCHFGQNILAFVLLSIVSPVTYSVASLIKRVFVIVMAIVWFRNPTTKLQAVGIGLTFLGLYLYDRTSESNKADRKVQMLAQTPGAVPLLPVNNDRSGGRSTGSTPLGTTPLAHPYTEGYFNGTLDPKKNDESGQRGRALGDASWLPPGTKQEDTWRANGHTGSQ

SEQ ID NO: 3552 - protein, 1112 aa, Unknown
  Kingdom: Fungi, Phylum: Ascomycota
MAPLASMSEEKETETAAAAATSNIGERIRWGGDDEEDPRPSRRQQRAHNRSRSTDSLSIHRAGSRSRTDPSLVLPVTYRTVSFNIEESKAKEQVKIAKAKDATTKALADLEWHTLSSSDVESCLTTSITNGLSSDQAKRRQGQYGKNVPSPAKTHWFRTIFLYFFGGFGSILLVGCILVFISWKPLGDPPAVANLALAIVLLAVFFIQALFNMFQDWSTSRTMSSIKEMLPEEGTVIRDGQLVHLPASEIVPGDVIQVKAGNKLPADVRFITVSTDVKFDRSVLTGESKPISGTVEHTDTNYLETHNVGLQGTHCILGSCTGIVVAIGDQTVFGRIASLTNEPKVKMTTLEKEVLYFVIIIASIMIIMITAVCIIWAAFLRKEHPDFINVPTLIVNCVSVAIAFIPEGLPIAITAGLTITANLMKNNKILCKSLKTVETLGSVSMICSDKTGTLTTGKMTVSDCAVGGLNMTIDGARGKFNQSQNHTHPVIQLRAIAALCNASEFDNATADVPSLTDRKIFGDATDQAILRFAEFVDTGSVAYLRACWRKTYDLAFNSKNKYMIRCFSCSKAEAVPATLAKGSSFDGKDTLLTIKGAPDVLITRCSHYVSEYGENVPLNDAMRTTLEALKNRYSSQGKRCLLLARKIVKATAVSSDANSTEFESLVTKEARSGLTLVGFVAIVDPLRDDIPHVVSTLRGAGIRIAMVTGDFALTALAIAREAGIVTSYTVDDSTALHRTPSDKSNSSSGDHLASSPSPQGAIVLSGPDLMALNEHQWETLTQYSEIVFARTTPEQKLRIVREFQRENVVAMTGDGVNDAPSLKAADVGVSMGSGSDIAMEAADMVLLESFGSIVVAVQYGRVVFDNLKKVISYLLPAGSFSEFWPVMAFVAFGVPQVLSSFLMIIICCFTDCAAATMLSYEKPEADVLTRPPRNVKKDRLVNWQLVVQSYGIVGVLQTVASFAMSFWYLERHGIPFNQVWFSFGKVPDGVDPDYYLARCNEASSIYFVNLVVMQWFNLMATRTRRLSIFQQPPLFNKETQNWYLFPAIVFSLVMAVFWLYIPPLQPVLGTTGVPVEHWFLPFAFGGFQLLLDEGRKYCVRRWPKGVLARMAW

SEQ ID NO: 3553 - protein, 250 aa, Unknown
  Kingdom: Fungi, Phylum: Ascomycota
MHRTGGRAFHRGEDDDVEQEYDRLRDLARAEAQKRNSCFDRSQQAYQSGDGAGAKQLSNQGKAHDAKMDDYNRQASEYIFRENNAPGRIDEDEIDLHGQFVEEAERILEQRIRADQQRGIVHLYAIVGKGNHSTGGVQKIKPKVEELCQELGLRYHTDEENEGRIFINLQGGEPPQAKPSHGGYQQHHGGHQQGHQNQGQHGYPGGQQQQHHGQQQQHGQQQGGDELEQAVKKHLPGVLRSLRKHCCTVM

SEQ ID NO: 3554 - protein, 111 aa, Unknown
  Kingdom: Fungi, Phylum: Ascomycota
MADVEMSDAPKAEGSGKAVEGKKKFEVKKWNAVALWAWDIVVDNCAICRNHIMDLCIECQANQASATSEECTVAWGICNHAFHFHCISRWLKARSVCPLDNRDWEFQKYGR

SEQ ID NO: 3555 - protein, 226 aa, Unknown
  Kingdom: Fungi, Phylum: Ascomycota
MSTPFYATFSPPPTTSRAPPQASQPPKPPPAAMSFDAVMPPYNASDPAATFLASSCLDFLLIELVPLAKRVTAERETETLVEKEGDAGEEEEADAVHHRLEMQGYRVGQGLVERFSRDRPRFNDTLDVIKFLCKDLWSLVFGKNIDNLKTNHRGVYVLTDSHFRPFARMSTEAGGQAVVRAQPFLSFPCGIVRGALAALGIVATVQAEINELPGAVFQIKTIPVKS

SEQ ID NO: 3556 - protein, 806 aa, Unknown
  Kingdom: Fungi, Phylum: Ascomycota
MLAADLLHGQGIDQLLHRVPIRRRRKGGEWTRTARRTASFIARDTTAGRVEDAQQAALDMEAKAAVIEDLGQGRGDRERWLIHTGFPMHLRGLSDAEVKSSFSLPRSARSLKLQPHGKGRAGASRDLDETAEGEDKELDCILAAAESLLRKAYSLMTDRSLDQKITHQRAQKVSDFAAGSGKKGKDIAFQCFKDESTLVAYFRRMKELLMYFYRVVYQEEGHFRRKREAQTLPEDMIKPTRKQRKAMDDMFAAVRRRATERKASGREEDQFEGGNDPELEHAVRRFYMRLICHNIGSSVFQSPVLSFCAMISRTTAYSGRSKIPEKARQKGTGDDDLNEAARKQRNAGGWSDPGNFSSSLSALVWTAQLILFEATCHYEGDNEDRIPETLGRLCEEFMHQKGETAFDHILQWRLYLTTVARSAISRRQARWSWDGMEITYLGTTLHIKKHVSQLILSEYRRARSLLYDVLLFGARDISPVEAWRLQDDLDAEDHGGSWMTDARNAELLRGTSFALLEEIERRADLRNIFLRDEPGTCESAQGADRNKAGKRLCEKAMAIYEASVQDFLKSISPLLHIPPMPPLRAPEFHTITYANSGSRRRGMLIWERMLMIHVRYHKSLEQTVKDADNVRFVPTAIAELILTFMAVVQSLRLVFLRQVKPGNLLSPYLFSRLDGTLHNDPDFQFRRPGQRDDAILATMGPAAAEQVVVVLASTETDAGPGGKQGHSTTGCPFADRVMPLCYGVFFTPGPRAFINKHTRAVPQRGGLHTMAWRIDHFWRLALHSGSSTSSITARGTWVVITASSVS

SEQ ID NO: 3557 - protein, 634 aa, Unknown
  Kingdom: Fungi, Phylum: Ascomycota
METTPSKAPDLEQVSSGDQSDQASVEKIKLLLQAKDDTQRFVGLALLKSVLDNTPALRDENETIQELWTSIPVKFLDRLLRTGAKPSNSNAKDMLDLAISVLHTLALLLPDEVRCEARFTGRIPLLVSSAVHTNPESTELLLQLLQLLVNSQAGASIFVAIEDTSPLTEIAPSHESAMDVLSFAWLSAMAVPEQQSLLRSQIDVALQNLASSFRNTDATTFLSFVGNFFRQASAEVLPTNLKWLTTAVLYIRNLVVSRPNAKARAAYTNAAASLLQSYPKEVPSRLFTDECGDETPFGYLFVNLLLIDIRSSTPALLQQLNQPEYAYISRRLASAFDTISIFIGFLIRSLEDESSDAMVMSPDSLLKLRKGISETMSVTVEYLRDRWDASVAGAMGLHPDARSETADTFAGTHFTLAWDSMKDNADEDPLIQSAIRALALWLREDDNDMLRKEATGLTDMFLDLYRSSATHKLDFRSPILVAFEALMTLNKGRRIFLEQDGWLVLAQDLSNILKNTSSNGDVEAARGIEVVRILLSVVENAETKNITDQQLDLITTVAGCNFDARSQSQTLQEFEVAVMMLCCTLLSEAPQVARKRFVHSISALRGIATELRPRLENPELVEDISEVVTTLHGL

SEQ ID NO: 3558 - protein, 180 aa, Unknown
  Kingdom: Fungi, Phylum: Ascomycota
MASTPTPTPAHKASIPFFYRLSLLYIEPIFALGGALILHFDPAAFLTTMTPSPTPDSSAFRSFRVLTDQLAAMQVLLAFNLGVLLRFAANMEDERIGNKLWRLCCGGALICDGLHIAASVRELGWEVASSPGTMWRVEDWVNFGILGWMTVMRLGVCLGIGMSDGTSSQQSERAVKDKTK

SEQ ID NO: 3559 - protein, 960 aa, Unknown
  Kingdom: Fungi, Phylum: Ascomycota
MSSKYKDKDSGIVLSFNAQWVSWAHTIVAYTAFLSALFVGIYLHYHKIVQNEFYGYPQEWFPSVSATIGDRFPERSVFMLFIAITSGPRFALVGLWYLLTRKPGQKLPGFVASMGLLRTLTCGGWTYVTSTDNHDWHDVLMISYIVATLPWTLGCIALSPPNPQAIKYRKWLAGLFFGTLVPLIYFFIQHKVHRVAGAYTIYAFFEWALILFDVGFDAVTTYDFDTFEVMVKDVKGTSKGANWSSTPSAVLEKEKNKATAGVASLRFTWSEALDTAADVYHGFIFWSMLTSLGVVVWYFPLWFMGISGFEAFIMCTVSPFLLGIGPLRSLVVHNLRYVHLLSLVGVASYQVTAMIPRLCAVGFGLGMACLGWAATLSSSRAQDVRFESKALGLMLGLILSSTAKFAWQTNNPIWPIMHAENGGWNGTGLIIGVFAALRFTRLPPVTGGSLSNEKQSGSAALAACGLGGLFFGLHSLLSDSSTMILWVWEGYPIRGPYFSTHGWMTIAAMTAGVFVGLLRPNLAGSWPMFLMGSAGAMIVTFFSHWFGYYGALAIAFYLCAASTPLLANASKKSPAVTFGLGFLLYNFMVLFHVWVVAYAFVPGGPLVRERTDWVMMTMLALLGAGVFDFNASKPRRAAPRRKSNSQHRKYFGVGALVVNILFLCSAFRRFPTNDHQPFHPEDRVITAGIWTIHFSLDNDMWSSEYRMRDLIKEMELDVIGLLESDQQRIIMGNRDSTQLLAEELGMYVDYGPGPNKHTWGAALLSKFPIVNSTHHLLPSPVGELAPAIHATLDVYGQLVDVFVFHSGQEEDPEDRRLQSLYLADLMGSTDRPAFLLSYLVTKPLKGNYNTYVSDKSGMHDVDPTDWDRWCEYILFKNIKRVGYARVSRSTITDTELQVAKFVVPKTAAEAQQMEAISNDDRYRRVDESAIPEGWKFPALFRGEGVRGHRYHVFDEPRYFN

SEQ ID NO: 3560 - protein, 1076 aa, Unknown
  Kingdom: Fungi, Phylum: Ascomycota
MKGDKVQPDDSHHVSGQSNEHMTRPAHALTSAQVANELQANTNDGLSSEEVATRLTKYGSNDLGEEKGVSAFSIFVQQIFNSMTLVLVLALAASFAIQAWIEGGVLGGMILLNIVIGFFQDLQAQRTIASLNSLSSASARVIRDGHSDTADAATLVPGDIIELKMGDVVPADARVIECVNLEADEAALTGESLPVRKDPLLTFGAGHDSDCEDDDIGPGDRLNVVFSSTTITKGRGKAIVFATGMHTEIGAIAAALRDQGEKRQLKKDENGSSSATDYIVFFFGRIWDFIGEFLGLNVGTPLQRKLSALFLTIFGIAVLCAIIVMAANDFSSRKDVIIYAITTAIGTLPVTLILVLTITMAAGTKAMVDRQVLVRNMRSLEALGGVTNICSDKTGTLTQGKMVARMAWLPSHGTYSLGVTNDPYNPEIADLHYTSDQPQYIKVEDPMDNKINAIEEEKQHPALKNFLDVAHLANLATVKRSAADNEGPAWTVNGDPTEIAIQVFAARFGRNSDTLKSFDAAEWKQLVEFPFDSSIKKMSVLSQNAYTGDEMVLTKGAVERIVESCISITARDGSEDPLSDEKKAEIIRNMEALARRGLRVLALASRSSPRNVTEDEVRAGTLKREHFENDLTFRGLVGIYDPPRPETRPSVFKCHQAGIAVHMLTGDHPETARTIAIEVGILPSRMDLLRADIAHQIVMTAHDFDRLSDDEVDQLPQLPLVVARCSPTTKVRMIDALHRRGRYVAMTGDGVNDSPSLHRADVGIAMGITGTDVAKSASDIVLKDDNFASILNAVEEGRRIFDNIQKFMLHVLAANVGFVTALLIGLAYKDSTGVSIFQMTPIEILFMLLVGGTFTETGLGFEAASQDILRRPPQSLKHGVFTPEFLLDLIVYGIVFAVCTICTFIAVMFGIWDGNFGENCNIESGPTCEGVFRARASCYTVFTWTFLYFAWVLCDARRSFFDGMIHKSGPWFHRLWRNQLLFWSIVGGFIIIVPTLYIPTLNTYVFLHKGIGLEWAVVFSAFIFFVASCEAWKWSKRVYLRRHNLMHRKGEDLGEADLESRVFGSFYASTDNVREK

SEQ ID NO: 3561 - protein, 751 aa, Unknown
  Kingdom: Fungi, Phylum: Ascomycota
MAGLPSYEEATTAPDWLKLVAPRFWTIFAPRLWENPLKAVRLLGLDPSDDVSWWFDFVFNKLSAIQPAARSLVRVLDATQFAKESYHFASDRNDRNLQLSFARALQWLPNTECILLDGHVDLDLGFLIGAKSDDSQHSPMLLSIADCPFELPGNFFRSTSLGRLVYLDVSAIPGSIKPILHPGLLPALRILKVRGRELDDVSLRSLVQLYGNRLWSLDISENRITDGVVDFLQDKCFPKNSLRTSGYFYTEGDVIPLEGGSESFGPFVKIQESRWSKDFNHPERFFIDSPAYEPNADLGPQEHHVFRANGHGRIRKDSSDEIVKMMTSHEDHLFSPSSPGTRGLTHLNLSNNLLSASGITRLIRTSNGQVEYLACDSMPLLSSRHTQKHWPIGSRLVGTIGDADIFRPVFSSNLRALRIHHSFVTGILDLEMEGFSSLARIYLGEKLLLPRIQSLYSDAFRPDMNPRLTSLVLTHVPRRSSGPLIAALLNFLRLLSEQEGAIEEVASGSVTSRRAPDMLSGTRHLRLEFDPDPMEEGYSAAEDLDAEDLMNSGDQGYSFFEGEQYEKTPVLVRHGAGPGQAETADTSGANVALNENDLEQEYVNYEGEWDGESFTCQVWLGPINPNPKSALYRYRQLVRVYGVRDGVGPAHPSQIRAGAPEGSYIFHVAWTLAVMPSELSAPPKVELAAMKDVLEVLKRYRLAGRSKFASSKVVADMGSVKLGAPHYFWTGKLEVSTQRPLPQGRAAQYWR

SEQ ID NO: 3562 - protein, 173 aa, Unknown
  Kingdom: Fungi, Phylum: Ascomycota
MPSSANSIASEAVTPSTSLLPSEDATAPAATKPKRRRENRYKNAPPAVISRRRAQNRASQRAYRERKDQRIRDLEDLLEEAHRKEETLTQAFQTLQSEYDRLITDQSRAGSLDAGPFSEHIFSSPELGDDGTGGGSGVGGSMSGFEFLDGVQNADMLAGLYLQHDQSAYPPII

SEQ ID NO: 3563 - protein, 692 aa, Unknown
  Kingdom: Fungi, Phylum: Ascomycota
MDKFSSWFQGSLESQKRPSCVPVQAGGAPSSPTSTKLSAVSAVGAFAAAAASTEAAIGSTASSSPGLGASTPAAIFGAGAGAGSCADSPGSLNSGSLTESPSPQPATPRDSQDSMTAVIDLTTTSRSPSSLPIDTTKSDPLPLFTDQSHHNFDLDQRRSAALRSASHIHDSDLNNLAHFDNDFEMTTGPSLDAAAAGRGRQDSFVSSGAKPISMNNPNRDNVNRNRRESLAGSLMGGRSWGGLSFGSFVRDDIAMQGTSPFGGVAQSPSFHSSSYLPKLEANFMRDFTCCGQILPNLHDLLQHYEEAHTQPSPNTSRTNNSFNQFSQFGMPGPSSMGASRSGSLAPGQMPGQPSGSQFGRQHNPSASGMQMLGMAQNLNGGVGQMNAGMGLSTHDEMDAVGDMEMDDPVGTMELDDSQKMHQTRQLFGQQQRPQLNMNTSGLTQGLRTSQPTTPAAASFGLQNNPTVSSVNTPTLTTHPDENDMDADFGGMEMGDGTDINALNMGNNGDGTNNGLFIDEPGKHLLSSNGGTFTPTNKTIQQQLAQLGLAPGQNQVTDPDAQKELLARLHSMMMPEEHKPFKCPVIGCEKAYKNQNGLKYHKAHGHQTQQLHENGDGTFSIVNPETSAPYPGTLGMEKEKPFNCETCGKRYKNLNGLKYHKTHSLPCNPDFKRQAIAAGLKLPGIGEDQQMVQ

SEQ ID NO: 3564 - protein, 513 aa, Unknown
  Kingdom: Fungi, Phylum: Ascomycota
MDVWISTPYVGVLILGGLLLSSTYTVKSRESKRSFPGPTQLPLIGRVHDLPRKATWLKFHEWAGTYGPIFQTSMMGQKFVVVSDEEIARELLLKKADQLSGRAQIRALLNHKEDPTYFALEDRQETWRMQRKWVHAALVASYQHHFHGHIENEVKRWLMTLLIDPSSFHTNTRELTGRIMSRLTWDDATQGRKHGEEAIETLTNMSIHGSLVNAAPFLWHIGDFFGYNPWREYEAERERKLKAHWLRSFHMAKKRYLEKDLPNDTWSYRYFDQLTQPGNSTLEQSEREEEVASCMLGFQCMVGIITVATPLMYLMMAMTLHPEWQDKVQDEMNAVCGDRMPGLQDYAQLPTLRACIKEALRWRSSVPLGVPHRCEEEIEYRGVSIEKDTIVMSCEWNLNRDPKNFPDPESFRPDRWLSPSWPTYLAPLSRHPNLREGKAMHTFGWGRRACLGQQLADDELFLAAGAICWGFKMRPRRDSLTEPLPWQMEFLPQEGRVGSMVKGWSGVREEMRL

SEQ ID NO: 3565 - protein, 333 aa, Unknown
  Kingdom: Fungi, Phylum: Ascomycota
MPQDPNLYGQRPSKKQKRVTPLSSSLDFSAQLTSLMSNTDGSSTTPGRSRPSREPKDSLFRKDKEKRSDTAKGNHSTKLVIKDVAGTEEETQELARARRKMEDKARLYAAMKKGDYVPKENEAAPLVDFDRKWAETTEGKEDLSDNSSSDDEDEDGGKLVEYEDEFGRLRKGTKAEIDKLKHRQRRGLLGAEELERMSARPSEPGKIIYGDTVQSLAFAADDPDKMEELARKRDRSATPPEQKHYDADWEIRTKGTGFYKFSKDEETRAREMETLAEERKKTEEERKARESDKDKRRREIEERRKEMTARRAKKQADSFLDGMEQVSKSNTTS

SEQ ID NO: 3566 - protein, 558 aa, Unknown
  Kingdom: Fungi, Phylum: Ascomycota
MGQSKDHEAANDGAQETGTHRSSEYDTSSRDSLSITAARRPSEVEASAHRITSHMSGPDDLEAAQPAMTNVTSYREPGDEVYNRLSRTRKSVIVFVLSFCAFLSPISSTSILAATPEVAAEYGTNGSVINISNAGYMVFMAISPVIWGPISQVYGRRPTNLITAVSFFLLSVATSLAPNLGSFFVFRALSAIMGTAFVLIGAACIGDIYRPVERGTAMGWFMSGTLIGPAFGPFIGGVIVTYSDWRTIFWLQTALTGAGMLMTFFLVPETIHHKKIEDLAHHTRKEKTWAILGMINPVRLLVLFKHLNLVMVAAASAALVWNMYSLLTPIRYVLNPRFDLETPILGSLFYLAPGVGYLAGTFVGGRWADMTVKRWIKKRDGDRVPEDRLRSCLPFVGVVMPGCMLVYGWSVEKEVGGIPLPVIAMFIQGVAQLFCFPSLNTYCLDVMPGRGADVAAANFFVRYLAGCIGTAVVLPAIQGVGVGWFSTLSAALMALSGLGLLAAIKFGQGWQKKVKARERAHRAAKKAARNNFASTSEEQQIAMTQLENKEEPKNEGGR

SEQ ID NO: 3567 - protein, 428 aa, Unknown
  Kingdom: Fungi, Phylum: Ascomycota
MPTSATLIPLQPFTPDLRERAWCSTPHPTLPLLATAHAKSVTVFSLSSLSIHSTLTGGHSRSVRSVAWKPGLPSGKLCLVTGSFDSTAGIWRWEGEQGGEDGAGLEVEITAKTTRKKEDDSDGEEGDKDWEFTLVLEGHDSEIKSCAFSPAGAHLATCSRDKSLWIWEDIGATEADDEWETIAVLSEHDGDVKAVAWCPDVPGRNKLRSYGSDVLASASYDDTVRIWREDSDGEWVCVAVLEGHGATVWGMQWEGKPRPDDKFPRLMTFSADGTIRVWELKEEKPDDAGAPMTFGGIPNTMRSSLKEEWSCVATLPSVHEKDIYSVAWSAETGLVASTGSDGIVALYSEDETAPAAADAEGDQAMANTSAGAWKLLSKMENAHGPYEVNHVTWCKRFDAGAGDRKGVEEMLVSTGDDGVVRPWAVQTS

SEQ ID NO: 3568 - protein, 757 aa, Unknown
  Kingdom: Fungi, Phylum: Ascomycota
MAKTSSGLNVLGTLKSVTYGGGPLHPVAGDKVSKVTRLCNVYGSTETLLLPGQVTSKEDWNYVELDPRFGYHFEHVQEDLYKLIVKRVPEFVPIQTVFLLMPDIDEFCTGDLLSPHPTKPNLWCIRGRADDLVILSSGEKFDPAPGEVVIKTSPLVSACLLVGRARPQALLLVERDAETTKTMSTEQVKEALWPVVEEMNNVMATQGQITPDHIIVASLGVEFPRTPKGSIRRKQTEEMFEKDIDKSFGGKEAFSNGDSNGNINGNINGNSNADHDEPADIVQAVRQAVYHICKIDNIGDDEDLFEYGLDSIQAQHISAALKKISTHWPGDSTTATGIIYSKPTIRGLVETIDPTRAHHNGQGGDDMETLIAKYTSGLPRSVASNGFAKGMTIAITGTTGNLGCNMLNDLIRHQKVAKIICLNRSADGKDAQTTAFARNRLTQAPLGHTVVTHFKIDLSDPFLGLSPIQYATLQREVEVLIHNAWQLDFLRTVKAFEKTHIAGVRHLVDLAASSHRDMRIVFISSIGAVGGTDPRVVKVIPEEVVGPNIAPVPNGYSRSKYVSEKILEDAAAKSKVKSAIVRVGQIAGPTEDAQGTWSTTDWFPRMMASAKITRSVPDSLGMSNIVDWIPINTVSQVMINIMEETSKAGSGINVFHINNPHTVPWTDLAPCLAKSMGKDVRLVGLKEWIEDLRIAIQEKGNGVLPVEALLPWLEGVSQGGEMASLAVDKTVALSPALASPGCVQLEWIERWMSDWVL

SEQ ID NO: 3569 - protein, 189 aa, Unknown
  Kingdom: Fungi, Phylum: Ascomycota
MVATSMMSGSDYTYERRTAAHVRTYNWPPFYLNLWIFVMLLASGSIMGVFAIFIQTQERLDLGIPWYFPYFIAVCAHTIVFIFGLFWLIYNRRLLPAIVMIGAFMLFVLWMVGLVVTSVELWGPSGSVNGVCNMQVFNKNPTGPSEATLAWMQQKNICESWRLVFAMALLGVVFLVWIMIMSYQVFVMS

SEQ ID NO: 3570 - protein, 307 aa, Unknown
  Kingdom: Fungi, Phylum: Ascomycota
MSDLPTTFDKPVHIAIIGGTGLGALEGFTPVAQVTPSTPWGKPASPISILSHNNTYVAFLARHGLYHEYAPHEVPNRANIAALRSLGVRCCIAFTAVGSLREEIKPMDFVIPDQVIDRTKGVRPFTFFEGGVVGHVGFADPFDKGLAEVVKRCAESLEGDGVVLHDKGTVICMEGPQFSTRAESHMYRSWGGSVINMSALPEAKLAREAEFAYQSICMATDYDCWHSFEDVNVEMVGRYMQANGKNAKRLVAAVLDKLSEAEHSDLVMAKHWEGVTQGGVKWMTKPEGRKEDAMKRVEYLFPGFWEE

SEQ ID NO: 3571 - protein, 474 aa, Unknown
  Kingdom: Fungi, Phylum: Ascomycota
MMTSDRKRVRKDSQLGLEPLQDAELHHADTPTSEAEMIASQECRFRNLYKKAPDFKVLALLDPDFAPFVKGRDLDFNDPAAVMQLTKTLLKLDFDLEIELPDDRLCPPVPNRHNYILWIKDLLSTTVVDDPTYKAVGLDIGTGASCIYPLLGCTQRPWSFIATDIDPESLKHARRNIDLNGLTSRIDLIARQPSDTLIPTSHLPTTLDFTMTNPPFYSSDDELSASAANKSLSPSTACTGAPVEMVTPGGEVAFVTRIIEESLILKERVTWYTAMVGFLSSLTSLVDRLKKEDVVNYAVTEFVQGSKTRRWALAWSFGAMRPEERVVRGVNAQSLAKSVLPPSTQIKFIEVIPPPELGSFIEFLTEKIEELDLESWDWDRQALEGVGKAPDKVWARAWRRMKKRQEAGDLLTAMEKADEKKSLGFKITIRVQRDESVEVMCRWMEGHDAAVFESFGGFLKTTIESARGKQREGK

SEQ ID NO: 3572 - protein, 627 aa, Unknown
  Kingdom: Fungi, Phylum: Ascomycota
MTTVRICVCGDESTGKSSLIAALVKDQFISSKIQPVLPQITIPPSIGTPENVTTAIVDTSARPQDRTTLRKEIRKSNVILLVYADHYSYERVALFWMPYFRSLGVNVPVVLCANKADLAGQGNTPQVVEEEMLPVMAEFREIDSCIRTSAREHRNVNEVFFLCQKAVTHPIAPLFDYKEGRLKPACVDALKRIFYLCDKDQDGYLNDDEMREFQSKCFDKPLTKDDLDNIKASISKSHSTSDLDKGIDQRGFLQLNKIYAEKGRHETIWIILRKYHYTDSLSLEDKFLHPKLDVPEYCSSELSPAGYRFFVDLFLLFDKDNDGGLNDEELDALFAPTPGLPAFWVDSSFPSSTVRNEAGYVTLQGWLAQWSMTTFLEPKTTIEYLAYLGFEPANPKDNITSAIKITKSRKRRRRPGRVERNVVLCYMLGGAGAGKSSLLDAFLNRPFEPLHRPTIKPRRAVNSVELPGGRQVYLILEELGELETAILENQAKLDACDLICYTYDSSDPDSFSQIVDMRAKHPHLDDLPAIYTALKADKDKTNQRSELQPDEYTSSLNMSHPLHVSVTWNSISELFVGLAEAATNPSTAFPKSEEDAPDRTGLYMALGATACAAVAAIMIWRRSTNSM

SEQ ID NO: 3573 - protein, 176 aa, Unknown
  Kingdom: Fungi, Phylum: Ascomycota
MVSSQDIEYLRQCVDLAREALSTGDAPFGSMLVNPSTSTIHARDRNRTASGSSPLFPDSRPGPDATLHPEFTLARWAGMNLSEKERKACTVYTSGEHCAMCSAAQAYCGVGRIVFASSTKQLEAWMNELQPYDERVLAPLGINEVAPGIKIEGPAEEFAEEIKELHRQSRDKRMKT

SEQ ID NO: 3574 - protein, 348 aa, Unknown
  Kingdom: Fungi, Phylum: Ascomycota
MVKSKRAREAAESVVDPSSAEAVNGSSATHEKQVKKRKRDDAAEEDAVATETKKSKKDKKEKKDKKDKKSKKHDQESRKEKKDKRKNLQDLPDEVMEDAAAEDEEAGTPPKAEAKATNGAEGDAEAKRKEEKRARKQAKREEKEKKQQQKQAEADSTSKSNDKASAPSATAPSATGEGDNNEKTEEDPIDLDDSSAKKDRHIVFVGNLPFSATAASISAHFATLSPVAVRCLRNRDDPNPCRGIAFVEFSKVWHQRTCLDKFHHSTFDDGVSPARKINVELTAGGGGKTKQRQQKIKDKNKKLDENRAKRIEREKVAKQEGGGADASKASHQEDSIHPSRRGRVAGGW

SEQ ID NO: 3575 - protein, 188 aa, Unknown
  Kingdom: Fungi, Phylum: Ascomycota
MIASRVGVAALARGAARPSMMLNQNIARALTAGITTSSQARAVATTKVPQDEGHQILVNQRLNRPVSPHLGIYKLSQSWFSASAWTRITGCFLSGGAYLYFTGYLAAPLLGWHLESASLASAFAAMPWIVNGGVKFLLSFPFVFHFINGIKHLIYDAGIGFKKASIVAGERLLWASSVLGSLYMAFGL

SEQ ID NO: 3576 - protein, 277 aa, Unknown
  Kingdom: Fungi, Phylum: Ascomycota
MLSEKDKTVGEKVTPATTTTPIDDAPSPSPGAQIHDADSHNEAHIIVRRRLKPSKNWTAHQIFYVFILDGLGGMTLSAGVNFALAYVMYTTQPAPSPPIKLFALPNTLSGDAAITIIVQCILTWFVELGLLRFDLRHKSVQPIGFVPEPSKPWLRWLFYLPPKNSSSSPDETERTVLPPRTISLKAILPEALRGSMLAVCGLLVLWPIGVGALTAFGEKQEGSLDYVYDDHYVPQGFKAVLGGLLGLFTTPVMALFWLVRAGWEAEGVDGAAEEAEV

SEQ ID NO: 3577 - protein, 851 aa, Unknown
  Kingdom: Fungi, Phylum: Ascomycota
MASAANMLSLPFRRSNQISLSSTIRQYINSKYDQHPDMFLQDLEVIDALRRDAVNVREPHPTNVAKLQTYAGQLVWIGGKFPIDIGAEFSWYPALGYSTERPLVRNNLKFELMNILYNLASLYSQLAVNTPTSSTDGLKTAANYFSLAAGVLSHIKTAVLPELRMSDPPEDMDAETLESLTQLMLAQSQECFWQKAVMDGYKDASIAKLAARVSDLYSSSGEAAVKSDAISSMWIHHMSAKHHHFAAAAQYRAACDCLEKRKYGEEVARLKDAVACVAEGLKETKSGYLTKTVAEDLGFLKKKVEEDLKRAEKDNDMIYLNPVPPKSELKILDRANMAVARTPPQVSNPYDFFGDQAEFGPALFSRLVPFSVHVATTIYEGRRDQLVNRSIIPGLEALNEQMHSLLSSLDLPGSLQALEKPMGIPPSLQQHAEELRQADAVARVHKTFADIEKLRSADMAIFEEGKSMLLSEEEEDQRLRAKYGTDRWARPESRSDPEGSNLWVLVNQFETWFAQSVTSDGNVRKKFAAVEDVLEVLCGPTRGLTEFIPSSSSREMAEELKPVVGRLRSAYSDVLRLESRRRKKVEALRETARRDDIKPDILKEAARLERTYPNTALDAVHFEEFFDKRLDRLYEPEQEALDKEADDQEKLLSEVERVNKEFESQKQRLGNRGNRAREQALQVLDDAYFKYKETVNNLEEGRSFYNQLNQHVGQQFRDVVKGWVARRRMEARTLSEELDMPSLSNLNLAHNQAQPPSVANYGGQQQQQQPRHPGMQRPAVHSPAEASIQSWAGGGDAVQQPQPMQPPANPMGSVWNPSMGIKFGSGGGPAAGGSGAQAPGTWKPGSGIKFG

SEQ ID NO: 3578 - protein, 146 aa, Unknown
  Kingdom: Fungi, Phylum: Ascomycota
MSGLDASDISNAYEAVRSDKDETNWLLISYAAATGNKLTLTQTGTGGISELSAALDDTQVQYGYVRVEYANDKESKRVKFVLVVWIGENTKVMRKARVSVESGDVKRVLSHHSIAITVGDKGELDEEDIVKKLRKAGGADYNGGRG

SEQ ID NO: 3579 - protein, 525 aa, Unknown
  Kingdom: Fungi, Phylum: Ascomycota
MVKTHSSSVGINDNLASSGWFSWLSNAGIVKLNAILCLSLISSYATGYDGSMMNGLQSLDEWKKSFNDPNANTLAILNAIQNIGQLAALPFCAIFCDKFGRRPALIVGACIMLVGVGLQGGARNTGMFIAARGILGFGLALNITAAPLLIMELAYPTQRAPMVSIYNTLWGLGALAAAWITFGTFRITNTWAWRIPSILQALSSILQMCLCWLIDESPRWLIAQERDEEAERLLVKYHANGDASDPLVIVEMEEIRTAIRMENEASSSTSYLSFFKTAGNRRRFFIILAVGFFSQWSGNGLISYYLTLILNSIGYRSQETQTLINALLTLWSMLWGLVFSVVVNRIPRRTMFLGSTLGSLACFVVWTALEATYEKATNLNEDGTGGPSGVAKGVLAMIFLFNLFFTAGWGVLQVTYVVEILPFNLRARGLVLYNLFVACALIFNQYANPIGVTNSGWKYYITYDVWLAFEAVVVYFLFVETGGLSLEETALVLDGPEAGDQLVGEVMAKTDKVVEVPTISHESKA

SEQ ID NO: 3580 - protein, 290 aa, Unknown
  Kingdom: Fungi, Phylum: Ascomycota
MPLNSLYWYVFEEYIYNRPQPPTRTRTTPLKVICVGPPRSATESLAAGLTRMGLQNVYHGWDILFEQPNYAEAWVNLARRKWLNEGAGLPISAEDFDKVLGHSEALVDAAGSVFATELINAYPDAKVVLNVRDDKDAWMRSMQESVIAVNYNWSFYIFSWFHPGLFWAWNVYERYLWPGMWRNFESRQGHGAATAAMGKWVYEEHCNMIRGLVAKERLLEWRPQDGYKPLCEFLDMEVIDEPFPHINTKDKGWKDREAQITKELVAPAIRNAVIFFSMLMGGLALGYRYC

SEQ ID NO: 3581 - protein, 1078 aa, Unknown
  Kingdom: Fungi, Phylum: Ascomycota
MASSSTGIGFPSWRRRASSLDIRRDDDSNDGATASSPAAASEMPASSSRRLSSSFTSGPSHREPIRSFIHGSIRDQLAPVDSEANAQSVREDTAELASYLLADQQDRRGSSFLHKSRPSVQDVFAPDGEGDDSTTTDAILEVSEPPSPDPRGDDPMEEDGPSVIANLLRKSPPESSVGDSGAASEDDEDDNETVRVESRRRKSSVRSEMRSATENTPLLHRTSSHPEGVDLEEQKPKAGKAWLQSVVQGTHEVKDRVANTVVVAVDPRRWDRKLIWQNAILTPASCLPSVAVGLLLNILDALSYGMILFPLGKPIFQNLGSAGISIFYVSTIVSQLTFSSGSIFKGAVGSELIEVVPFFHNMAQRITDSVGEENPDAVIATTIVSYAISSMITGLVFYLMGRFKFGYMVGFIPRHILIGCIGGVGWFLVATGFEVSARLDGSLEYNLDTLHKLAQPDTIPLWTVPLVLAIILFWGQAKIASKYFLPLYILAIPMIFYFLVLCIDALDVDHLRDGGWIFEGPPAGEPWWYFYTLYKFRLVQWDAVIECIPAMLALTFFGILHVPINVPALALNCGEDNADLDKELRLHGYSNFISGCLGSIQNYLVYANTVFFMRSGGDSRLAGYMLAALTFGVMCIGPSLIGFIPVMMVATLIYDLGFELLLEAVWLPRKKLKLAEYLTVIVIVLVMGIYDFVIGIGVGILLAFISLIVQTSRISAIRGTFSGDIVTSTVRRNPSQHHYLQNVGQQIFIIKLTGYLFFGTIVSVEEKIRALLDDNAFAKKPIKFLVLDLWRVSDLDYSAGEAFNTISRLLDNKGVVFVLSGVEADSQLGRNLRAVGLGNNGIEVMMLPDLNSALESCENELLKTLYARQEELNQNRRTATASLDVPDSKTSQLSSFDPPFNSPRRNHQAEAAQDALNTIVIQPSSRWQSFKEPLRLMLQIFQGLSDKNEDFWFRATSYFKRREFAAGSVLFRRGERADGFYLVERGILRAEYDLPQGWLCESIVAGTTCGELPFFSETERTATAQVERDCVVWLMDTEGWAKLQKEEPEIAREMLRVSLKLTTERMSAITSYTLTMAG

SEQ ID NO: 3582 - protein, 359 aa, Unknown
  Kingdom: Fungi, Phylum: Ascomycota
MAAPTYSRERDIAELAVLRACVLTKKVLSTVDEISKSDLTPVTVADFAAQALLISAIEAAFPGHGVLGEEDATELRHDAKLREKVFGLVASVDLPTTPNGDGPVSLASPANAEVMMDMIDRGGQGKGGREGYYWIMDPVDGTKAFLEGHQYAVSLALMKDGKEVVGVMGCPNLKLQDGRVSETTVDKDGLGVIITAVKGHGATIRSVSANGTLSPREVLKTLPSPKSINNLHFVGCTASKALRQDIPEALARKLGTKDPGTNVWSSHMRYASLILGGGDLQIRVPRKNVEPVAVRVWDHAGSQLIFTELGGKVTDLDGKEMDFGAGRSFFNNRGMVVAKKEIHAEILALVRELLDEPKL

SEQ ID NO: 3583 - protein, 585 aa, Unknown
  Kingdom: Fungi, Phylum: Ascomycota
MADVTYGTDGAIERMLRLNHKSKHVPAIFIHAGAGFHSHQNEEVHLKACVAAAEMGMRFLKAGATATEAVEASLRVLEDKEITNAGYGSNLSIDGTVECDATIVDHLGRSGACGATPNIRNPISLAKLILDTSNQPLSLRRVPPNALVGEGARAFAEENGMVTFHNEYLVSKNARDRFLRWQDDLRYAESKSDEAKSGKAAVRAGGSDDPCHYDTVPTPDLARTFPRDNAAALMTGTWNEGQPDSPYAGTPVSEASQSPENAVMPGYFRPVTATTPTSRAPKIRATIDQLVPATMSSPSAKDTPSARLRAHARHGGQNSSGGSRQAASSRHDSRVRATKMHEGNRDGSSSPQQRGRIQEHSSDADYAQYMPSSKRLRLAHDSGEEGLSETASLTQLDEDHITDTVGAIAIDNEGQIAAASSSGGIGMKHRGRLGPAALVGIGTAVVPCSPGDEDGTTVAAVTSGTGEHMATTMASQRCAERIYHGTRKGPDGMDVKDDDEDAILESFVVNDFMGHPGVKNCHSAGAIGVMMVKKTRSGYYFHFAHNTDSFALASMGGGEVQASCVMSRMPQGCKIAKGGRKIQLT

SEQ ID NO: 3584 - protein, 360 aa, Unknown
  Kingdom: Fungi, Phylum: Ascomycota
MRAPLQLAPLRLRQRLAFVALKQSCKPPTTYVELIWGRAAAFKHCKMHYAYPPRRESTPRAWMDSSARPKIPFRTYVVRALLLVATLTLAAFLFLRGQSEDAYYEEMPTGGPSVVIVTLTDTDNHNSAYLNLIRENREQYAALFGYETFIAKAVDYDTGEAPKSWAKLMAIRHAITKYPTCGHIWFLDQNALILNPKTSLEALLLEKSRLSEIMLPETPVVPDSIIGTFGHLQAEDAALLISQDKTGLVTDSMIIKNGEWAKFFLEQWLNPLYRSYNFEKAERHALEHAVQWHPTVLSKVAIVPQGLLAPYSSERNGEVVGNGAFVVLFEGCQKQDGSTCAQELEKFWPRWNNALGASGG

SEQ ID NO: 3585 - protein, 463 aa, Unknown
  Kingdom: Fungi, Phylum: Ascomycota
MGARAHKIRVLVWGEAPESPEERKLLRKIDFFILTYCCVAFFFNYLDRAVLANAYVSGMKEDIDITGNQYNILVTCLAVGYIVGQVPHGLVIQKIAPRIWFPLMTVVWAGLTVACAGCTHYSQLAAVRFLQGIAEASTYSGTQYIIGSWYKGSEAGKRIGLFQASGMSFIINGIITLPIAAFGFAFFPDLPENTKAFYLKPEERALALSRLPPKNPDGHQIGLSIVKRVLFTWNFWILNIFWMLGGALEAYSTQTCMVLWMKASGLFSVPENNTYPLGITAIGIVLTLATSVAIDATGVHAPYGFFACGVQLIVCVILLCWKLVGTAAKLAAFYMAGTAYLIQPVVFVWANKILARGGDDAARAVTLYSMNGASSVLYSFWGIAFYPATDAATGFHKGSITMVVVSAALALWICVVWWQDHRTAKAFDMPQHDADAKLEMGVDELQEFKDPKAEVQRVTAPVS

SEQ ID NO: 3586 - protein, 380 aa, Unknown
  Kingdom: Fungi, Phylum: Ascomycota
MADTLHNVAIVLDNGSGTIRAGFAGEDSPKCYFPSWVGRPKHTRVLAGALEGDYFIGQKAAQELRGLLKIKYPLEHGIVTDWDDMEKIWEHVYVEGLKTLSEEHPVLLTEPPLNPRRNRDTAAQILFETFNVPAIHTSIQAMLSLYASGRTTGIVLDSGDGVSHAVPVYEGFVMPNSIQRIDVAGRDVTEYLQQLLRKSGHVFHTSAEKEVVRQIKESLSYVAPDPRKEEKVWAGGKNIAGKMGEYVLPDGRTLKIGSERFRAPEILFNPELIGLEYPGVHQIVVDAITRTDLDLRKSLYSNIVLSGGSTLTKGFGDRLLTELQRLAVKDMRIKIFAPPERKYSTWIGGSILAGLSTFRKMWVSVDDWHENPDIIHTKFA

SEQ ID NO: 3587 - protein, 111 aa, Unknown
  Kingdom: Fungi, Phylum: Ascomycota
MKPLVSAMQAWTWYVLPRDLSEPTPSRRLASLEHASTVISVFGIVILSIIGAMYRKGHEEFVGGIEDPEDGAAVAGTVFTAVIVYAGFVVFCGLQGMLHVRESRRGAIALQ

SEQ ID NO: 3588 - protein, 272 aa, Unknown
  Kingdom: Fungi, Phylum: Ascomycota
MLFKASLVALATQLLGAVAQDAGTTPVDAATLNADLSASFPDADIFGVKLVNGHPTKALVTVANRESTPFTLAFLTGALHSTKELPADAPAYQGILRNLSATQYNLEVPAGETKEIPYSFSQDMQPQDVQINLMAVVTNAQGNIFSLPVFNGTAAIVEAPTSFFDPQIIFLYLFLTAAFGGVFYFVYKTWIEALFPQAKRPKTPRAKSSRKSLAADIDADAALSGNEAVSPSIGASSGVATIDQSWIPEHHLNRPSAKRVKSSASAKKKVVG

SEQ ID NO: 3589 - protein, 458 aa, Unknown
  Kingdom: Fungi, Phylum: Ascomycota
MFYQGTLQEGISTAVEQQKLVLCFVTDGKEESQSWEDEFLKDETISELIDNHAVALRLMAGSEEAGYLAQIFPLPKTPTVVIIKNGELKEYLTAGTSREEFVNRIHAAFVKPAPSSASHNANTATSQSSSSQQPVAPVAQPASQTRQPPQEQHSSNVQRVLAERAARLQAQKEEAERKAKEERAKAKEKAKAEAEAGVKSDAARQHKQAELVKKRRQQELEERKRILQRIEDDREERRMRAGEREKARLEDQKTGDIAAALVNAPESKMPSTTRVGEMTAVQFRLFDGSTLRSRFKTKATVRELRKWVDENRGDGSEPYRFKQVLTPLPNRNIDDTEEDKDLGALGLAPSSTLVLVPVQKSTTAYTGASGGSLFGSLYGLIFGFFSWILAFIGSAGGVLSSTAPGQQESSAVSSAQEAERVRMREMQDLAMRRRNQQLYNGNSKQQTNFEPRPEEEEE

SEQ ID NO: 3590 - protein, 431 aa, Unknown
  Kingdom: Fungi, Phylum: Ascomycota
MVFENITPGVPDPMFTLKARADADQHPNKVDLGVGIYRNAQGQYEGLKCVAKAKTVLDAANLGHDYELTTGNAEFLSKASRVLLGQDLASSGKVKSVQTISGTGAVHLAALFIAKYLAPETKVYVGVPTWGNYRPTFELVGKQVTEFPYIKTSIRAYDHETTIATISSAPPSSVFILQACCHNPTGLDPKPEQWNEILDKIEQGNHLPLFDIAYQGLGKGMVEDTYAARECVRRGIEAFICQSFSKNFAIYGERCGALHVACKTPQAAANVHDRLRCLIRWEVSSSPAYGSRLVNIVLGSDELQGEWQSELTSMRSRIQENRSQLWHYITKALQIPGKWDHMQHEQGLFSYLPLTPAQCRQLVSQHHIHLPESGRINVSGLSEDNIPRVARAIESVVGSSAGRKESVAASQATSSEKSHLSAAISLKEIAA

SEQ ID NO: 3591 - protein, 486 aa, Unknown
  Kingdom: Fungi, Phylum: Ascomycota
MSSDDEHVEIINTIFKDLSLPEVPRYSLTPSAKFPLPSSYNLHLLSTTTTLLSTLTPALLYAHRNNLPSSSQPQVILSPFQADAQFLCERLYSIDGTPSNTDRLLIGGLHATGGSGHVRIHDGFPNHRSGTLKLFNLPSDATREDVAVGCLKYHSSVALETAAHEAGLPIYALRSPAEWSSHPQSSFTSSSPILLKSIPSSTSNKTYNLPPASRPLSGIRILDLSRVIAAPCAGKLLASFGADILWITSPNLPSLPVLDLEFSRGKRSIELDLNDPADKATLEGLIADCDVFLQSYRPGSLAAKGFSPEDLVKLNPNIICANLSAFGPDGPWAERRGFDSLVQTCAGMNYSEAEQRGDNLPALPLPCQALDHASGHLLATGICAALYHRGVKGGAYTVTVSLAATQKFLESMGRIPASQAFADEKVTGPGGLPEELFEERQLEDALGLMRYVKAAGRIEGVEVGWKRMPGKLGRDKPEWLPRPPMK

SEQ ID NO: 3592 - protein, 615 aa, Unknown
  Kingdom: Fungi, Phylum: Ascomycota
MKFSTMTAAGAVFGLAAAAPTTTKRSIHKRQVPQEQSHGFILAIADEFMKLENTLNIQDAVFGLLGNAAAEEGAGDVTNFDCLKQATADQAFTNAKAISDIRGMAGALMFQAIERNTGSVGLASVLCDEPTVNPEVGALISHQDAASDNALAINKAITLELARQLATFGADPNLALLTGTFPPGDVNDNTGAGFTCDTEDRELGCIYTEGLLVLDATEEEIAAAVADVEQTFEGEGGILASDLVNLADFDVAVVDDVFDLSELAPGSGAAAVDTPGAVVDETPAVTDEAATTTAAVDAGVTGECSLVTVTVGADQTSAVMAQYPSAVLGDVATPAEGTTTTVVTPTPVVADECVNEGNQNQDNNQNQDDEAADDNQNQDDEAADDNQNQDDEAADDNQDNAEGGQAAGGNLQSFAGALGGAAPAVQNNGDADRPFEVNGATFNNEAAALIRSCDIQNNQCFNAVNGGELAGGTEQCSQQLTECQANAGGAPGRKAKRNNILGGVNPQLLAGNNRVVGGGSARIVGGANNRVVGGANRVVGGANKVLVGGAAQGVNLGQLVGGGQNINVGQLLGGGNLAALLGGGIVGGVGAGLGGVIPPSVGNQQLVSVVLQQCK

SEQ ID NO: 3593 - protein, 162 aa, Unknown
  Kingdom: Fungi, Phylum: Ascomycota
MSQPILRIRDAGDANGKTIANVLPARIYHDGPVDPVDSFWTPTEGDDGKRMAYLRGRKLEGKTVKLPAQCRGVVLQRRDNPKTTAVSNSTQEDNVIDLEAEEPGPETASMHVTAEFDELVVWGHETTADAAGDPYVRSIEEWLQVSEKINSHATDDAGRDKK

SEQ ID NO: 3594 - protein, 578 aa, Unknown
  Kingdom: Fungi, Phylum: Ascomycota
MMSPSSFKYSSLPPATSNRPPSSFAQPARRQLVSPAATSSRYYSSSRETAIAPSSTSPSPYTNLASPDVTQPTQPRTIPTTPSNQLQRHRRAPNYEHDKRDYTSVIITPARSSSPPTTPAFYAAMAKRKERRETTALSPSSPPTTTTDLSVRPTTPTSPVQIPKASKRDHVHSSRPHGAMRRRGKEAHTPASISPSMAALLAVTDIPRPRLGSRRLRKSHPNKPLTVEDIFDERQVSEKEFSWSLSRGTMDMLLTPPDHLTEDDMSISDSNVGSALSMRTISVDSIPSLGDSFATDHISSVDTPSRSSSRRRSSGPTRKVLEAISSPEQVEDHPLAFAGLDLDDFDSEFLGQPLEAVPERQPLTPFKPLRSVFKSNLTASLRALRSAAKSFSSISFATVPSEALLTRSILTMDPKVPYTDERMPPVTDDMPSAEVRRYLNPSTSSHHEPSPASTLVQGSFSASIQMQTYKIQRSRAPSPTTHSPYPNAYLQPPESGSDRSSQQPPAPAQHPGMRQREMRENSDFIRIAVMEMAMRKCGKLDDQRPGRARWALPPRKAILKPYGVNTDGVPERWVPISA

SEQ ID NO: 3595 - protein, 575 aa, Unknown
  Kingdom: Fungi, Phylum: Ascomycota
MQSAVMRRAGVRCLGQAARFPQRRSLAQLARFKTPQVNNEPNQHYGKGSASREGLTAAVEKLKGKLPLQVPVVVGGKEITTSSLSQQFNPSDHATPVASYHTATSSDVSSAIEAALAAKSSWESLPFADRAAVFLKAADLVAGKYRYDIMAATMLGQGKNAWQAEIDAAAELADFFRFNVAYAEELYGQQPTHNYPGLWNRVEYRPLEGFVYAVSPFNFTAIAGNLPGAPVLMGNVCVWKPSDSAIASNYLVYQILLEAGLPKDVIQFVPGDPVEVTKVALAHREFAGLHYTGSTAVFRKLYGTIGQGVAEGRYRSYPRIVGETGGKNFHLIHPSADIENAAIQTVRGAFEFQGQKCSATSRIYVPKSIWPEFKEKLVSETEKLKIGSPLEHENFIGPVIHAGSFKKLSGAIDAAKSDSTLKLIAGGKYDSSKGYFIHPTIYETTDPAHPYLSTEFFGPILVAHVYDDAAPDAFSRACELVDSTSEYGLTGSIFAKDRETIRFAEEKLRNSAGNFYVNCKSTGAVVGQQPFGGARASGTDDKAGSPNLLTRFVNMRSIKEEFGPTTKVEYPSNEI

SEQ ID NO: 3596 - protein, 1180 aa, Unknown
  Kingdom: Fungi, Phylum: Ascomycota
MLSHLRFHRRGPASTPSSPVPDQQPPSPFNSQPPNISAESNSPYDAPLSSSSSSALPPFLPPITRVTSTESEPQSDLRRMPDSISPGDQRPKPPTKHSNNDSGFMGGLALQNYRKGFNSQTSQRPETADGALNAGSNSRPARPQLQTSFSSRPEAPTRPPPLPATGSKAASSFTTPTELTHPVAPATGRRPAGTRMTNESQAMPVPVEPQRGKKSLPFLKNPMSTLLMRRKNSHNVPDLLPLPLKKEEEPTYDPRIRGTRVHDFSAPRRKHHTPHIGTNSSRSPTQHDYGADARRDPIPAADSTSTLVQPLSYVSSASESASASVISQPVGHSTSASSRKTRASVEPASVASQEAPPVPPKDDADISRAQPSKRTHVTLQDGLSHGKSFASRKSAQSRQASLAERSHRDTISSIPKHMKSTSSRFSFDMIGAHTQEKLMEERHRQRELERQTTEPAGPRDSRYGDDDFDEDEMYNAMMDENDMEEEIPGISFDYEEDDFLTHEDNLEDTLEDNPQDSLENDPNEPDSAKDDPDNDQENFEGFVFQRSNPTSTLVSPQYPGAIATPRDASGEVIGFATSKYTPNLQIPTLSPLSPFSPDFTNSAGSRLSGLGIQGIQTSPIPAAGKLAVQSEPPTSAPAAPVQAQERDELDFGNGVMSGFENEFAEDLAAGPDQDAAPFDESIFDNNDTDQYGRPLPGAFAQAQSMRREAQEGTVKRESDMTSRLSAQTAVDRSTAHTSLSVEIPDQVAYDEPTKLPQSGSSSTVEPNDNEATSGDPMAAYQAALAAAAFNAAASGKFQRDDSSPNKEDEAILSDGLDLEDERGFDPDAYEDDEDDQGGLDDYELDDDAIIAEANADMLAYDEDYYGQEFGFYSAPLTQHGSINSRSSDESDYSFAGGFFAPKGVDIVNRSKSGRIVSREPNLTPITERSEYSNRNSIMSLGVPPFFSGTPIQSPGLAQLAMMADRGDDQMSLSALMRLRNKAWGGSQISLSSSREGSPSLERGENVTSPWGTQSGGFFPANNTGHLRKGSVYSTVSRDSEANSMAGSPTLTGMDFAGFPSPPTAATNQLPPISMFHDESADVVSPLGIQAPAGNYVIDSIETPASATSSNDCNWGKQSQGQPSSRRPGMGHRHKGSADSISYIQEEEGGGETRWVMERRRTGESGQVELLEREVVEGGRI

SEQ ID NO: 3597 - protein, 297 aa, Unknown
  Kingdom: Fungi, Phylum: Ascomycota
MSRSILVSGATGKQGRALIQSIIDQDADFKIIALTRNASSASAQRLAAKSSKISLIQGNLDDTEAVFAEATKISPTIWGVFSVLAVNMGGEGSIVEERQGKNFIDSSLKHGVKHFVYTSSSRGGNQPTDVPHFISKHHVEQHLISRTKNTSMTWTILRPAAFMDNLEEGFLGKVFATSWQNSIKSRGLQVIATSDIGLVAAKVLLDSQRYVGRTIELAGDDLTFDQMAKIYKEVTGVKVPTTFGFITTILFWMSAEFRLMFNFFEREGFGINLAETKEVLPEVQDFRTWLSRRNKTA

SEQ ID NO: 3598 - protein, 877 aa, Unknown
  Kingdom: Fungi, Phylum: Ascomycota
MGLLSNPLRRQQPSLPTYERVTTQSKERFSDDDFTSSEDDYDDDDIDDDDLAPHPTGTTPGSSRNTSGSMSSGRLLVPKRNVQSQRQRPSRLYPYRLPNKVTRYLCFILSATVILMIVSLVRASRVENWKVQNGKVDARPKPPPVWDKFPFLERYYGGVRTVVPYNESYPEFPESDEVPPLRSETESKKEEKPAAAKRDVPASKPWETYEGRNVESDMVECFIDDANSIRVPPLRYLEGRPRGFPRHAVGSYELLNLPEDICFERFGRYGPYGFGYSVRSGGLGTGETGENEGSAAIWQDTARVDYRTVNWADVQRRCFRENSHRFEGLPPRVPTSHGFFIDDQTKPRPASKIEARAEQQATKSAFSTPATAPTAEASQASTKATKDKEEEKPEEVSVPAEKKARTAVVIRCWDEYLFREDDIANVRSMITELALASGGRYDVHLLIQVKNDAAHPIWADHEAYEKRIEESIPEEFRGLVTLWTETQMLSLYQGIYDNWSRGPDLPVHGVYRGLTMAMQHFAYLHPEYEYFWQWEMDVRYTGHYYDFFTKLESWAKEQPRKGLWERSSRFYFPDVHGSWEDFSQRSRIETEIGVTSADNIWSKVPGMDPSASKKQGKSVWGPVRAPDHKDWFRPQNDSTPPTPYEKDHHAWGKGEEADLITLNPIFDPDGTTWGLKEDITGFNRSEPLPPRRAAIITTSRLSRRLLLTMHKMTAYKKQFAFPEMWPATVALQHGFKAVYAPHPVYVDREWPIDFMAATYNAGSSGSSGGSRTSIFGEREHNMHGTSWFYNSGFAPNLYRRWLGLKVNNDGGEEFELTEDKSKIGQKGVGNMPGGEGRMCLPPMLLHPVKEVDLPVEAPPEDHEPDENGNVVGLDPNA

SEQ ID NO: 3599 - protein, 614 aa, Unknown
  Kingdom: Fungi, Phylum: Ascomycota
MTGPIPSEDNPDYNLNTPISSSAGLRQGLTSYGDAHFSLFLRKVFIKALGYSEDALSRPIVGIVNTYSSFNPCHANIPQLIDAVKRGVQLGGGLAVDFPTISLHESFAAPTSMFLRNLMSMDTEEMVRAQPCDAVVLIGGCDKTVPAQLMGGISANKPIFHLVTGPMMPGSHRGVRLGACTDCRNNWASFRAGKIDIEDISAINEELAPTGGTCGVMGTASTMACILVGLGLMPFKGATAPAVSATRLRIAEETGKNAVLACQKLDELRPQTILTRESFLNGITVLQAIGGSTNAVVHLMAIIGRHPKVAGTITLETVDEIGRKTPLLVDLKPSGDNYMTDFHNSGGMLALLLQLKHLLHLDAMTTTGRTLGQELSSATHLSVPQHLSVIQPLDSPLHPSSSLVVLKGNIAPNGAVMKASASKSKHLLHHTGRAVVFAGSADMAARLDDPDLDVDEDSVLVLQNIGPVGNPGMPEAGMIPIPRKLAEKGVVDMLRLSDGRMSGTAGGTIVLHISPEAADPRSVLGAIQTGDLITCDVEKRLLHVDVLDEELARRIEARTALITSSESTAPWATRDETRGYRGLYLRSVNQAQHGTDFDFLTAAGPKGAQAEDAR

SEQ ID NO: 3600 - protein, 540 aa, Unknown
  Kingdom: Fungi, Phylum: Ascomycota
MAPHAEIDDDTPITRLPPPERPPFSQSPPRLLIIGAGNRGKAYAEAIRKSSNGILVGLVEPIALKRRQLGRKYIWNQRRPVAGEEFEDWPDFVKWELERRKKAEAGHDVPEGVDAAFICVQDGMHKDVVLGLAPLNLHIMCEKPLAPNLEDCVAIYKSLKPDAEGMGSKIFSIGHVLRYSPHNVLMRKLLVEDRVLGDVMAVNHTEPVGWYHFTHSYVRGNWRNENTAAPSLLAKACHDMDILYWILAAPPPGSSKPAHIPSNISSIGSLQYFRKERKPAEAGNATNCLSCAYEPSCQFSAKRIYTGADLKSEQQEHFASIVAPEMEDFALAGKPEEAKQALMAKLGEDYPEGASAEEISQRNTFGRCVYECDNDVCDNQTVTLSWDADPIAGPGETPLRALQGRGSKTATLHMVAFTEKICQRYTHIYGVNGEMYADSSGITVTDFRTCEKTVHYPHVPEGGGHGDGDEGLTRQFVLAVDAVKNQGMKVGSAQREFVGCDLRDVIMSHGLVFAAEEARLGRSVVSFPEWWQREVVAKLG

SEQ ID NO: 3601 - protein, 257 aa, Unknown
  Kingdom: Fungi, Phylum: Ascomycota
MGRYELEYPKDATNTVKRHNERGVYALKAVHSLINASPLLHISFTPPSSPFPTILPMIGQMGSFERPSSSISDPLDLYLHGYVSSRVMNVARSTQGLPVCVAASHVDGYVLALSAFNHSYNYRSAVLFGHASIVEDEAEKLYALELITNGFLPGRWDKTRLPPLGAELQSTSVLKVKIESGSAKYRDGQASDDKHDLENEAALDKIWTGVVPMHQTFGEPIPSSYNRVEFPSYAAEFIADTNKEGQEHSVAAAAIKK

SEQ ID NO: 3602 - protein, 69 aa, Unknown
  Kingdom: Fungi, Phylum: Ascomycota
MPEGGESPPPETLSGRQQRDPPASGKGIENAENKGENKGKEMKSELDNLSSNPTAGTDKAAKDKVSKDS

SEQ ID NO: 3603 - protein, 487 aa, Unknown
  Kingdom: Fungi, Phylum: Ascomycota
MPISSRPSAGPSRRIDQQGQEDLRNPRSFHHNLIPNPTSNRAGSTRSSTRPQLASITRHRSGASPTVVEANALSVSDAIDLTGASYTDPQASSRSANTLYALDTEDSNAGRVHGLSDWTASVLGLTDPSSAAWLHDEEFDHDYDDSYQEDQDEIDVNFIDEEEHSEGEDLDGDDLDEWLEDYDEDLLGLAEEESLFLEDDFFLAGDEDGDSLLNQGIHHHQALLDILMGDNFSSPSSYPSLVHAPSWQLESGQFSPTLGTRSGRAADQTRSSLLTPSRTTTQQTDFTTESVIITDDEDEEEDHTPNTSFSDDMAPTTRRSSHQSVQAEPPAKRRRTSTNHQPNLGTGDKIAPIKLDDDNIFTDLPTKKHTEAAIDDIPTLDLTNATEVPEELQEPTKDNRIKLAAFQCVICMDDVTNLTVTHCGHLYCADCLHSSIHTGATKGRCPMCRQKLEVKPRANYTAKTKGHWLLELKVMTSTRKGKRKAGT

SEQ ID NO: 3604 - protein, 221 aa, Unknown
  Kingdom: Fungi, Phylum: Ascomycota
MPPSLPQNFRLPPRQNSFAPVPSSYGSASSSPHPGVVAGIVIGSVGGFLLLLFLIYSCLGFGPQLWVQPSRSEYTAASQSVLSFRTRRTSRARSARRPSRAGGARVTETYEVRTRESRGGGGRTRSGARPVVVGEPVVVEPTRAPPPPRVVRSEDSEDDDEEDEIVVLEEHSPPRRKPRRGSSGRRSEERYSRGGGSYYHDAEPGSPSYRERRDRTYSRDR

SEQ ID NO: 3605 - protein, 390 aa, Unknown
  Kingdom: Fungi, Phylum: Ascomycota
MSEVSIPPKATPGRRRNGRGQARTNAPKAYASENDATATASILHESPQTPVKNGPASTARSNNPPNSQTNKSRSRTKSKPKPSNSPEAAADAQQSTPQRAASMSTTKPSMAFAGATFHASPAPSALPMPSFFTKSSNESPAPRPATDPMQQQPSPPATDPELPTPNRTTSASRPNGSPLDFMFRAHREEKERERRGSSLSQKPAMHSEPSPFQSPAHQSAPREFSSVPHTRNPLNRQMSAGRIGSEELDGERGLLMGPAFSTPYHDRIRAARASQPRPNQAQPQSPQQPRDTESLEDKTEALKKFLFSGGFSNAPQPGATAMPANNFSPPQRPNPMVDSYPPASYQGMPAAQQNRSPERPNDIQAMENDLRRILKLNPGTQSGPNGGSLF

SEQ ID NO: 3606 - protein, 424 aa, Unknown
  Kingdom: Fungi, Phylum: Ascomycota
MELMELVDNEPTARPFQCDWQSCDRSFNRKSDLQRHYRIHTNERPYTCSTPGCGKSFIQRSALTVHIRTHTGEKPHQCQHVGCGKRFSDSSSLARHRRIHTGKRPYKCAHDGCLKSFCRKTTMVKHQRRSHQRGLLSNEALDDCTSDSDSGEGPMTPRISNTSWSTPTAEDRYPQPPGNPTLRRAQSYSDNIQQQYAPHPHYSGRAVSHSHHDPSMAMVDHSNMVPMMQRNPGPAPEAFYITEHHNPGVATMTTAGMQRPYHTQRAVIEHGPMDVPYSAPPVEEIRNSPAPGRYALSSGRSPAPQAAMYAPPVHAVPYSVPNSQTLESHAPMMQYAHQVAQPMPRSHHPIPSRTVPSTPAPAPYHQASPPVESEPWYQYQAPVEVATIGQLPVFGSGVFDIYGAPKIEFDDPSMQMPSARVETL

SEQ ID NO: 3607 - protein, 598 aa, Unknown
  Kingdom: Fungi, Phylum: Ascomycota
MHLLRLLLVAQSALAGIITERQDSQACDEKCMKAFKAALEGERSQWATPNFKDDPFYTTPDNASDAKPGDLLRWEDISASHVGQNWTGIPGGMSLSRFLYMTEDMERKPIPASAFVLLPFSAQTPGCNSKVFKTIAWAHGTAGRARQCAPSNHKQLYYGWQAPLFYASSGYAVVAPDYAGQGTDIPGGFRYEAGYLHAADVAYALVAARKVIGDILSDEWVVAGHSEGGMTAWRTNERLAMENQEELLKAGKFLGAVAAAPAMRPIDLIPKSIRLAKGGPMGAPVHVYMVQSLVEIYPEMRIEDILTQRSLDLLPLLDQGCLLTGDALFHNMSVTDIFKSTAWLKSKQFREWQKKINGAGPHKLAAPMMVVQGLGDTLTYPEECEADFDRTCDAFPDSRAELYLVPELDHGPSFQAGQPYYMPYIESLFEGRQIKAGCKKVTAVPSNDRYLILLSRQGKVRLAKWFTTLSPKDKAKIVKDVSQLVLARRTRMCNFLEYKDTKIVYRRYASLFFIAGCSSEDNELITLEIIHRYVEQMDKYYGNVCELDIIFSFTKAYYILDELLLAGELQESSKKGVLRCIGQQDSLEDMEVCDSIRA

SEQ ID NO: 3608 - protein, 247 aa, Unknown
  Kingdom: Fungi, Phylum: Ascomycota
MAAERADKKEKKEKKSSRSDDAGAVTKVKKDKKEKKDKKEKLAAAVLDQKLQEDAAAAAPAEKIEVDSEAEDSDAEDDKKEELPLERTVVSFAIPLADEKGTKKVFKTIRKSAKNNTLKRGVKEVVKCLRKSPASSPSNTSFPGIVIIAGDISPADVISHIPVLCEDHNVPFLFVSSRAELGAAAKTKRPTSVVMILETPQGAGGKKAKDLEKGDEEEFKEAYKTLVKYAQKEYAKQGFWVQGESKA

SEQ ID NO: 3609 - protein, 496 aa, Unknown
  Kingdom: Fungi, Phylum: Ascomycota
MSYRIAQPSEYLAITGLGVKSVKITKAAWVWPLQRCMRFSVQPRDYAMELTAMTIEKLQFSLPVVFTVGPDVNNRGANTTIAEVGEDMVRREDRGDSLMKYAMLLADADDDRKIDSTAQHVTNIIKGIIEGETRVLVSSLTMEELFTNREEFKKRIFRNIQGELDNFGLRIWNANVKELRDAPESNYFKSLSQKAHEGATNQARIDVAEAQLRGNVGEAKRRGEQEREIAAINAQTMVQKTERDIERASAEAQLHTKQTALNRDVDIAKVMAQRAIESQDEELKKQVEVKRAGAELERLRATDLVKATIERESKQQAADASAYEVEADARARQQAAQRRADAQAYTMRTEAEAANFAAQQTAEADAIKRIKEAEGITAMADAYSKMSHAFGGPAGLLQYMMIEKGTYIELAKANAEGIRGLEPKISVWNTGSSSGQGGSSDGTEAMRNVYQMLPPLMTTINEQTGITLPEWQFGKMNAQMGAMNENKVNGTHTNGH

SEQ ID NO: 3610 - protein, 348 aa, Unknown
  Kingdom: Fungi, Phylum: Ascomycota
MASRTASSLLRLAARRTPSSAASIRAAPLTASRCLSGGPPRFDKPGSYSRTDPGVEVEYPEEHELPQSKPVRGIPGQYVKPTLASFSLDGNVGVVTGGARGLGLVIGQGMVYSGSDLALVDMNKEEAERQCQLLVDAFKRENPNAERIPNVTAHYADVADPESVEACIAEIIAAHGKIDNLVTSAGFTENFEAVNYPIDRMRKLWAVNVDGTYLFATSVARHLMERKAPGSMVMIGSMSGAIVNVPQPQAPYNAAKAGVRHLAASLAVEWASAGIRVNCISPGYMLTALTEKILDDNPDLKKKWTSLIPQGKMGQPQDLMGPVTFLLSNASGYVTGADIRVDGGYTVT

SEQ ID NO: 3611 - protein, 576 aa, Unknown
  Kingdom: Fungi, Phylum: Ascomycota
MNFENLSISERKIIVGIDFGTTYSGVAWAETQRHDRRTTITSWPISKTTKEGESSEKVPTKLRYAGDETQWGFSIPVTAPQDEIVEWFKLDLDPQLQSMGTSAFSEKSRGGRDALQLVTDFIGLLGEHLIYTLQEKLGESVIKTTPFEYVVTVPAIWSDLAKDKTKQACERALSLSEKGAPVHLVSEPEAAAIYALHGLDPHGLKENDTMVVVDAGGGTVDLISYTITSLEPVLEVHEAAPGSGALCGSTFLNMRFAKFLKSKLGDEPGFDDEVMAEALEVFEKKVKRQFAYTADPNDTYTIPVGGLPNNKALGVSRGRFALKASALTVIFEPVILEVIRLVKEQITTSGVPINAVLLVGGFGASNYLKERLRSAVDKDVSILQPPNAWQAVVQGAVMKGLANCAPEKWTTLRVKNRKARKHYGMEWRTAFDDKQHKHMDSTKHWCGMDGCWKVYSMEWFIQRGDPVSENKPYYTKFVWTGLVSQGRIRKIKMSIYADQTDRTAPLGRDENVKILAKVEADVSHIPEYKLARRQGNDGEWYYDLSCQIEAVYLSASTTYTLLFNNQRYNTVTCEYV

SEQ ID NO: 3612 - protein, 435 aa, Unknown
  Kingdom: Fungi, Phylum: Ascomycota
MTSPNPPVIIIGAGITGLVLAQALTKHAIPFLIYERDPDPLHRGKGWGITIHWALDTLLELLPQKVIDRLPEAYVDAEATENGDNGNFLFFNLKTAEALWQVPPARRIRMSREKFRRVLMDGIDINWSHTFKSLEHTRDGSVNVTFDTTSSLSTIRSSMVVGCDGSRSIVRRLLFPNAEDHTNHSLPVRLLGASTVYPDSVASSARKLDPFFYQGGDPETSAAHWFSFLDSPSTSGRGDDTRDCQILIAWPFRKGFMGHDEPLEVPLGSQERVQLMTTISNGWAEPFRSIVHNLPEGADVKTISLEDWVPPPIEKWDVNGGLQRVILVGDSAHAMTMYRGEAANHGIMDVSLLISQILPALSKSNANEEQTKEDLLQACRTYTKAMVERAAPAVLNSRQACLDAVTYERIDENSPLIMKRTIRAEPVTKEVTVSA

SEQ ID NO: 3613 - protein, 975 aa, Unknown
  Kingdom: Fungi, Phylum: Ascomycota
MADDREYSGFNPKRRRIDPARSRSKFTNGSRSSTPRAQSRYAQTPARETDNVKPTEKDSLALDRDWYGADELGGHVFGDDSYNPFASYDTSTYDGQQQEMAKAQQMVGRFDARQEQRNKENDAWETNRMLSSGVAQRRDMESDFDDQETTRVHLLVHDLRPPFLDGRTIFTKQLEPVPAVRDYQSDMAVFSRKGSKVVRDARQQRERQRQAQQATSMAGTTLGNIMGNKEEDADSALPMAGEDEAANGKKAHKLGDAMKNRQGASNFSQSKTLREQREYLPAFAVREDLLRVIRENQVTIVIGETGSGKTTQLTQFLYEDGYGKTGIIGCTQPRRVAAMSVAKRVAEEMEVPLGSTVGYAIRFEDYTSEETKIKYLTDGILLRESLNEPDMDRYSCIIMDEAHERALNTDILMGLIKKILQRRRDLKLIVTSATMNAKRFSDFFGGAPDFTIPGRTFPVDVMFHRSPVEDYVDQAVQQVLAIHVSNDPGDILVFMTGQEDIEVTCEQVQKRLDALNDPPELSILPIYSQMPADLQAKIFDRAAPGVRKCIVATNIAETSLTVDGIKYVVDAGYSKMKVYNPKMGMDTLQITPISQANASQRSGRAGRTGPGKAYRLYTEKAFKDELYMQTIPEIQRTNLANTVLMLKSLGVKDLMDFDFMDPPPQDTISTSMFDLWALGALDNLGELTELGRKMSAFPMDPSLAKMLITAEQYGCSEEMVTIVSMLSVPNVFYRPKERQEEADAAREKFWVHESDHLTYLRVYDEWKLKRFSEGWCIEHFLHSKSLKRAKEIRDQLMDIVKMQKMEMVSCGTDWDIIRKCICAGYYHQAAKYKGSGEYINLRTNLGVQLHPTSALYAGHPPDYVVYHELMLTSKVYVSTVTAVDPHWLADLGGVFYSVKEKGFSIRDKRVTETEFNRKVEIEAKMAEDKRLDEEKKLAEEERTLIKKKTAVGAGKKFVTQGSVKKPIVKRRGRGF

SEQ ID NO: 3614 - protein, 427 aa, Unknown
  Kingdom: Fungi, Phylum: Ascomycota
MVWNADLNQPRSDRWHLNGWILPALEEEEEDARRASEAVSERSAEDATFAESTVWLCGDAPPWSPSTHDSDWHTCSTRTTIATTTTTTSIPESSRNRSSFLPKQRAKMSSLFQLSQQYSPLALKLAKSPKVQALAATVGAVIALRRLNRYLSWRGANNCITKKTWDGPKEIVVVTGGSSGIGATIVELLEQKNIKVIVLDIAAPSRKLGRRTSFYEVDLSDADAIATVADRIRSEHGHPTVLVNNAGFANSETILSVSPEKLLRLFSVNLAAPFLLTRQFLPDMVAKNRGHIVNVGSMASFSTQASNVDYGATKSGVLAFHEGLLQELKHVYKAPAVRVTIVHPTWVMTPMAKDIILTGKLGPYVTGHDVASAVVNQLTSGYGGQLVVPSTLGWVSSLRGLPTWFQEQFRDSVTLGLIRAIEETSGK

SEQ ID NO: 3615 - protein, 947 aa, Unknown
  Kingdom: Fungi, Phylum: Ascomycota
MGSQATADFRQHLVFPGTPPDLISPGASSYVSVSAPSEAQTVGSGVSTSPTMSIHDKAEVSPAMQREDSAHSRPDSSSASAAPRQQLPSLSSLFGPPPSRPLHSPVSDRPGAFPTSSPLDRPRITSMDRTASGSYFSHGMPTSMTQPRSTVDGKLDSTDRPSLHPLKRTFSGSSSPGYRDLGHGRSDSRIEADSAGKWSMHHDQSRQEYTFSSREHHFRPPQEHFRLQFPGSKDAHMSLYGDQRTGNSNPPPTPSSINSEGMSKDGLGPKIWTGSHFLPRFVRAADVPGEGLCYFYDDGSHCKTVIDGEAVNAHWGVTKAGKPRKRLAIACMTCREKKIKCDPDFPRCVQCEKFGRICKFKNAPRGGHNGSPTTPPAELDDMRKLGGPVRVGEYRLGDSESGSPISPRTALPNGSPEESSHKRLKLDNHRYQSTTEPHGSISQTLEHSRAEFPAHQRPRELPRIPDNVLNRAWQTDPYVSDPQSIIAVVSHFFAQIDNTMILRFLPQEATLAWVSASAHRKTPEDLLLLYSMLAVGVALSDGPRHIAFEYAQVAHYAQKTLQLDCLQLVQSRIILSLYYISTSRLRDATDLIAAAVAAGSSLQLHLEIDDSVEAKRPSFPLNMNRAGFAESRRRTMWSLFMLERLSGMFPQQPALINAEDICIRMPAESRSFEKQLDDTAPLFDPFEPASRPLDTTGCLIEMVHLWSTCQAAVFRQIRRSVWLGPELNKLRGLLARLEKWRSNLSESLIFEPKNLEIAILAGKAGAYLSMHLLYRHALIALTRYGGNPIQMTRHERMTSVYRCRDNAKLILDVLQAMGHAHRGVPSFWNPMPPTTAFLVGEAVDILSCGGSLASLEGVINAIEGARPAMESMGTVWENQRAAVAIIDEHLTKLRRIQDRGSEPPSAGAGYRIIRSSPGPSCNGVVWQLDDGPRTPSRDLDILFHTQH

SEQ ID NO: 3616 - protein, 531 aa, Unknown
  Kingdom: Fungi, Phylum: Ascomycota
MPDIDPAALSRPANFSTPTLSSKTLSITAPGAVKISKSQAIPQRIDLEPLYTALKAAIAPEQWLPYKEATTEFLIGRLNQTEFAERVDPILEGQTPEKQHLHNKLISAIYANVTREMPDQGPAPWVSAHNKPVTSATAKPVTGDAAERRLKGDVMQLPARDRRRIKDLVQNEFDATESLSNMFSDTYRRPSAVSEVPVSAAAGGINKMNFDLEIRKRFAQPLAIESGEFPDVGMITGRMLPMCYEAGLSNGHISDAPQLMSIATEIFIKEALSQVFSRTRSNAPGDSGNAGFGPNIPTWIQTRKYKKQLRQEEAAAQRGELLRDKSGLLPVEYKAASERAPLGMADLRLALDMADVGLAQFPIITSQVLYGYREGELESWDDYTWYNGIKPAHAPLELAPVEINGDRVHELPNGHPDAMDIDNDTCRELVGTAAAKGLEGWPIGLEDSSPFTTPTPAGVSSPQSWHTDEEPEIKAEAEDEVNCKPKPTSPQSCEDQASQPREQTYQRDPWRHGRSMAYCSGGEWRAPEAIM

SEQ ID NO: 3617 - protein, 1225 aa, Unknown
  Kingdom: Fungi, Phylum: Ascomycota
MSSPDVFLSSPRVTRRMLHATGASSPELPDLNDLIKSQRSARPPLKSGSKAAPIPDDALAGFTTARGLWQSAQSAEAPSESVLQTADPIYLSGEDDFVCIIDAPAKTDKPTKKPGKPRQARRQTSKAIAPATLRSHPEPSSPRTPSKEQPWRKYLPSPKGVSESPPSENVAFEAPPSAQIPEEEPRLLETESVSKHFRPKRLESKEEPKAVPIPSEPVVLDPAPLRRLDWTPPAKDTVSNEALDHDSDTRQVDSPKDEDQVVFKDLLRDYSCSESATNPDPDGIKAPAAGLGKRKLIEPVVVREGDISERSRSSSPTKKKAPKKPRTLTELATAAYRIQEEPEVPPPSLLNYVTVNSGDGGPAAQSDNKGKDKPRKRAGSKKKAALAKPELLSPGAALKHVANQDFVFGTSSQLAQERSPTFLRSLHTAMRQSNDIDECAFDIPLNSDDIEIPKTHSRLWDAAARDADGELFDVEVVNLIDASPTLSRIAEEADPFGYGNGDGAGQDHRQPLDAATDPEDSLLSLSEILPRKVSRPLETSAMGTKAIAGASEADQKPDRQTMSTVAEDTQESTLPPLPVEAPVRPAYESFTDVQLAKQVSSFGFKPVKRRATMIALLDNCWKSQVASGRLTSVSPKRSITTKAGKSAASPRPRGRPKKTASDVPATADSTAPVDPVTPTKKPRGRPKKDAAIPTKVSAKATAPRAKKTNVSPARKGTGKAKTTATKSQSVLEIPDSESDQASVRSASRSVSPDPMFSSPAVRANLAITRGDDDTEMSLTMTPTDQQASLNEHITKAVTSAPRSKDITDPSWYEKMLLYDPIVVEDLAAWLNSGQLTNAGYDGENVNSDAQFAFLIMLLLPGSWRIPLSHILRLKLVSIPRLSPSVRVFATMPPPRPSSSIVLLSPTNQVLLLHRVGTSSSFASAHVFPGGNLDAFHDGSDVPKPGDEGMHRDGKAYRLAAVRETFEETGILLATKKGEKRLLEVEAEEVATERKRIHNSEVKFTDWLESKGAVADTDGLAPLTRWITPNNLPKRFTTQMYLYCLPITSSSTPSSYLVPTPDGGLEHTTALFSSPQSFLSKASAGEIILFPPQHYLLTLLSRFLPSDSNPAHGPLHYQAQREKLMDFIKRVPTAETKKGLQDRTSQIPWSEKVMSPRTLFVREEDGRVVLGLEKPGPELEGSDRGGDWERVVLVRFTKKGPVEVEVRGREEVFEEERRRQTTTEKL

SEQ ID NO: 3618 - protein, 512 aa, Unknown
  Kingdom: Fungi, Phylum: Ascomycota
MSGRPGTPASPKNVKIKSPAPGTPVFGCEHVQLLFDRGQEVMNSCISHYKMILRGIFDSTPIVPQTSTNNDGRPVTTLTSNYLCLQCPSTVTEEDRLKHGNKKSHRFYVDSRTGALYCQICDDLVWDPTLEELRVRKIGTGSFSGRKRKHDELFTDSGKEDPRYITTNTVTAPCRANGLRGIYNAGATCYQNVVLQSFLHNPLLRNFYLSDGHQSSDCKVMNCLSCAMDDMYQEFFALEHTNGYTAASILSAFWISEKKAFENLVTTKEQDAHEFFQFLAEELHERNGDGKRPETGSEHLCNCIIHQTFYGKMQTTTTCQKCSGTTHAVQSFLDLSLGLENLTLKRKKNPTASLMLRDCLDEEYVKSDKCEYRCHSCESSQQARRQTSIKRLPNVLSIQLKRFEFKQGRSDRAAGKVDTPVQFPLQLNMLPYTHRARSRDSRENMELERSCTYDLLSVVVHVGELDTGHYTSYCRVGDQWFKFNDHKVEMASISEVLGAQAYLLFYIIRSLA

SEQ ID NO: 3619 - protein, 305 aa, Unknown
  Kingdom: Fungi, Phylum: Ascomycota
MATTVEDPAATEVPQSNETITSVASVEPQSEGLKRKASTEQSIDDNESTSKRPRSDSSHARDTTTTETQRKPSSVQDEKKRNRRLFGGLLSTLSQSTASNPAQKRRLEIERRQQERLQKQREDDERLRKEKGDHRRTARVKEGIAWEEEVMKNRHRRILESARFLKTKARPTVYYLPFKRSAKHDELIEDQIRRTQKLIEREEDDFEERRRKHEEQYGRPSHLEKTADTRASMDLDKEDIGSNPPLQQSSQTVDRKYSEDKHAPVERHTASTAPQAPVRGDHGDHGDHDESGDEVVDAEEDMVIY

SEQ ID NO: 3620 - protein, 576 aa, Unknown
  Kingdom: Fungi, Phylum: Ascomycota
MPSFNPFSSVSGRSSVTLYDIRLENDFIVFRGTDHESSGQLLKGVIVLCLSAPLRMEDIRLRLTGTLRLNWADQRASTPGVSGQKVDKSTAILDHRWSPFVGAHGKSMTLPAGNYEYPFEYMLPGDTAESVEGIPEASITYKLKSTIGRGKLAYDLHSYKHLRIIRTLEPGALEFLHAMSVENIWPNKVDYSIVIPQKAVVFGGFVTMEMRFTPLLKGLELGEVTAKLIEVRDCMVQGPANITMREHRTEREVSVWRFDVTRDEHWSDMIEDTGQDGWALSKQLNLPRKLRQCVQDLNHHGIKVRHKIKLTVALKNPDGHISELRATLPVSIFISPNMPLDEQGNLVSQNPGGGAQPSDSGAVAPPGYGEHILDQLYDEVDISGLQTPGIQSGVSSPFYAQSRSGSMENLASLNAPFPPAALSSRLADVSIDPSMRNPPSPPTAPRSEPQSTALSRSNSGEDHSGRESPEAGVDMSEFADLSRVPSYQTAVRTPARSRAQSGSVTLPDYHTALSAPSTPPATDLHTAHDILAPITEDTAGEHQSRTQPRFESGRVHTTDSTDHRRLAILQARDQVY

SEQ ID NO: 3621 - protein, 697 aa, Unknown
  Kingdom: Fungi, Phylum: Ascomycota
MASHPDWVKKLTVAEPKGNTLLTKERAQSNIDVDQLAEYLHGKQELTTRANLLSILIKDPVFDKSQNYFQGREDRIEASLAKAKRLRQLQIKHKWSETEYHVANDLLSEPTPYGLHASMFLKTLRDQGSPEQHKLFLEKAEEYKILGCYAQTELGHGSNVRGLETTATWNQNDKTFTIHSPHLTSSKWWIGSLGKVANHAVVMAQLIINGKHYGPHPFVVQIRDINTHEPLENVQVGDIGPKFGYNTMDNGFLLFNNVKIPHVNMLARFSRVNPESGKYEKPANPFAVYGTLTWVRSNIVLQSGSVLARGVTIATRYCAVRRQFQDLDAKGNVGENQVLNYTMVQYRLLPLLAATFALHFTGRSMINMYEENQARMATKQDVGKLSDSNRRPGPEEVNPGTDLLPDLHATSCALKAYGSTVAGEGLEVCRRACGGHGYSSFSGIGTWFADYLPTLTWEGDNYMLTQQVCRYLLKTARAVLAGTATDNDTSRIFKTFLARRDTGAAFDILASDQDLVNAFAWRVSYLTFDALQHRDVEKQSWNSLLVDFHRLSTAFAQYMVVKSFYEAINDSSAQASLERSTTSVLHTLFRLFALHTLEKEAAEFFSANATTLRQIQLSRKAVMKLLEDVRPHAVRLVDSWAFPDWQLDSSLGREDGNVYEDLFHRASVLNPLNKTVWDPYPESDVIVKKDNRVKSKL

SEQ ID NO: 3622 - protein, 648 aa, Unknown
  Kingdom: Fungi, Phylum: Ascomycota
MPAPSSEIQTVTYDGHHVYSILPANRREAADLEERFATYHTQQARNALEVVIPPHEVRSFEELGLDARLISRDLGKQIRDAQKPSVYSRALQKRGELPDLSWFDTYHDYDDHLQYWDDLVASFPGHSNKIDLGKSFEGRSIFAFNFWGKKACPGKKPVILWHSTVHAREWISTMVIEYLAHQLIDGYQSGDEEITKFLDHYDFWLVPFHNPDGFVYTQTTDRMWRKNRQPRANTTCLGTDGNRNWDFQWDAEPPEGGSSPDPCSQTYRGLAPSDTPENQVISALSKRLGATKGGIRSYIDFHSYGHLVLTPWGFSCDPEVLPPSLPRMVEVAKGFAGGIASVNGTEYEAGPGCEILYFSTGNSRDYHHGANGANHSWTVELSPENAREGGFVLPPERIWQVVEEQWAGQLYLLNEIWDDSEKSVILAGLLWKRTSPAPSASRASDTDGMASQPTTPELTPQFCFSTRTLRDFLRLSRSSIDDSITQNLNALITPSRAGFDSSALSQRSTNPHTRTPDPQACQDFRDKVLFPSWEARAEIINYCGMVATSPDKEDPEAELRAIENQKDKERVVNERLDPYSGRFFPREARTEMLASLMRQERGVENIVRARTWEMVQQRCAGGVEGGSWEDAMAEWRNRKRQQRNEAEG

SEQ ID NO: 3623 - protein, 714 aa, Unknown
  Kingdom: Fungi, Phylum: Ascomycota
MGRKPNPLILEYFVRGPKLNDNSNRYPHTCKQCGENFPKGRIDSLTTHITKKCPAISDSDRMRACLELHGLSTARAAAAERNSLMNGQINSAQAAVSALPQGWSALETLAEASRQVDLNENNRVPKTEAENGVPAMDTVDEPHTTDRFELQEPFTLDNPPISFETALKMDPPEVMVDAPSSDLTPEERLQALVSRETPDPTNLSVAVAAAARLNPSFLDPQLVPNETPSEPLAQEQQPEIPTPTVETQEVPALDILPQTSTTKPTEMQPWGEMTYMATTSPLPMLTESPNPPMQMHRGGIRMDIGDIGPLGKARHSRARFTPARRKEVQEVRKIGACIRCRILRKNCGKGTPCDTCRKVLSPRVWRTGCVRTRLHEQLDLYSAGVQVVLSQNRINMLKSQLRLHDNETVVEMSHFPEMDLNVVCPTLVALLEPSEGQAAARQSEEPFHQVIMIDQDSDDVPDKVERYMRAVLPHFIEREPSKFMRTTLETATQQLQADEDDLLRKALELWGLVESIDRERQWSILEKPGGNAEEARWIKEAHGETDADIYTMICMQLNAAAERKANSTSRNLLSMMHRLLQDSKVKIGFNMFLTALIFLNCVEKSTWAFKAWEQDHLRPGWPLERDPGVFTQQGDTLAGLLKMLLTIRKALPTTSRSAEGKLVTEDTDPMVLAYFQTIDLDFDTIQFRQEGSQFSPADSRSLELMFCSQLLLPN

SEQ ID NO: 3624 - protein, 1217 aa, Unknown
  Kingdom: Fungi, Phylum: Ascomycota
MQSSPGMLTKFESKSSRAKGIAFHPKRPWILVSLHSSTIQLWDYRMGTLIDRFEEHDGPVRGVDFHKTQPLFVSGGDDYKIKVWSYQTRRCLFTLNGHLDYVRTVFFHHELPWILSSSDDQTIRIWNWQNRSLICTMTGHNHYTMCAQFHPKEDLVVSASLDQSVRVWDISGLRKKHSAPTSMSFEDQIARSNQNQADMFGNTDAVVKFVLEGHDRGVNWVAFHPTMPLIVSAGDDRLVKLWRMSETKAWEVDTCRGHFQNASGCLFHPHQDLILSAGEDKTIRVWDLNKRTAVQSFKRENDRFWVIAAHPEINLFAAGHDNGVMVFKLERERPAAAVHQNTLFYITKEKHIKSYDFQKNAESPTLLSLKKLGSAWVAPRTLSYNPAERSVLITSPADGGSYELINLPKDGSGIEPAESKRGPGNSAIFVARNRFAVLNTANQTIDIKDLSNNTTRSFKPAHNTTDIYFGGTGNILIINATSVHLYDIQQKKSLAELTVSGVKYVVWSNDGLYAALLSKHNVTIVNKNLEQVSTLHETIRIKSATWDDSGVLLYSTLNHVKYTLLNGDNGIVRTLDQTVYLVRVKGRNVYCLDRSAKPKILQIDPTEYRFKLALIKRNYEEMLHIIRTSSLVGQSIISYLQKKGYPEIALQFVQDPTTRFDLAIECGNLEVAVEMAKQLDKSSFWTRLSSEALAHGNHQVVEMCYQKLKQFDKLSFLYLTTGDHSKLARMAKIAEHRGDFTSRFQNALYLGEVEDRIQMFKEIDLYPLAYMTAKSHGLDEECQAILEATGATEDQLTLPKIGSPLSPPRPVVPTYKTNWPTKASSQSFFEKALLGQVEGLSLEDDAAATNVMDLDEGMGDDSARNAAAMDDDEEDVAGWDMGDDDIPEVDDFVNVESTEAGGAGSSEADLWARNSPLAADHVAGGSFETAMQLLNRQVGAVSFAPLKPRFLEVFKASRTYLPAASGLPPLVNYVRRTLDETDPRKVLPIIPRDLEHLAANDLQKGYDSMKANKLEDGVRLFKGILHTILINAVSSEGEVAEAKKLIRSASEYALAMEIELARRQQGPPDVLAKEPEKLKRALELSAYFTIPKIEVPHRQLALLSAMQLAVKNKNYNSALSFANRIIANGGATKIVENAKKIKAQCERNPNDAVEIEFDQFAEFEVCAASYTPIYSGTAYEECAFDGSKYHSKYKGTVCRVCEVCEIGKHGSGLKLFA

SEQ ID NO: 3625 - protein, 376 aa, Unknown
  Kingdom: Fungi, Phylum: Ascomycota
MADISTCLPLSRPSVVAAHELIASHIHLTPVLTNTTLSDLASTPRTADELKGTRWEGRTPAKPKVRLWFKCENLQRVGAFKPRGAFHAIERLKLEEGWKEGGGMGKGVVTHSSGNFAQALALAAKESGILAHIVMPEISNPLKIAGTRAYGANVIFSGSTAPERDAVAKKVMEDTGARFVPSYDHPDIILGQGTMGLEMQAQVQELVGKGGKGLDGIIAPCGGGGMLSGIALSAEDTGIKVFGAEPIHEGADDAKRGYYSGTRVPAVSSLSIADGLRTPLGAHTWSIIRRDRGLVHGMYSVTEDEIVRTMRLVMERMKVVVEPSACVALAAVLFDEDLRETLEKEGGEEAWELGVVFSGGNIGVEKIAELFGKAQS

SEQ ID NO: 3626 - protein, 611 aa, Unknown
  Kingdom: Fungi, Phylum: Ascomycota
MDSFIPTQTLNIRDHGDAAAAVTLPTGTIAPYTTALNGVNQEMNMYLKRVLWWTLGAAALFILTIRIAELLFSKLRLINAMSQPRDKQTYWKKAQWSWMPWLKKYITYAPLWKKRHNREIRLSSVLHFGTLPSRLHFIILFVYLGCNFAYMFLLNWHNENRYAFCAELRGRSGTLALVNMVPLIIMAGRNNPLIGLLQISFDTYNLLHRWMGRIVVLEVVIHTIAWAIPMVAAAGWEGVRHKIMTDLFIGSGTIGTVVMVIIAIWSVSPIRHAFYETFLNAHIVLAAVALVCTFLHCITSLHPGGLPQWSWTIAIACIWFADRLARVIRMMYANWGSKGFTRAYCEAMPGEATRVTLTLPKYLDIKPGTHAYLRFWGVNSWESHPFSIAWVEHDLDETLPVHEKDPLAIYDRAGKTSVAFIIGAQTGMTRKLFNKASVNGTMTIRAALEGPYAGHHSLDSYGHVVLFAGATGITHQMSYIRHLLDGYNNGTVATRRVTLVWIIRSHEALEWVRPYMDAILRIPGRKDILRIQVYITRPRNPRDVHSASTTVAMFPGRPNIPLLLAKEVQDQIGAMCVTVCGAGALADDVRGAVRAVQGESSISFIEESFSW

SEQ ID NO: 3627 - protein, 592 aa, Unknown
  Kingdom: Fungi, Phylum: Ascomycota
MRFAQALRRSIKGEKEKQNVNIAPKAAVAIVPPKKVIRALYDYEARSTQELSFSRGDFFHVIGRESDPDWYEACNPALPDARGLVPVAFFQALGRTERDSQQSDSGRPPTASKNPDHDSGYSDSTAQQPVQSAGGPTRESQRSSKSAGKSSAMVYGIVMYDFAAERADELEAKAGEAIIVIAQSNPEWFVAKPIGRLGGPGLIPVSFVEIRDMASDKALSNPGDALKKANIPKVEEWKKMAAEYKNSSITLGKFEGGVDPSGAMQQGMDRLSLQQGGRQSSQTGSQQFGPSGGSRTASQQAVQPNQFASESTPDLFAPVQARIPRYCFAEDKYWFVIEAMLEDGRHWELSRYYEDFYDFQIALLTEYPAEAGNTGTQKRSLPYMPGPVNYVTDAITEGRLHNLDAYVKNLLNQPPYISRCNLVKQFFAPREGDYEIDPANSGEEYRLSQGSQGSAGAPDGQRNYNGAGYGGSNSTPRQMNSHPGMNRQQSSMSQPSQQSLGAGQEGQGMPAEAIKVKMYYNGDLIALRVPKDIMYDQLRERIQDRLKVAAPDRMRISYKDEMSGEKPMLSNDGDLDDALNRNPKLMLYVEMA

SEQ ID NO: 3628 - protein, 299 aa, Unknown
  Kingdom: Fungi, Phylum: Ascomycota
MSHLPQPSAAFISKKAKILEQLDVPDESYTDLSPKGSVDVGIRDLINEVNAIDGLVTTSSCGGRVSVFLEGIKRDDGGRDGQVATPGGKGAGGAWLFVSHDPVKQGSEETQDWSKIFCLKDNGEELEGKSRRLIHFKFEPMILHVFTASPQHAQLILRSALIAGFRESGALNITSSTSESSETPTPMVGIRSMGLGFESLIGVQSTGQRKQLVSSEYLVELARIGNERFVENTIRIERFREALRKATVGDTRVGDAGGAWEDAETRRERKRAEGLRKKAEKATEAKLTGTEDEGVSIPW

SEQ ID NO: 3629 - protein, 258 aa, Unknown
  Kingdom: Fungi, Phylum: Ascomycota
MFDVKHLLFLAPLAGVAFADLELDRDDVPPPCRDICQPIVDLTSRCNVDLPGDNNDRDEDRLERQCVCTNDSFDVGRIAGLCASCFQQNFRTPDNDDDDDNDTEWDDDGKLLPKSIFALYVVHANSETDIQEIMRDCGFSTESYSSQLSTAAQTVNVVASAPTATDQLTTTIDRNNAQPTNSNGGSGNSNNNNDDNSNNDDSSQSSDAGSNNADQTSSSNNPDETDLAVPGAVPLAGFSAAAALGLFGAVAAGGAFLL

SEQ ID NO: 3630 - protein, 398 aa, Unknown
  Kingdom: Fungi, Phylum: Ascomycota
MILDTRALRHLTAEDWKVLAAVEQGSKNHELVPTPLIEKLSRVRGGASGVHKSISALAKTGLIAKMKEARYDGYRLAYGGLDYLALHTHSSRKEVYSVGSRIGVGKESDIMIVADEKGVQKVLKIHRLGRISFRSVKSNRDYLKKNQSGSWQYLSKLAAMKEYAFMQALREEGFVVPEPLSQSRHTIVMSLIDAHPLRQIATVPDPAALYADLIAMILRLAQHGLIHGDFNEFNILIKETPITLEDGTETVKVEPVLIDFPQMVSMLHQNAEMYFDRDVNCVKRFFSRKFGFTSDEPGPFFEDAKKMVGTDGCKRLDATVEASGFTKKMMKDLDAAIREQEAKRSENGEGSLADLSGEEHGDSSDDEGALNGRFDAGEEESDVRSDAEEAGDGVTSKP

SEQ ID NO: 3631 - protein, 370 aa, Unknown
  Kingdom: Fungi, Phylum: Ascomycota
MPSPNHVLTDLSLLGMLYCATLSTVYIIAGSITFDLIHWKIHHSGRSSNPLLRCLSRAHIAHHQYFDRRLTFNKAFSLRNNLTNAPLELLSQIIGSLLSWKFFRVFGLRPSLVQYEDIYLALSFLIVRAGVVAFNEGRDSNHIAYTQLPADPHSVIVGPEYHALHHIDPQGYFGSMVRVVDWVFGTASTLHGRNILMTGSGGALGQALLGELNKEKGTSVQTLHFGHDWTYENYSRLEKALRTTDILILAHGSKSTNAFKANCESARIIVETFMRVREPSSSLLRPEIWYIGSEAELHGAWTADMEEYAASKRAFASYAREYYDNETFLYRHVVPAAFSSRMGWAIVSPKWVAWVALWWVLLLGEANERV

SEQ ID NO: 3632 - protein, 1342 aa, Unknown
  Kingdom: Fungi, Phylum: Ascomycota
MSELSPRGVRFSAGEEDMRTERLKDPRLSTVALESEDSSPESNGDPHANDQDDDLDGMDRYVDASRHAGSMGSLGTITPSSSMNNVTKSQRSNGDDGPSFNGTWPQRPLGPTRTPSNTYNPGSSRKPAPQPAPSFTDSMRSSSKTRPRQNESRFRAQERAYIQKLRQDYSGEYFASYEGTTGNDSDSEGEGETPSSEGPFDDRYDEETIMFYNNETLQPTEEDLQNKENRERLEWHGMLAAVLMGNVVSQEKQRLHGSSDKKLLIRLSCGWVRMVEEARATIDRTLDEIVNFSVKGASEVGKSPYEQVNDVVAKIERCESLYPSWKVIKSEHKAADSEAFNEAYDSILSWYNTNEMINTELAILKKWVGNEEMDFSRTKQRSPAVHGISSDETSFLDRLMKEDGLRSLYNDDDKSAEKGMLLRQKGMLLPISTIISKAKQTLIKNSGPFEKRHLPPYLEELLTLISFPSRLIEEITRTRLAYARRVKESAQQNPLMQDQMISQFQLLLRFAIRIKVEYLAIAAPEPGWELPPLIDESFDQVVLEALKYFFKMLNWKLSGNKNTFKEAELLFEQWGFANEIGGHLLRGEIEVAEQFSSLTFKALNRLSQTFEKELQAKPKESAADMSKRYKACLDSVRVRHRMLQRFSRNLSEQYEHACDFSINFPQEEMQRIYDQLLTTGHFHVNTGVFEQDGVYILASAGLRERPDDIQTLMAVTSKETFGPEFSDQYLLILRPEEPLSWFGPSISLPLREQNIDLKRGQVRLCATGSIALPIARRIFLDAVDTHIDLIQEHRSNIHKVNTRLMETRRVAYKLSNTFMDSVETIRKQAEGKDCQELIQTCFVFATEFGQRSLQSMDTNRRQMNNIKLTKLALDWIGFIVDDCVASDRKTFRWAVQALEFAMRMTLGRHILALGEEDYALMRDKVAGCMGLLISHFDIMGARSTLAAQAEREKLEAMVGHFKRMDHNGMLLDDSEASRNITEQRMESLDHLDEFRRDKEAERQALGRVLEANTEADRSLAYLSSSATNITMRWQQGHYVGGGTFGSVYAAMNLDSGHLMAVKEIRLQDPKLIPTVAEQIREEMGVLEVLDHPNVVSYYGIEVHRDRVYIFMEFCSGGSLASLLEHGRIEDEQVIMVYALQLLEGLAYLHESGIAHRDIKPENVLLDHNGIIKYVDFGAAKVIARQGRTLVHDLTSTKANNSMTGTPMYMSPEVITGENSGHSGAVDIWSLGCVILEMATGRRPWANLDNEWAIMYNIAQGNPPQLPTQDQLSPQGIDFLKGCFTRDPKKRSSAVELLQHDWIKAIRSQVVEPATPSDTSSSVQSTPIASTSSRGSAGPDGFY

SEQ ID NO: 3633 - protein, 582 aa, Unknown
  Kingdom: Fungi, Phylum: Ascomycota
MSVVAFFRHGLRLLVPLAVACTIYLYLYPIFSGCAFPLPSGDSKEAFDATKRLHWPYNANEQPEGLPSKHAPFRLLALGDPQLEGDTSIPIKHLGTLPHLKKIYKRATFKKEHHSLSDRVRMILHDTIDFYFEDIPNLLESWRKVFDLFGNDFYLAHIYRTVHWWTQPSHVTVLGDLVGSQWIDDDEFDKRGGRYWNRTFKGGQRVPDDVALWPKNEYEPSGFLDGRPAEDVWKSRIMNVAGNHDIGYAGDLTEERLERFERVFGKANYELRFELPITDPEVNATTKDNDPESHKLPPEIRILVINDMNLDTPAKSGPLQDQTYDFINSAIHSSADVKYQGHMTLILTHIPMYKPAGVCVDAPYFAFHTKEDGGGVREQYLLSADASKGFLEGIFGVSKDTGASGKGLGRPGLVLNGHDHAGCDTYHYVNHTHGEKPADRKWESTRWTDAKAKGIPDMELMPGRREITVRSMMGDFGGNAGLLSMWFDEESWEWQYEYATCPLGRQHFWWFTHILDFLALLSVVLYGIIIGLEKAGLNIDAMLCRSWKVSRDTMKRLAGNKVRPVTDGTSAKDRNGNVSPMT

SEQ ID NO: 3634 - protein, 544 aa, Unknown
  Kingdom: Fungi, Phylum: Ascomycota
MTTRIFTNGRLFTGTDLNDAKHTAPTTLVIKGSNIAHVGKDDDSVVAEAKKLGAKVTDLNHRIVAPGFIDAHVHILFFGLSLQKLDLEHCNSLGEIRSAVASYAKLHPGLPRVLCRGWQQSSTDGEALARDLDDLDERPIYIEALDLHSSWCNTAALKELPIERIRADCPSCITCDESGSPTGLLSEAAVTQFIWPFLVQQCTEDEVQAALGQAFKAYVEAGYTGIIDMAMEKPLWSALDKYRKTNGLPLHVAAHWFVPYLEDPVQRNKCLQEAIEMHQLWHPSKSREFCVVGIKIISDGVVDGCTAALSDPYGGKTVLVHPIWPRNEMEETVAAAVKAGMQCAIHAIGDVAVTQSIDSIEAAQDPQGRHRIEHLEVTNKEDAARLGSIGITASVQPIHSDPARLIGYSKLLGPEKWSRAFPYSEFLEGNANVAIGSDAPTASHRALHNLYCATTRRSAVQPDFQGQTNPSGALTMVHAVMAATYGAAYSRFAESWTGSLKAGLRADFVVLDTPWDPTKLLDAQVWETWAGGEKVYEASSRPNL

SEQ ID NO: 3635 - protein, 467 aa, Unknown
  Kingdom: Fungi, Phylum: Ascomycota
MSHITLAQQGLTAVDARQWDEAITKLSKALQTSQNPHWLIARSKALVGSKRFEEALDDAHLAWYKAYDRNKREALAEAHYRRAVAHFRLKQYADADRCCIYSMRIVKGHPAVEKEDPTAAFVDEKGFWKQTVENAKEESRQEESSGQKADGLATAMGADAAKVPKAWRLASAMRVQALSALERLPVDDPARQVSVTLKPPQKKLADVGSGETRVEKSDPGTQANKVPAPASAPSKPVDAPLRLQEFQNDTTMSVSIFSKGNKKEELKVDILPTSVTINPILYPNGEAKSFKLDLWGEIDTAASRYTVTPSKVELSLKKSSPGKWAQLKSETPSSSQLDASDKAAEEERQKLEALKDARKKAMENADKVDSQSTQTSTTAPAPSYPTSSRSGPKDWDKLADDSDHEEDDGVNTFFKKIYKGATPEQQRAMMKSFTESNGTSLSTDWNDVKDRTVDTVPPEGVEAKKWD

SEQ ID NO: 3636 - protein, 270 aa, Unknown
  Kingdom: Fungi, Phylum: Ascomycota
MSASTRLAPRLRQLWTSLPTASRPFTTTSRLAKEEWPQRTPLGSYYKSIIQEPPPYPFEEKPEEPPNSADPEVLPDEKKPEAPAAPRPAKKKPGRKPKNGTSTASSSATPIPPQPSVEASPVPSPPPTTAQEKARIVFGTRLAGPSDRAERLKALKNRSQYIGGVLVPPMPEEPDNCCMSGCVNCVWDLFREDMEEYTAKKSEGEARLKAASSMDADGGGLGVNVGDTKIAKDLWDEDVFKNVPVGIREFMKQEKRLKEQHERDGTSGST

SEQ ID NO: 3637 - protein, 302 aa, Unknown
  Kingdom: Fungi, Phylum: Ascomycota
MSERKVLQKYYPADFDPRDIARRRGPKQTGPRIQTVRLMAPFSMKCTTCGEFIYKGRKFNARKETNQDEKYRGNQIFHFHIKCTRCSAPIIFRTDPKNSDYAMVKGALRNAEPWRNKDTAAETDEERLDRLEREEAEEAGEEETNAMADLEAKNADARREMAAADALDEIRYRNARINRNEKDGMDYADTIVRSEDEERERQEREDEEAARRAFAAARGSTTAPNPIPADDEASKEATPSAALLSQVGDDGFVKPALPASALAAKEQEAAVSNGTAPAPTFKRVVKKKKDHSALLGIKKKVV

SEQ ID NO: 3638 - protein, 284 aa, Unknown
  Kingdom: Fungi, Phylum: Ascomycota
MTGDFTAYLIPVACFPPSPDLNTTLNLPIEKLEAPDTESLLRNDQPEKPLLSQQARWRRQLITYLHLLAIILYSSIAIYLYLWSVRLSATGCESNSAIVFSPAQTAVQYEKQTIVHNVVDNGKYRGPPRPEQDEAWESLLRYNNLRVQETDLEKANLTSVPLKDAAGGYLATLDVFHSLHCVNKVRKSYYSDYYHDPNPIADQQEHFDHCIDLLRQVIMCHGDVSLHTYEWKDDYRWPWPSMQTTHQCRNWDRLMDWSKDHNVPSLTGPILSHPSLGGSSIGFP

SEQ ID NO: 3639 - protein, 511 aa, Unknown
  Kingdom: Fungi, Phylum: Ascomycota
MASNIDFALYESPVGYALFKVVSQADTVGLKLKETQESVNDVSKFSKMVKLANFSPFRGHVEALENINLVSEGIVSDYLKNILELNLPNTSGKKTKVVLGVSEKNLAGGLKAAFPGLQCETADTNDVVADVIRGIRLHADKLLKDLKHGDVEKAGLGMGHAYSRAKVKFSVTRNDNHIIQASATIDFQDKGVNQFFMRVREWYGWHFPELVKIESDNYTYCKLVLAIGDKKTLTDDKLHDLAAVVGEDGEKAQAIIDAAKVSMGLDISAADLEIVMGFATAVVKQAENRKTTSNYLDKKLGSVAPNLQALIGTPVAARLISHAGSLTNLSKYPASTLQILGAEKALFRALKSKSNTPKYGLIYHSSFIGKAGVKNKGRISRYLANKCSMASRIDNFTEEPSTRFGEALKQQVEDRLEFYATGKKPAKNADVMHSVMQIIDADGGDEEMDDAPAPSSAKKEKKEKKDKKDKKEKKEKKRKHEDVEMEEAPTPKADGEKKKKKKRKSLAADDE

SEQ ID NO: 3640 - protein, 407 aa, Unknown
  Kingdom: Fungi, Phylum: Ascomycota
MADQKEWNDFINAAIEERRDDINSINRLVHENPELAYEEHQAHDNFVSLLTKLGFEVKPHICGVETAFSAEYGSGGRLVVFNSEYDALPGIGHACGHNLIASAGLASFLGVADALKKSGKPGRVRLVGTPAEEGGGGKLPLIKGGVYKDAAACLMTHPGPQYLLKGKCQGVAAVKMLANIKWRIYFSGEPAHAAMEPWSGKNALDALCIGYVAVSALRQQIRPAERMHGIFSRAGDRPNIIPHETSLDYYVRSDSLASAERLWQRVKKCWDAAALATGCTVKYQPINSYADVRSSSVICKEFCSTMDTYGHEVSFDDPADFLAGSTDMGNVTYECPGFHGSFGIDTEVGQGNHTEGFTKAAGLEKSFDRNMDWSKGMARVVWKVLVDDEFATRMKEDWEEDMKRAKA

SEQ ID NO: 3641 - protein, 371 aa, Unknown
  Kingdom: Fungi, Phylum: Ascomycota
MAGPSSSRLFKPLKVGKMQLQHRITMCPMTRCRITEDHVPQTQVVKEYYKQRACVPGTLIVTEGILCSKPMAGGFPSPGIWSQEQISAWKEITEEVHRQGCFIVAQLFGFGRAASEEGCRQEGFDLVGPSAIPIDPNHPTPRAMTLAEIKQTVADFAQASRNAIEAGFDGVECHGANGYLLNQFLQEVSNQRDDQYGGSIENRSRLIVEVLEAMVKTVGADRVGLRLSPFSPFQGMAVPVPYPQPTHLIRKASELGLMYLSMVEGRISGSSEGELDGDLEFAYQLWKGPFIAAGGYTTEKAKKLVDQERTGSDIIVGFGRSYVSNPDLVYRVARDIPMTKYDRSTFYTATPEGYTDYPASKDFGQSIGVPS

SEQ ID NO: 3642 - protein, 283 aa, Unknown
  Kingdom: Fungi, Phylum: Ascomycota
MSDLQNFENTFSLAGKTALVTGGSRGLGLHMATAFLRSGCSHVIITARKREGEQGIDQAVEKLNKLPGVKGKAIGLAANVGDSEAIGKLVDEVKGIVGDKGLNILVCNAGAAWGSRFEDAPPHSSVKILDLNVRGIFELVQKSLPLLEKAGSKADPARVITISSTAGTNVPHVGEHGTIMYSTSKAAANHLARNLAVELGPRNITSNIIAPGFFPSKLAQGLISNLGGVEELSRDNPMGRLGEPEDIAGVAVFLCSRAGGYVNGVDIAVDGAARLSAGRMSRL

SEQ ID NO: 3643 - protein, 368 aa, Unknown
  Kingdom: Fungi, Phylum: Ascomycota
MKLSIAFALTSAVFATASPHPPSHGACDAGHSWAGVNSFFLHAFPKRERLEVLDAVKAAKLKVVRLFISETFPDFKRTGSIYMPDIEPKKVGVYDDTQLEAIDQLMVEAHERGIKLTIAMHDRYQLGCWGNDTYTDKYNLPKVDCALGTVKQNNVTSWYGDKRAVSDFDQRISHILKHRNKLIRGRPAWKDLSSHIFSFNIQNEGQGHLNGNVAPHPSWWCDRATRMRRIMGRSRVLVSTGGGNEFPNSDVAENWACKALDIVNMHSYSGVEEFRTKGAIALKHALEADKLMLFEEFGATGAKKPQEIADHIAVFNDLRVPWMPWQISKPGNGEGDFEFWTDEPTYDVVKRGSEQASGSKAAQKWNLK

SEQ ID NO: 3644 - protein, 316 aa, Unknown
  Kingdom: Fungi, Phylum: Ascomycota
MKDSDTSLSLPTTTAPTDYTSDPACPPSLAFRSLVPDILPWDSSTSSDHQDEKLHHQLHHKINHVQDQKQEQQEEPARGAKRLCNGLFKSFRACKRGGDSSSVSSASSMSSEASRPNRSVEEFHQRSLNHFPSPELLFPQPALEFDFRIAVKLRPEPSRIDPRPDPRRAASQTSASHNTDAPTGAAPQQQREITAVSSGSWSGSFGHGKVLAGGYDLGQARGFRPIRIVEGVFVMQTTDDTPAILEMRTRGSLSGPCDVLDALLSPLHTPKQIDPRRYGFRMFSTIKTTDKRYAEIVNCGLWVAGGVWRGDELIIE

SEQ ID NO: 3645 - protein, 671 aa, Unknown
  Kingdom: Fungi, Phylum: Ascomycota
  misc_feature (56)..(56): Xaa can be any naturally occurring amino acid
MGNQSFQVSSNCLQIESRRKQGSHTCFHQRIVRSNDERWQAICSIKLGKALKFMTXSPAPGDVSLIPHPDQRVGYLGATSFSAVFEETQESLAEFRGTHGSMGRAVHASCDTNIMRIAPDKEAEEIGVRVLKSIPTKASCTYLLKIFSNPNDGWVRLAAHRSVDSLWDKFGHFLEGERHEEGLREMSRILSQNSAMPQDEGKPHDGVSGGETWLAGFTGDNMRWETLGVLFTYWSFGTISLTENDATIECKKCFRSDRRRLWRQYKASASHCIELTKESPSSPLCAYLMYKHTILETARTGDASASTWRLMGETAAMATFLGLHVVPRSGPGLYSVGAEVRRRTFATMFIIDKVFGTFTGRPPLLGRRFVSSELPLDVSDETLLDEPPEQWFAHVDENGWNTEGKIYSTTLSRARATILLIRDEILELALDSPHSSEAETSYENLVRLRNKAISAVAGFPSQIVFSPNDNRDPFMEAPVLYTKLLIRLEHLGNLFFIERLMIKHHPEHSTDLLDISFEMVSLTLVFWTHKDRLAGLQGDFEWIVMSCAAPAGGILCTELLKPTLTQNTSNSNKGGGKLSATRSSVIQQLSLLVGFLDWVGPTAPNGDLCSSTKNVIKHVLDVALNPKADATDLLGGAGEWDVDFSVDLNDFFNFELLDTFDWLRPEEKQGA

SEQ ID NO: 3646 - protein, 644 aa, Unknown
  Kingdom: Fungi, Phylum: Ascomycota
MSFTMNSLKVPDSGLRLQASGGDGLPIPPQAFFLTLEDNAIESMIMAVQSGQELNLKLGNEPALKYGSNTHIIPPPSDSLPYDLYLTRPFESTKSAERLPCTGSLFRKPKGSSSPVKSRVVKEAEKKGSDRSKGSSSSGLESDYETLRDGLAAEEAARGRIHIVDKALAGKRGTLKNRGLSPNPSSLPPSPAIRAVGSPSGLVPSASQLAMEKSKYYRIPLVHELAVDDRSLDFLREKWDGNESEMLPALNKIADQQPDGKTWTMRRNYYKELDVYNYAYDSTDDREKAIKNAIKVFDKMRLSSREPEWERLNAPEDRGKGKCLSSLQAKIATKEPPQPAAPKIKVQKAEDSSSKDEGSTTDSGKTARGGESMARSSSNPLQSKPKKPTASDAQAKRLLNSSKPKPATASATTLKPSPTKAKGGKAGDGRILSQEIIEDSDVSDDEKPAPKPKPAPAKPRAKDPEPKSRPAAREPVKPAPAKRQREDDDSSSSSGTPLAKRIKGRTAALPPKPKSSQTLQRPAAPAAPPAPRAKDTSPTKSSPLASSPPTNVSDMDDATPPPQPIKKRHVEMEKAHALKQRKKATTITEEVITLASRFKVQYARYLKLHHEIAASANPSQEDIEGLTRMRNRLATMKSKIHDAV

SEQ ID NO: 3647 - protein, 397 aa, Unknown
  Kingdom: Fungi, Phylum: Ascomycota
MSKHTQQAVIDGASTDCLFQIHTYPSGGSTAQAAQARKRKRIKGPVAQTQNTFLHQEASCPLEGKFKNGQDLDMHYTISPAQQWADAQRYKSFRLNDTSYTSGEFVYVANPDTVENQRNLGVRVPTNEWVANILEIRAVNEQNVFARVAWMYWPQEVPAQTLYRGKFVQGRQPYHGKHELIASNHMDIIHAMSVTGHAKVEHWVESEQDSTLDALYWRQGFDIRTMELSTVSLMCRCQTPPNPDNLLVGCTNTQCGQWLHKECLIDDILTRTWERKSLDTTTAVVKEEESKNADIKMEHSATPEKFCDDVEERSSARSTPRRGASSNPVPAGSLGRAGLARARGEKAKLHIGKYEATLRADDGPPRFELKDLREGVPDAERSWTESVRCLLCDHILE

SEQ ID NO: 3648 - protein, 256 aa, Unknown
  Kingdom: Fungi, Phylum: Ascomycota
MDASVTAAPAANGENGAGESSHEWKLKFCTVCASNQNRSMEGHLRLSQAKYPVISFGTGSLVRLPGPTITQPNVYQFNKTSYDTMYKELEAKDARLYRANGVLNMIGRNRDVKWGPERWQDWQIGVPRLEHATDKGSEGVEAGLVDVVITCEERCWDAVIDDLMNRGSPLNRPVHVINVDIKDNHEEAAVGGRGIVDLANSLNQAAVEEREAVGAAAFDAGGAASRASFDERVPEILGAWQERWPKLPATWTLAWF

SEQ ID NO: 3649 - protein, 344 aa, Unknown
  Kingdom: Fungi, Phylum: Ascomycota
MDIVLEITDTFIGDYMWAYFLPGRPAPTDYADTMYANSTAQTFSAWTYKPSTHLFSLEPSQAAYMSSFPRDDIVRQLTSLYFITWWFGLLLYFVFSSLSYQFIFDKRTLNHPKYIKNQVWLEIKQANKSMPIMSILYAPIFLAEVRGYSKLYDTTEEGPGFWWDILQFPTFIVFSDFCIYWIHRYLHHPRIYKHLHKAHHKWIMPTPFASYAFHPIDGAFQGLPYHIFPFLFPMKKWVSVLFFVFVNFWTILIHDGEYLSNNPVVNGAACHSLHHSRFEVNYGQFFTAFDRMGGTYRMPEEWMFAKEKMDAKKWQSEAKAVENLIKEVEGSDDRVYDDDTKKTK

SEQ ID NO: 3650 - protein, 1157 aa, Unknown
  Kingdom: Fungi, Phylum: Ascomycota
MASSTRSILAAARPVTFAGANIAAKSFSTASRVSAIQTAARPSIAPKFNASARMAFRRAYADQAPKRKPGAIRNTFKWLWRISYLSVGGLLAYTTWVIYEDRHPPAQFEADPEKKTLVILGTGWGSVALLKKLDTENYNVIVVSPRNYFLFTPLLPSCTTGTIEHRSIMEPVRAILRHKKAAVKFYEAEATSIDPERKVIKVFDASEIKGATTETEVPYDMLVIGVGAENATFGIPGVREHSCFLKEIGDAQRIRKKIMDCVETAAFKDQSKEEVERLMHMVVVGGGPTGVEFAGELQDFFEEDIRKLVPEISPQFKVTLIEALPNVLPSFSKQLIDYTEDTLREEKIDIMTKTMVKNVTESTVEAEISRPDGTKERVKIPYGLLVWATGNAVRPIVKDLMSKIPAQKDSRRGLAVNEYLVVQGTRDIWAIGDCAVAGYAPTAQVASQEGNFLARLFNNMAKTESTEARIHELSSGLNIQQGNTADAASEIEALEKQLRRVKDVKPFRYSHQGSLAYIGSEKAVADVSWWNGNFASGGSLTYLFWRSAYLSMCFSTRNRVLVIVDWAKSKIFGRDTNFVPRFIFQYHTILKRSSDPGFPTGTPNNNTLNMSGYGGGGYGGGGRGGGGGYGRDRGDRGDRNGYSGGGGGYGGGRGGGYSGGGGGGGYGGGGGGYGGGGDRMSALGAGLQKQEWDLSTMPKFEKSFYKEDTDVANRSAAEVDEFRKKHQMTIHGRDIPKPVETFDEAGFPRYVMDEVKAQGFPAPTAIQSQGWPMALSGRDVVGIAETGSGKTLTYCLPAIVHINAQPLLAPGDGPIVLVLAPTRELAVQIQQEITKFGRSSRIRNTCVYGGVPKGPQIRDLSRGVEVCIATPGRLIDMLEAGKTNLRRVTYLVLDEADRMLDMGFEPQIRKIIGQIRPDRQTLMWSATWPKEVRAMASDFLQDFIQVNIGSLDLSANHRITQIVEVVSEMEKRDKMIKHMEKVMEDKENKILIFTGTKRVADEITRFLRQDGWPALSIHGDKQQNERDWVLDQFKTGKSPIMVATDVASRGIDVRNITHVLNYDYPNNSEDYIHRIGRTGRAGQKGTAITFFTTDNQKQARDLVNVLQEAKQQIDPRLAEMVRYGGGGGGRGWGGYRGRGGGRGGANANSAPMGNRRW

SEQ ID NO: 3651 - protein, 937 aa, Unknown
  Kingdom: Fungi, Phylum: Ascomycota
MNDPPQLLRPTRQLSSHSPTRHRHTASVSDDFLLQLAPHSAVDALTSATGSLRACLDGASASERDFLMRTAVASKMIWSWVQELSEWSWPNEGGPAGFEAPNRKRSKLAVHVAGPEEEKDGDFMGSLRADDVAQYEARIEAIHQDMLELEVEDIKSHVLSDHILPLSRPSTPMSGMSRSSTLMSIGSYNKMEDLSAAITAIVIQTLPNLAKLSRLLQIWSTRLRVLQQVPRLLLAIEDAEVALLSGWNAITAPAKTAQEPSASNVQATSLSKEHFAVMRAVVEKKVTSGGRIADHMLDCLEGQADTLPDEWLDRLEKVEEDYAEWVAACEMRVQETEWTQAQAVRRQDEKRVTPVAPVPEVVATSEDAQSQEVVPVDGDEQETSQEVAPAVIEPTSEPIFKDADEPVYSGAHDFQVWVEVPEKDAGEDQAVSGLDGTASDSSTPSLRPPLPIVALADADKERNSQTKVKEAALDEDSAYLELDDELDLPPLRHGSRRNSDVSQTSTVLHGASSHFEGSDMPEISASPDIVHTQIRQAEYVSTSPPSSPPLPHEGEPDKKSKPADISVIGTVPEDEEIPRTPLDDSFVDDYDDSFSVSEAAIGSPSKRRESSGDIQLRQQISQIIESIPAKIKLTNEAPNINLNPPDLQLPKMRKKPSTDRFKRSGSAMSAMSSRSGTPAFTLSPAKNARPTRAQRGQQEIKVYHLSRSTGEAPIKLFIRCVGENGERVMVRVGGGWADLSEYLKDYASHHKRRSAAADGPKVEVRDVPRVPSGRMSAIGSSPPSRPGSALDSPLTPLNVRKPRRSSGAFGNEAPRLVPRTPAAATGADDSLSAIPQSEDSMRSRSSSRLSWVEDESSFLGLAGPSGKRVEMSEENKAWVESVKEKVRLASGERRVPPLGAASTAPDEMSSNKGRFGELGKVGGTKRLFRKAEDVRKK

SEQ ID NO: 3652 - protein, 456 aa, Unknown
  Kingdom: Fungi, Phylum: Ascomycota
MTSPSPQVPLIFHGAIVHSQSESQLEILENATLAVDESGRIVALKKSVDDDSPIPDWPDAQVHHLAPGDFLIPGFVDTHNHAPQWPMRGLGQGLHILEWLDQVTFPIEARFADPTYARKTYQHTVADFLRQGITTASYYSSRHAEATRVLAQTCLEKGQRAFIGKCNMDRNAPEYICESSAEESLRETKECISFIRELPGCGESDNALVKPVLTPRFAICCTPKLLTGLGDIMAQDKDLAMQTHFNEAQQEIDATRELFPAFRSEADLYENFGLLGPRSILAHCTIMDDYDKERLKALDCGIAHCPIANMTVGGGFMVAPIRDFMRRGIKVGLGTDSGGGWASQMLSVMRQAMIASNAREVLSEGQDKGLLLEEVFYLATLGGARVLCLDGKIGNFQVGKEFDGSWVTTTQGLHSAMTPVEEGDSLRTMFEKFIMTGDDRNIASVYVRGRRVSGEM

SEQ ID NO: 3653 - protein, 479 aa, Unknown
  Kingdom: Fungi, Phylum: Ascomycota
MPSPTDDETSFPRLDRSSTFNAFGRSHLSPDDAFTSPPRRLYGAADGSVERMDGERSRSRRRKRAWKKLMWVKQSFPDNYTDQATFLESLQRNPRLKPYDFWPLVSDSTVILQHVCSVIIFLVCFVGISKDHVSPVSVVSWSSTASFLGWLLWERWVTEEDEAAELLGPGTSNVPATVMGRTGSIRRRGRAGSLYRPLPLKDAASMLNTGPSRSLSNVASAVNSAASSTSNVDATQGPSNSSSNLSLGSNGAGKAHTPRASQETLPQIPPPMLGEENRTHQRLGTLKSAILIWSTLLGMSPILKSLTRSTSSDSIWAMSCWLLAINIFFYDYSGGVGAKFPASLSTNAALMASTVLASRLPSTKQVFSITLFSIEVFGLFPVFRRYVRHRSWRMHVASAIVLVLSAGFGVGMMLGEGETGEWTWKSGIVGMVVGMLIAALATGGCSWWLIGLQKYKNEIRGPWDPARPIIMSRTRWDEK

SEQ ID NO: 3654 - protein, 1046 aa, Unknown
  Kingdom: Fungi, Phylum: Ascomycota
MSAPSPPRSPSRRPLPQPPPQSLRSSVASFASSSAPPPPPPRRGSRALRPRHGNLDEGHRADTSKLQIRVVPYSPPRLSSDGGSLSSSSRPVSYADSDAAIAASVAASASPSPSPTVRRASGRHGDEVGPSSPDVSDLNIVVHAQSPHPQLVLDQSQSNSGLSSPSEPSNPFLSAPATARRLHPRLPGTGGMSTGPDTGMTPGNDPGVPVNASTADVISPISAPDRPSSATSSIGSRSSNRSRRNRVINLHANNKTFSLAPLSGSLSSRTDSFATGPPSLATPSSSYGRVSSASALYNDDRPISPLTSVGEQPGSPASTLTSIPDITTASPWNYRLVGGLRKVKGAPVDEPEPESEPGPSRIASNFTSNYSSQESLPALPPLAITKSSSDRLASASLVPKASFSSSESSQSGSIVSERTNYKVYGQSSPAHASSHRPVDLDTLPPCSSHSAENYHIIAQSSPPAAFRPRTADDLETLPPSSSHSNVNLRVIGQSSPVVAVRYRTADRNTLPPSSSHSNANYQVLGESSSSNNSLYELQRPQTGDSDANYVVHHPGASTSSLVTTRSRLRPEYSQESLIVPPLRPGRQTSIESLRLAAKRSSDSLRSGSFTSLSSIITQEAARALFAGPSAIYIPASIRKENNSRGKPARLGSHSGSSMIQSHPHQWSSQLSTVPSESEPSSRSLSPISEAARRSSFFSQRSTRMRSISSSLAGPFENLSRSGSHSIPESIDRPQAAHMRHSSREESLSPRLIRDHDEDGDGLADLEDLRHKHSRTRLSSILSHQTSDRNLRSSGSSRSNSLTSSLPAWARVYYGSGERRFVVTHPSTESMYSLYNETPRSGSRSGSLLRHSPSAERFMMPIRNGRRRPREQQHQSVDEAIHRDPTQEPEDEIQEEEGHPVLQVARRIRKQTSSIWSPHLAYDRRATRYSMWEPPSTTWSEEAGIISRRNVQVILFIIGFVFPIAWMIAAFLPLPSMPRPEMAEQLASTSNVDLQQQQQPQYMQAIDQIRYNSARWWRNLNRIMSVVGLLIIGAIIALAILGVKRRW

SEQ ID NO: 3655 - protein, 437 aa, Unknown
  Kingdom: Fungi, Phylum: Ascomycota
MRLALAQEDLSSTLDLYPPCAQLCVVEAFTAELCPPFDNLCICHDQAFRLNVTACVQAECSVIEALSTQNVSLTSCGAPVRDRAHNLIIHSFTMFAFAMLLAFIRLGYKTTMKLECVLLLQEAIPNGLGRDIWTLTADQITMFLKHWYIIAIIYFLQTTLVKLAFIAFYMRIFTTRTTRKVLWGTFVLVALWGLTFVLLGTLVCNPISYLWTQWDGLHDGKCLSDAAYVWANAGSNIALDIWVLAIPLWELRKLQLHWKKKVGVAMMFSLGALVTVMSILRLKSLALYQKRDNVTWEFAEVYLWSSIEIGVGIICACLPTLRLLLVKIWPVLAGSTIRDSNQWYNQSGKGSQASRSTAQSLGGKPLPPTPTFPSRAHSRANGSISRRVTINGRDVGVRPGRRADSSPDEYFVMQHHDRSEISLILMKTEREPERQHV

SEQ ID NO: 3656 - protein, 1736 aa, Unknown
  Kingdom: Fungi, Phylum: Ascomycota
MSFRGDDQRRYGHVPPVQYPIPGTQASNIGRRPSFNDGDDAAYYSQPQDRAPAFGATQPNSGADELFLTSPTNPNPSAGRGGYASPTSALSGYQHQYNDPSPAPPAPAHAAYNPQNFQSGAQDGFQRSQSTQLPYHPHPSSRYSAVSSNPYNASSPTSYTPAAYNPAAYASAPQRQPTYHGYSSPDQGYGAQRPPSSYGQSPVSTYPPSISQMPQHSPSLSQGYQAPQQQSPGYSANNGGYDPSQYTTGGQYAQQGLNGTTTAQYPMSSQAPYPATSQMPVGPNYATQDRNSFYSRSSRSNSQTSPLASPGIQPQSSPGLQRHPTRAPLPSRPMDDLPEDSRWHSGRPTYDDDDYAYDNLTQESIMQDIEAELDRVSPGPSPRPANGRRREPEQLHRLDSTASSQYMSNTSSLGHSSSHSSSTRPLASQPVYEEDDDDDPEGTAGVLAMQQAELDDRRFSSNAFGFADMPAVPAVPAQLPPQPEEQTQSSDSDFGGMDLGMLSGGYPGNLTYGNEYGTSPGRNPSVDLNRPLPARPGYTMSNDTYERAPALHNAEIDYGGTGGLQPPTAHRLSFDEGEERVSLHSRQSGTESPTKEDYQELFYHPGISNRPLPRLPPAPESDSSSMLSINPGGRGYYQNSTSMGPSNVAANMSADDSRLQPAEYDPYNRSASPQYPERSISMNSHSNTPLVQAPARSRTDAAEERKKFHRQQQMLSQPGSAHPDQDTSTPASVGAFDGITLPTGRKKKFVPSKLSSGDFRRCSEPWALSGIEAWVREMAEGEQDLREKKVEEALINLFVHKVATMNVADAEALSNRVVNLMLESGTLEPDEEWVKFGSGHISGVLWQLTGSGCYAPKLHNEEISGRCYSYHCTRTLKKVDLEDPDLVKSTDDWHVYYHLKKEDWESKPKKEVDRQNILHEIVTGEDNYIKQLDIFRTLYRDDLRTRNPPVLHPDRRDKFLTAVFGKLDTVLRINKENLLSQLKYRQQEQGPWITGFSDLFREWIRKAKSDYVEYATGYPRAVYMVRKEQDRNLLFKKFLEDKLKHKSSSKHDWTHFLIAPLQRLQRYVLLLESVDHKMIGDSEEKTNLQKAIQEIKAVAMDCDAKVDETNKRVEMMELDRMLVLRPGFQSVLNLDHLGRELIIQGELQRMGSRSVRWIDTHALLFDHYLILAKVVKDTRGEKKYDISKEPIPMPLLFLESMNEEPVMKQRGVVAPLGRNVAAQVPNAGLSRVTTNGTVRPGLEHSATNNSLNSMNSLAQTNSNSDEKILFPFKVKHLGHEVYTLYASSARDRMDWCTRIVETKTRHAKALFSQNAEPFRLRVLADAAFHYEPTSMHARAVGVPVKGTPLDRAIEDLENVLGSGQGIAPVCRAQVNCASGFTAFGKAIIAIGTDYGVFISDPSNPRGWTRTVQATRVTQIAVLEEFNVCLIITDKSLVSYPLDVVAPISEFAPPVNDNPRRAPQRLAKDVTYFATARMKDRMLVFYKRKESLHTTFKVLEPILHKSSEKKSRLFGGRKGASSGTDTFRDYDEFFFPTECYSLSLFQSYIAVSTAKGIEMLTLDKKQPMSIPDLKAPSIANIASRIRDQRPLGMFRLNDNEFILTYEDCAVYVDKHGDVSRTLIMEYTGKQKKARSATMYGQYLLLFNDDYVEVRNAENGRLRQIIAGRDVRVLDLGIRGPTGGNASTHWEQTHGANGGMNTLDASKGTVKIAMSHPELQGRQIVLEMLLNDGHTETS

SEQ ID NO: 3657 - protein, 139 aa, Unknown
  Kingdom: Fungi, Phylum: Ascomycota
MMSGEAWLFLLAVLINAVNLFLQVFFTIMYSDLECDYINPIDLCNRLNTYIIPEAGVHAFLTFLFLINGYWLPLILNLPLIAWNAKKIIDNTHLLDATEIFRKLNIHKKESFFKLGFHLIMFFFYLYSMIVALIREDSS

SEQ ID NO: 3658 - protein, 421 aa, Unknown
  Kingdom: Fungi, Phylum: Ascomycota
MLRKTILWAKIISAIFGMLGAEINRRARYAKTRLSSATPSPGPDKNIVIVGASFAGWFATRVLAQNLPPNSGYRIIVIEPNSHFQFSWVLPRFCVVEGHEHKAFIPYDGFMSKVKDSVTLVQDRVVTTTPTHVILQNGEEIPYEYLVVATGAEVKEGLPSRVNHTEKAEGMLRLQEIQAGVKVAKSIVVVGGGAAGVEVATDAKDLYPEKNVTIVHSRDALMNRFGKSLQDEALEGMKRLGVEVILGERVIEEDAAAGTVTLRSGRVLECDKFINCTGQKPASGMLQELSPKAIAPDGHISVKPTLQIADDRFPNIYVCGDVADTKVPTPNARAAARQAAVASDNILAAMRGQQPTFIYEYSWPIDSFIKLTLGLHRSTTYMGDGEDSVMFRSKEGDDLMSKHAWKQFGAKPFEDGSNKSG

SEQ ID NO: 3659 - protein, 1616 aa, Unknown
  Kingdom: Fungi, Phylum: Ascomycota
MPNTATGNHQMNGQMNSMTQFPPPPPRYPGSASTPAGMVAPPPPGPPPGSAMGQQAPWHGNFGRVYDSRGGLMPPPPPSAGHQPYNPQHHAQMGHPPPPPPPNEQMSATYIPQGDTYGEVAGFPAFGPDDWAGASGATMPAPNFYHSASTPQSATDTHQSLGLDGTQARGLSNASNATTNPSSIPPEIAAQWPLDTVLMWLAKNNFSKDWQETFRGLNLYGAQFLELGTSHGGRGNLSLMHKQVYPRLIHETTSSGTGWDPAREREEGKRMRRLLRNVNSGKPSESYGMGNYHTHNRRESGTSAPPASLPSAGTDQAESPNPLQAPGPGFSAKRYSQSRSTTMPTLNNNTMSSDSGHRSTMKSFESDRRHSPNVGEGGEGGPFRGSALRTDSPEGSPALGSATFTPVLSASPNTTKFPQRAARHSMDSQSSNAAIYGSGVPADAANMLSRSLNLNEAMASARSPVDKRQSPVESGDRSAGTEPPSSAKGTGLLSFLSRKKKQKEDGSHHSPDDLESPTSDMFGKPPFGDRSATVSETNLDRTSNSSLPRGRSSSQVRSRGPRLFVLATMDYWTYRMCDITDAETAADIRQVVCMNLGVGNFDRSSVYLTELGKFDHSEPLDDQNLVAQRKAKADSSGTLKFFVAPAWNQTNADGSTSTVSGVPLALSPGYLPPGASLDAETYDQLNGRQRSSSSPPSSRSNTLMGEQVDDQALAQEASEYRAVMERKQREYLAKRKQAGKGTSPTAPEVATGYGIVGRNVDFDQPRNSPFEDKKQDHLFPQRKPPAPPADPSATLIKANSLSRKPGHNGRPSTGSMEGVPTPRHPMTWSPENGSPDTARKPRFQGAGNAAAGGIGAALVGMGRNLGAVGQSSANGPRGISPGRGTDDGPQSGKKLSPTASQDQLDSGSSDRRSKSGSPGTLTWSPGSVAFMVPDYVRGQPARLEEWSPPSSPTSAIAELPPAIVPHTTETSPGSMQQRSTFPLDNRRRSGQESENGEVQFKAPGSGSVARRPAPTKTNDSDDDSDDGLFAIPLANRNKGKAPDKPGHSQRPSLTVKTQRSKKNLSVSFNSPQSSVLEGADETSGMRTGGSARRTPMTPASDSWESEQSESKLNRRKSFIEKDVWANRPPTDALLNNLDDFFPNLDLDQPVLDEGADGDSGPSPIPEGDENSEGSAPHSATVPELRNTASAIPPSRQPSLYTNDGDTLGSDESTLKALERPSSYQSVAQRSMRRSGGLGRMKSIREVARGAHEANKRYTNTSQDMGKPSASASGNTNTNILRRKSTKMFNANIVQIRPDQRGSMVMPQIPQDTLPKRQTTFRWFKGQLIGKGTYGRVYLGMNATTGEFLAVKEVEVNPKAASGDKAKMRELVAALDQEIDTMQHLDHINIVQYLGCERKETSISIFLEYISGGSIGSCLRKHGKFEEPVVSSLTRQTLSGLAYLHREGILHRDLKADNILLDVDGTCKISDFGISKKTDNIYGNDKTNSMQGSVFWMAPEVIRSQGEGYSAKVDIWSLGCVVLEMFAGRRPWSKEEAVGAIYKIANGETPPIPEDIQETIGPLAVAFMMDCFQVNPFDRPTADVLLSQHPFCELDINYNFHDTDLFHKIKGTFNKNE

SEQ ID NO: 3660 - protein, 136 aa, Unknown
  Kingdom: Fungi, Phylum: Ascomycota
MAAFIKAANAKIRSNPWSDYLCSTHFWGPVSNFGIPIAAVMDSFKSPDLISGPMTGALCIYAVTFARYSLAVRPPNYLLFACHVINGGAQFTQMFRFVKHNHMGGREALALEAEKAKDAVQGKAAEAVEAVKKSTS

SEQ ID NO: 3661 - protein, 681 aa, Unknown
  Kingdom: Fungi, Phylum: Ascomycota
  misc_feature (92)..(92): Xaa can be any naturally occurring amino acid
MISAVAMETDKFDCAAALQYWSEVQCSTLLREHYNKIVSVDQVGNLMTAACMFQLRDPYPYLGVAVRNLPQSAFGVIWKHKALKHIPDVIAXPGAKRFSQAKPVVRAKALGARLDTSNASASIIMAESDKSGQSDPGSILELDPRGDLILAIQQDDGTLHKKVLCCVRVLELSSSVFATMFLSKFKEGTKLQEQTRPIIELKEEFPEAMVKMLSFLHFHLLKSPSEPPDLAALAVQADKYNCSHSLGAWAERETWRIMERNPVVPGHNMGGLLTAATLLKFQQPYDVLEFAVKNIPWCFLPGGENPEWKYVPDVVRYSLEIEQRSMLMNLHMEIASVEKALRLEDQNDVHPCNSRALTLGVPSPSCTPQSRMTAYFAAMEKHDLWPSISEYDSPTDAWLKMECNLIFRDPQRGLRCTMATTGANGSKPVKPVNFNGKKEVKILMLHGYTQSGALFRTKTRAMEKLLVKTLTPFSLHPTLIYPTGPNQLRPSDIPGYVPSADSNEDDMPDMWAWWRKDEASGTYRYFDEGMATVADAIREAGGIDAVCGFSQGGAMTGLVVGALEPGRKVPEGKSGDWARGLRDANGGKGVQFGVSYSGFLALPEELRWCFEPKIAVPTLHYIGSLDTVVEESRSQALADRCEDPKIVVHPGGHHVPVSKEWVMAFAAFIKDNASNEPRAGL

SEQ ID NO: 3662 - protein, 525 aa, Unknown
  Kingdom: Fungi, Phylum: Ascomycota
MSKQEQVTPDGSNAAHNKHEDSKDNIVQEEDIQQSQPVGKQLTLMETYRSYEPSYSAEMERKLVRKIDIRLLPLIVIIYLFNYLDRNSIVQARLYGLQEDTDVHGAVYQTAISIFSAGYIAMQIPSTLIMTKMRPHIFLPGCIIIWALVSGCTSATSSPAGLLVVRFFLGIVEAPFFPSAIFYLSCWYTKKELGKRMALLICGILLSNCFAGLISAGILSGMQSVGHLASWRWLFILEGLATILIGIVAFFCLPDYPGTTKWLSEVERVIAQGRLAADAGAEEAIGEEQVPFKTSVFLAFKDYRVWLFACMQMATTATISFSHFLPTLISLLGFSDRTVTLLLTAPPYAFAFVWAISLAWSADIWQKRSVFALICAVVAIGGMIPNIALSDQAWARYALNFPVASGTFGIYATTYAWLSSTIIQPRVKRAAAIGIANTCANLASLYANYFWLDQYGPYFKVSWGCLLAFQMLGVVCIFALRWSLRRANAKFDRLAAEVDINDEAALSRLDLDEQRAVLNGFRFII

SEQ ID NO: 3663 - protein, 188 aa, Unknown
  Kingdom: Fungi, Phylum: Ascomycota
MKFSTVLALFPLLALAQNNDGNSAGDVVDDVVDGVTSDLPSGVEDIVDNISTAATGVIGDASTAATGAEGAASTALEDASTALSEGVDQASSAIESGASAVSSVVGAITSEANARQSSIESELENASGTRSEALASELAGLTSSVDAALSSAGAAATGDGDDGDAGAMPTAAVAMGALFGGAAVFANM

SEQ ID NO: 3664 - protein, 821 aa, Unknown
  Kingdom: Fungi, Phylum: Ascomycota
MSGHADDPKKKVNLADVSGAEVKNEDDTATAILKKKKKPNQLMVTDAVNDDNSIIALSEATMDSLQLFRGDTVLVRGKKRKDTVLIVLADEELDDGSARINRVVRHNLRVKHGDMITIHPCPDIKYAKRIAVLPIADTVEGITGSLFDVFLAPYFREAYRPVRQGDLFTVRGGMRQVEFKVVEVDPPEYGIVAQDTVIHCEGEPLQRDEEENNLNEVGYDDIGGCRKQMAQIREMVELPLRHPQLFKSIGVKPPRGVLLYGPPGTGKTLMARAVANETGAFFFLINGPEIMSKMAGESESNLRKAFEEAEKNSPAIIFIDEIDSIAPKRDKTNGEVERRVVSQLLTLMDGMKARSNVVVMAATNRPNSIDPALRRFGRFDREVDIGVPDPTGRLEILQIHTKNMKLGDDVDLEQIAAETHGYVGSDVAALCSEAAMQQIREKMDLIDLDEDTIDAEVLDSLGVTMENFRFALGVSNPSALREVAVVEVPNVRWEDIGGLEEVKQDLREQVQYPVDHPEKFLKFGMSPSRGVLFYGPPGTGKTMLAKAVANECAANFISVKGPELLSMWFGESESNIRDIFDKARAAAPCIVFLDELDSIAKARGGSMGDAGGASDRVVNQLLTEMDGMTSKKNVFVIGATNRPEQLDPALCRPGRLDSLIYVPLPDEPGRLSILKAQLRKTPVSSDIDIGFIAAQTHGFSGADLGFITQRAVKIAIKEAIAADIERAKAREAAGEEVMDMDEDEDAEDPVPELTKRHFEEAMSMARKSVSDVEIRRYEAFSQQMKNAGPGAFFKFPDGAEGGSAEAGNSFGDAGNDDDLYD

SEQ ID NO: 3665 - protein, 491 aa, Unknown
  Kingdom: Fungi, Phylum: Ascomycota
MRVTTIISSLFALTVSAAPAGTDNGISTLEERNFIPQCTGGQYFNWLQWKCECPWGQSWQASDNCCKPNQHSCNPGWEWFETENCCKPHPQHCNDGWYWDFGDSCCKQHVCPSGQYWDDGSNCCKTHTCPAGEYWDTQKNCCEQHTCPAGEYWNPQTNCCEQHTCPTGYYWDTSSNCCKQHTCPSGEYWDTTADCCKKHTCPAGEYWDDAANCCKQHTCPAGEYWDDTANCCKQHTCPAGEYWDDTANCCKQHTCPSGEYWDTTANCCKKHTCPAGEYWDDSANCCKQHTCPAGEYWDDTANCCKKHTCPAGEYWDDTANCCKKHTCPAGEYWDDGENCCKKHTCPVGEYWDDTANCCKKHTCPAGEYWDDGENCCKKHTCPAGEYWDDTANCCKKHTCPAGEYWDTTANCCKKHTCPVGEYWDYKENCCKKHTCPAGESWSDADHCCKPVKHTCPAGEYWDTTENCCKKHTCPSAPLSWRPALELAEELL

SEQ ID NO: 3666 - protein, 182 aa, Unknown
  Kingdom: Fungi, Phylum: Ascomycota
MALNGKLSHPQRLITTHNEQGKAILSDLSSPAPFYALASGDALFAQAYVTEGFPTTLTNDADLGVYKHYLSQPPGITVSNGTVLRYVDMPPGLTSPMHRTVSLDYGVVLEGEVELVLDSGETRVMKRGDVCVQRATTHAWRNTSQTEWARMLYILQPVQSFSVAGEEIKEDYGGMKNVKASE

SEQ ID NO: 3667 - protein, 682 aa, Unknown
  Kingdom: Fungi, Phylum: Ascomycota
MATTRLNQLAEHLTFKEAPKHPLDPLDAREIAAAVAVVRSEKGSLYFNTITLLEPRKKEMLKWLADPSTRRPSRVADVVATTKAGQVHDIWVDLSTRKVVKAEIVDDVQPTLIVEEMLSVEDALRKDPRVIEQCGIIGIAPENMDKVFCDPWTITHDPKYGTKIRAIQGLLYYRPNYDDSQYTFPLDFFPIFDINKQEVIDLEIPPVRRPISLAEPNNYHAPDIEREGGYRTDIKPINITQPEGVSFTLEGRTIRWQNWSIHIGFNYREGIVLNNITFYDKFEGKERPLFYRLSIAEMVVPYGSPEHPHHRKHAFDLGEYGAGNLTNSLSLGCDCKGAIHYMDAELPTQAGGVRTIKNAICIHEEDAGILFKHTEFRDESTIVTRGRKLIISQIFTAANYEYCIYWTFLQDGTVSLEIKLTGILNTTAMNPGEDLEGYGSEVYTGVNAHNHQHLFCLRVDPNIDGQENTIFQSDAVRSPHPVGHEKNKWGNAFTAAKTKFRNVTEAQSDYDGNTSRTWDISNENKLNKHSKKPVSYKLVSRECAPLMPKEGSLVWNRAGFARHAVHVTKYKDDQLHPAGRHVVQTSGQPSAGLPAWIAENPNESVENTDVVLWHSFGLTHFATPEDYPIMPAEPITLMLRPRNFFERNPCMDVPPSYNITPTQVRDGKKGCACAASKESVRV

SEQ ID NO: 3668 - protein, 647 aa, Unknown
  Kingdom: Fungi, Phylum: Ascomycota
MTSHQLLPSQLASAMHHHAQNQLQSPDTTPQDRLAEARKNLQVLIDCGFSRDLLHQWVDENSHSPQLNLAQSLGTMIPTAPQQQQHSPTQAQIQQQQVQVQPQQQPFAQSQPSPSSSAPHHPSPPSHTPPQIPQSVPHQQHSPQEPLGPPPPPPQCPPPPIPTMASNRSPSSTPAIDVSQAPQAIPEHSASPWSPTHGSTLVSNIAEADSNMFLPPAAPSAHTAMSWHSAGTGFKSHLSSPTTSPTGAPLINGAQAAATSKTNIYWCTSCETSFKRKYDWKRHEDEFHERWRKYPCPEPGCNRSFWGSNSFNQHHKQCHGCTTCPHAEKVVKFLRKRKYWACGFCSALHPARERHVEHVARHFESGLTKGDWMHSRVVYGLLHQPLIHEAWDALVDSKQADYMGRRPQFSWHPSKTGRAQGFLEKENNGQLQDLLEFFSGNEGEAQFIVSSAYSLADIVLTTGGPVPSPQFNDAASLGSQMFSQDPRMSYASLSSQGSTPTPTPTPQAQQSHQQAMMHSGDASSHHPYASGFGAPMFVNAQQPFAPPPPPRAGSDVSSHSPLTASHSPITVSPSPGIKRELPPPPQESQENLMDFEFSPAPVNFDDWESFSGAMLDDSPQPMQGSSNQIPQASWGMMPMFNDPRVSS

SEQ ID NO: 3669 - protein, 221 aa, Unknown
  Kingdom: Fungi, Phylum: Ascomycota
MAEYTLYGFWRSSCTARVRIAMNVKGIAFNTVSVDLLKGEHLSALHKQHNPSASVPLLVHSTPEGPVSIGQSMAAMEYLVEAHPGVGGALLPPASDVRGRAIVRVLANIIACDNQPVTNVRIMKRVSALGGDAQEWNRDLMYDSLVAYEATSAGSAGKYSYGDTVTIADACLVPAVWNARRFNVDMSKFPTITRVMASLEKLDAVTKAHPSAQPDTPPEFR

SEQ ID NO: 3670 - protein, 553 aa, Unknown
  Kingdom: Fungi, Phylum: Ascomycota
MRARLVVRRLRVPQPRISNCPSSLRAFTHHAQLTNTSSRPNLPFLTTPTQRRIRNFTSERRSWLRREIKNGIKYTVILWVAAGAVLLIVFAIGEETAEREYPTPHEWGFYTRKMLRDCHSRASPKNRKWGDSVQLGAEVLLRLEDPAKDGQGVVKLEGFELENLKLVPCDISAKSEEWRRGYYDALMATAKAAEHTEGWLLDTTRGLNIPPEYVIGPSNPRPKPLPKGAPTAPREEDCVIAFPSAAEYYLKISRTKGLTPKQQLDARLEEAAYWEYMGRPDTAQECLAHCLILANGDEKASTIEEWIRLDQMAPIRRAGGEAPSSNMLDTMTALAGLWARNGNLPNALTAYISVLHARRSLSSSPSATTQDKSTRRIPTYQKLVNFVSPPPYPSPPPSGFTSPWRSPEERCQEAALQLHIGEILFATSSREEGLAWTRDGVDEAEEQLRAIGPSNPHKEQSERATCRECLTMGLQNWTTMVSRMAAQERKKGEDEASGAGSSPWAFWRGGSSEAQGRWQAEEKVVAERVRRTRELVEDVAPPNENWLATLFKA

SEQ ID NO: 3671 - protein, 853 aa, Unknown
  Kingdom: Fungi, Phylum: Ascomycota
MAEEAPLTTAPKRSPGDRFPADHEGPGRSQPRDHFFRHSAALALELVKKHQAAPKAGPPKHETPAQAKRRRSLEKLWELWKRQGTPLFAEDANVHYEQLWIDLCMRKDYPQGVIKAFLEFYVHSSVRRRPCLGLREGMRAQRTVTSATTLQDVLSDLVYVADERVLQPKKKEDPRQASFWRISYSSREREYCSGPAYDIAKLLNGVQKLPDLAIDLGLNLGQSFEKKEATADDIMLVLLTLWQRGRDIPCRPDDRFGFHCAVMLGGFGGWRTGETIQLLYKDTVIEWIQDLDTRRIWPVATMTIHHVKTGTKVRRDQRERLKFSLTRVPSPAICLLSFIVSKAIVDEAFVDGFAEPEQVLDHLSLEPRVPSTPLSWKPEVMEKAIFRISYDKLLSLWKRTMLVAGVRDPPRPYSMRVGTGQRLDGPLEPAVRNFTLANSTDVYEKSYQPVQLAHNLQEISFPGAVQDGTRELMSLVRQATLRRDDRAPIYPTREQWAEIERSELLTKLREEYQSVSQTTGSQSKEAKRLCAKIKHMRDCFVEQTVQKARKAYFEKVDRLRALRQPTDHLHNPEATNPRFTHNKHSSLAAEGLGKLLTVENDSTFCRELKAFLQQPPSNGSTAVDREESEPPKGFQCLLCSDQLASKWSLSRHVSTHHHDLLQSAFSCPECRRLGHGEVTIQGGPSAWSSHVSHKHGTPMTPDPPAPTEAHCPLCGTGYTSRGFTAHLKTHKEMFSSPFPCPACACAVIRGLEAWISHVKDVHHGGSVPGAILRPATGRQRRQKRKAETGPLDYKAPKKMKTVPDAAMEECTAVEEWSSYDGREAGVDFHAGEEFWVTGRDCDFDYMEASDSYT

SEQ ID NO: 3672 - protein, 1069 aa, Unknown
  Kingdom: Fungi, Phylum: Ascomycota
MSRKAVDQRIPALIRNGLQEKKRSFFVVVGDRSKDVIVHLHYIMSSMDIAQNKSVLWAYKNKLLNFTSHRKKREQKIKKEIKRGIREANSQDPFELFVSLHDIRYTYYKETDKILGNTYGMCILQDFEAITPNILARTMETVEGGGLVVLLLKGMNSLKQLYTLSMDVHSRYRTEAHDDVTARFNERFILSLGSCPSCLVIDDELNVLPISGGKNVERLPPPDLDQPKTATQLELEDIKEQNQEQQPVGSLISLAKTVDQAKALLTFTEAISEKTLRSTVALTAARGRGKSAAMGVAVAAAVAYGYSNIFITSPSPENLKTLFQFIFKGFDALGYADHADYTIIQSTNPDFNKAIVRVNIHRQHRQTIQYIRPQDAHVLGQAELLVIDEAAAIPLPLVRKLMGPYLVFMASTINGYEGTGRSLSLKLLKQLREQSTNAAAGNGDTEVADRSTGRAAKTDNFGAGRKLREITLSEPIRYAKGDAVEKWLNTLLCLDATLPRAKASANGCPDPNQCELLSVNRDSLFSFHPVPEKFLQQMVALYVASHYKNSPDDLQLMSDAPAHELFVLVPPVSENSGKLPEPLCVIQVSLEGKISRQSVMNSLSRGQRAHGDLIPWLVSQQFQDEDFASLSGARVVRIATNPEYVSMGYGTKALELLTDYYEGKFANLSEDEDAAMQDSIRRATDAELASASLLDDDVQIRDKAEMPPLFSKLMQKRPEKLDYIGVSYGMTPSLHKFWKRATFSPVYLRQTANDLTGEHTCVMLRPLENSGDRSWLGAFSRDFQRRFLQLLSYQFRSFPAITALGIDESANMGAKLDDVPTASLSKAELDRMLTPFDLKRLESYANNMLDYHVILDLMPAIANLYFTGPLKSAISLTGVQQAILLAVGLQRKDMDAVAEELSLPSSQLLAMFIKILRKVTAHFAQLVAEAVGEDLGDGGRAAIGVSRADATGVHDDEIVDEKYVPLTTTLDDELEEGGDEALRTLRQKQRELIDSLPLDQYEIDGDAPAWQEAEKQVSRATRDGKANTVVSVKTGKQKRKEGPTAADVYEEVLGDKSSRKKAKKSKKSS

SEQ ID NO: 3673 - protein, 94 aa, Unknown
  Kingdom: Fungi, Phylum: Ascomycota
MDAERFDAWQWVMWLLLCLAGLMPGQVAVGKAADSSSVRTSAAVVGAEQDVKVTAVDTSKKFADEETGRQHFSSQPEINPYFSVFIQRPRNNAF

SEQ ID NO: 3674 - protein, 99 aa, Unknown
  Kingdom: Fungi, Phylum: Ascomycota
MVLAAKDPNAPMAEPQVAGVKDVKSMEYHRQVFQNKKAEEPAEQYISPSDNIMSPCTAKINALRNKHASKAKPKSLFAQASAKKLSSGENPLGARSIQK

SEQ ID NO: 3675 - protein, 471 aa, Unknown
  Kingdom: Fungi, Phylum: Ascomycota
MSSFFWLPFYHCIIISHINWFDHPSTMSYTIAFLSLLAAAKAQQVGTDTAENHPAMTWSDCTSGTCQSVNAEVVIDANWRWVHGVGGYENCYDGNDWTSVCSSNTDCAENCALEGATYGTTYGATTSGDALTLSFVTEHEYGTNIGSRFYLMENEEAYQMFTLAGNEFAFDVDLSTVECGINSALYFVAMEPDGGMSSYPTNTAGAKYGTGYCDAQCARDLKFIGGEANFEGWEPSSSDSNAGKGGMGSCCAEIDIWESNAYAYAFTPHACTDNNYHVCQDQDCGGTYSDDRYAGKCDANGCDYNPYRMGNTDFYGAGMTLDTSRPFTVVSQFGSDAFTQYFIQDGERIDVPAPTFDGISETSDITDDLCTNQFNVFGERDRYAEVGGWSAMQDAISIPMVLVMSIWNDHNSQMLWLDSIYPPEKEGQPGAARGPCSQDSGVPDETVEDFPNAKVVWSNIKFGPIGSTYDV

SEQ ID NO: 3676 - protein, 461 aa, Unknown
  Kingdom: Fungi, Phylum: Ascomycota
MGFIRSLALLACSFQLLSLPYLASAQDAPVMVQGGLEDATADDTSMYNTGGAITVNGFNMVVPKNVLVQFPAAWVPWKDFVENKAEYIGFETLVLGNTIDGVHRVAQVVVYEFFEGLASGFIESMNYEEGTIKIQGGPTVLINDPNGVFSVGYDGAPHMTADDQSPSITSFSGFPMCIPRNSTDPLCPLKNRPFKGPGTFTAPDPMVMAPFQEGDFITFTGFRKGNEVIAFSIVAQNVQIQTLGDIVYVRMELGLLGIDNPNPNAEIAESRFIGFTSNNRASVALYAMDVDPCSGNVTDRILATMGLRGGRNEQNKFEYRSDILHSYTREYRVVAEINGVPKTRETKNGIMSGTYVQPVNVWIQGEQNIPGTPPPPHDFSEMAFLTKGVGRDDDGNIWGPLDPFPQTGVFIEEPNCPTARSMRILREKRGSMGLWYSRAKAEAEASADNKGTTPGALSIEG

SEQ ID NO: 3677 - protein, 205 aa, Unknown
  Kingdom: Fungi, Phylum: Ascomycota
MSETVFAQNFLSTLSSRPIKLSADHVEDARNFPARPPNILPRMPKPMTKTTNASSLPGQERSITLHLKSLRNPPLDLKLTSQPLATSILDIKSQVQRQTRIPVEKMKLLHNKRPVTDSKILKDLIGDDTSSKSLEFSVMVMGGAAAIPPAEEEKADAGQETSPLNTEVFWSDLKGFLMQRLKDEKQAENLSKLFKSSYQSNMATP

SEQ ID NO: 3678 - protein, 125 aa, Unknown
  Kingdom: Fungi, Phylum: Ascomycota
MSDQINVFTKDAPAALGPYSQAVKTPTAIYCSGQIPLTPDGTLIEGTIGEKTKQCCQNMEAVLKEAGSSLSKVVKCTIFISDMAHFASMNEEYEKWFSHKPARSCVAVKTLPKNVDVEIEAIALP

SEQ ID NO: 3679 - protein, 339 aa, Unknown
  Kingdom: Fungi, Phylum: Ascomycota
MTTPFKVLKFSCSDGSQVLVQATSKGNKPLDLKLVGTEGSAAYRVTLKQDRIASLRVKNCPVTESEWEAILEAVLQLRAPPDIQATAAVEPDTSIALTIRKIIQGTTHRLGSITLNYTESEEIGLFDWCVAAVDTSLEGTKALSEVETQKEALQSDVEDYKRQLDELIQAKNEDETVLLQKFRDLLNEKKLKIREQQKIIAHASFAEDVAASPEHEASPQPVRKPAASRAGKRKAAPKDSQVADMTSDAEEMNIDEPIKIEAEETDPGNTTDGTASTAGGGDSDNEELASSNAKTAAPSTSQKADKPPPPRSLPFNQRRAAAKPAPKASSETDSDDDEL

SEQ ID NO: 3680 - protein, 392 aa, Unknown
  Kingdom: Fungi, Phylum: Ascomycota
MAPSAEHVTPGTGAVQNAWIGEKGSGAFDLRSDVLTVPTQSMLAAIQTCTMKDDVFREDPTTMDLEAHIARMTGKEAGLFVVSGTMGNQLALRSALTQPPHSVLCDLRSHIWQYEAGGVSSLSGAMLVPISPKNGIHITLEEVKSHIVLSDDVHACPTRVISLENTLNGMIMPLSEIQRISAFARSHGIHMHCDGARLWEAVAAGAATLPEFCKEFDTISLCFSKGLGAPIGSMLVGTQKLLKHAMWVRKSIGGGTRQPGLLTAAARVAVDETFGPAVDGSKGILKKTHEMAKRVEEAWTRRGGKLIHPAHTNMVWLDLDAARCEATNFVAMMKAEGLGAGGSRLVTHYQVAQRGDEVMERLERVFDKVFQGEGGAGEAKEKIGQDSMYTTR

SEQ ID NO: 3681 - protein, 137 aa, Unknown
  Kingdom: Fungi, Phylum: Ascomycota
MGELIELTGPAPKPGRYVKVSLFLRKRADLTDDYFHAYWANNHVKPAFESPIFMDKVRRYNQHHVTPKERAIAKEFGAPVLEYDGIAELWLDSFEDWKEVCMTTSFVEKVASDEANFLETPIHMMFGFDHLMIDDKK

SEQ ID NO: 3682 - protein, 1117 aa, Unknown
  Kingdom: Fungi, Phylum: Ascomycota
MSSHPSLGFVGFGPVKAEVAITLQSHNNGTVRAYDSSAGHIEAGHVQRSDSVFEVAQNSRVTWIEEQDSQALSESLLGPSGLIHALPKDASLILECLTTPTYYEDLAASFTEAGRADIKLLDCSLITPSNRSTENSIWISGSPDALDSISFLSKAHNDVKIISGGLGSANKLRLTSHLLEATHTVTSAEATGLASKAGIDANEIYKIIVNAAGNSSSYEALVPDMLKGNPEAKPSIESLLQDINLVTTSSKSLSFPLPLCAATEQLCLLATAQGYGSEHVSSLIKPFQAQQKSTTTSNTSTFTAKASGDVTPPKTPLSESTIGMVGLGAMGQGMAQSLVRAGFCVQGYDVWAPSVAKFVTSGPSDKAIAAASPAEAAKGTTALILMVQNAAQAWDVLFGTGKASDELADGATVILSSTVPPSEARRVGEKLESLGRGLSLVDAPVSGGVARAAKGDLTMIISGTDSALGAVRGIILAMAGKDSNIYNVKGGVGAASSAKLINQLLAGVHIATAAESLSFASRLGLDTRQVYDIFNESSAWSWMFQNRASQMLDADWTPHSALAIFLKDLGIVLNEAKRLGSFTPMSSVAHNLYIDAAARGWTKESDAGVVRLWETAGSNVNKSASPKQSLLPIAYEDDVKPLPAKETLAALPAEYAINLIESTRARVDSGEMPVLVALDDDPTGTQTCNNIDVLAVWDVETLKEQFATNCRGFFILTNSRALPPIEAKALIVEITANVKKAAEESDKGFEIVLRGDSTLRGHLPEEPEAVEEVLGKSDGWVLAPFFRQGGRFTVNDVHYVQEGDQLIPAAQTPFAQDATFGYKNSNLQQYILEKCGSRFDASSFTSITLEDLRCGGPDKVEEKLLSGERGANRVIIVNAVADSDMNVFIAGLLAAEQKGYRFIYRTAAAFVSSRLGIQEIPPKTWADLASKDDAQGSNTGGLILAGSYVPKTTAQLRALRERRGDDLDVIELDVARLIESPEQELKMVDNAISEATRLISTGRDVLVMTSRKLIKTDDAISSLEIGSKVAAALVRLLVNIQVRPRYVIAKGGITSSDAATKGLKMRRALIVGQAAPGVPLWRCDEETSRHRSVPFVVFPGNVGSETTLAEIVEQWAL

SEQ ID NO: 3683 - protein, 1607 aa, Unknown
  Kingdom: Fungi, Phylum: Ascomycota
MAPQRRSALFAQVWTLAAKTIKIALFHQTRSTFYTAFLLPILVALYLGVGQRLNQPQSDFGIAESRPVRSFSDALDSAASGRTTVLFVNGGFEDGAVKDVIDSLSQEVMSAGKNATTMEKEDDIGYVCRSSVRGTSNCYGAVVFHSSPDQGNGGIWNYSIRADPALAREFNYEDDNNDAQIYILPFQRAIDNAIKQTNYSSSDSNNGLPRVNEYAYTELTEDEREDKQRRDYQKTFIDFLGVAFFVGLVGVAYHLPGLLATERERGMSQLIDAMILTRYDWEPQLIRMLSFVLAFTIVYIFGWIACGAVAGAIIWKETNVIVPIIAFILGGIALTSMSLLGATCFKRAQLSGAVNSIIYLLFGVLAQALPNPGTPVVIILSILFTPSCFVFFIHSVARFEAEGNAANLLKSPPTANYNVPGIFFLIMFIIQALVYPIIAGFLERVIHGVSSEHRQVFHAGAGRTAPTNTLTIEGLTQIYRPSLFRRLFSFVSRPRPATVAVDNLNLTAKRGEILALLGANGSGKSTTLDAIAGISRFSQGNISIDATGGLGYAPQQNVIWDDLSVEENIRIFNRLKSPHNRATLTQNKELAKAVGLESKYKSKAGKLSGGQKRKLQLALMLTGDSAVCCVDEVSSGIDPLSRRKIWDILLAERGSRTIILTTHFLDEADLLADHIAILSKGSLRAEGSSVELKDKLGAGYRIHILDPHKVTSPPEIEQVECKVTHSSIIYLASSSGLAANVVKVLEANGIEYRLSGPTIEDVFLQVAEEVKDEGDLRTGGEKARPARDAGKSHDLLTGRRIGFFQQVKVMFMKRLVVFKRNWIPYLIAFAIPIIAAGGTQVLIADEPPTGCSPREQSSDTDLPDDFDEIFGNLQMVAGPRDQFSSGVQDTISDMLASSEEVQASGGSSTDNLDLVVSLSGFNEYIEENRKNVTPGGIWLGDSNSEATFAYRADKYSVYTAMAIQNAMDMALSNLTIAANYGTFEAPFSSSTGDALQLAIYFGIAMSLFPAFFALYPNHERRMNVRGLQYSSGARSFPLWVAHLAFDYAIVLVTMLIAAIIFYVSSEIWYEGAYLFPVFILYGLTSLLLSYVFSLFLSSQLGTYAACTAYSMIGHAIYFISFLYILTFSSEQKTDFNILAGHWVIAAFFPVASLVRAMFVALNAYSTSCSGFDLRSYPGAMAAYGGPILYLTVQAVLLFSVLLWYDSGRGLPLASLFKRSKKRTPTSDEHRPSEATLTESDQEIQNELTRVTDLKNRDGLRVQNLIKEFGDFTAVDNVTFGVEHSEVFALLGPNGAGKSTTISLIRGDIQPSKNGGDVFVEGIPVSTQRAAARANLGVCPQFDAIDNMTVVEHLRHYARIRGISDINHQVEAVIRAVGLEAFPNTMAGHLSGGNKRKLSLGIALTGNPSVILLDEPSSGLDAAAKRVMWRTLDSLIPGRSILLTTHSMEEADALASRAGIIAQRMLAVGSVEHLRQRFGDTLHVHLVSKTAPHSTPEEMEQMRLVISEILPGAEIQSDTYHGQMRFSVPAGAVSAQPGATGSAVGQLIVLLEDNKERLGISHHSVTPTTLNEVFLNIVGKHDVEEEGYSSRPKKKKNWWQTALWLMKP

SEQ ID NO: 3684 - protein, 391 aa, Unknown
  Kingdom: Fungi, Phylum: Ascomycota
MPEFVVDGNQGSPQGPAFVPHFSVSNLHSHPPVRESRLAPDARTQQGGSLHTRDLKTPLSQHLFAIALSTSCNPTEPGKLLESDPIDDFISQPPNMAAVASNKPKQDWADDDDNEETSTDLPPPQTVSNKDGTKTIITFHYNDDGNKVKTTRRIRYTTHKETVNPRVADRKTWGKFGASVKDAQGPATDTTSVGENIIFRPSVNWRKDEKEGEVDAGAKAMKDKLKDKQVKCRICSGEHFTARCPYKDTMAPVGEAAGPAGDVAAGMPDEPGAGGAGAKKGSYVPPAMRAGAAGAGERMGGSKYGERDDLATLRVTNVSELAEEGELRDMFERFGRVTRVFLAKDRETGMAKGFAFISFADRGDAVKAADKMDGYGFKHLILRVEFAKKAT

SEQ ID NO: 3685 - protein, 393 aa, Unknown
  Kingdom: Fungi, Phylum: Ascomycota
MTSRRRSGVPATPRVISPSPTPSERENIEYNAPVTRSAARSSRMSTPQPVAEDSNEDSDAPDLRRARTRSRSPIDTRRPQRMTPREPLSRQSSKKQDSKSQGSTTTNGQTSVTNGHLAPPQPSAPSGWTWRDFSRSPSPLGLIPIHRHWRTFVHKHEVPRKVLHVSIGFFVVWLYLSGTQTSSVPPYLMAGLIPITTSDWLRHRYDTLNRTYVRLLGALMRESEYAGWNGVIWYLLGAWIVLFFFPKDVGVVSVLLLSWCDTAASTFGRLWGRYTPRLRRGKSLAGSSAAFVVGVATSVFFWGWLAPKFGPFPGDETFMFKGTLSLPASVAQSLGISAAKATIGGSLALGVMSVVSGFVASASEVVDLFGWDDNLTIPVLSGLGLWGFLKVFG

SEQ ID NO: 3686 - protein, 343 aa, Unknown
  Kingdom: Fungi, Phylum: Ascomycota
MLSALHLGCSVEKYHYLNLYFLPIFGEAHSKTTAEMENPGDFVIFGPKANCTLELCPIEMSVYGYRPNLAVNIVFVALFSLATMVHIYLGLRWKTPGFMWCLILSCTHEIGGYVCRIMLWRNPWSFGAFITQIILITQAPVFYCAAIYVTLGQSMRHYDPSLARVSPKIMACVFVTFDIISLILQGTGGGLSATSSGASEIGVDVAMAGLILQVIMLVSFSILLADYMIRYFRSKGSKNIGARDKTFFAFLALAVLSTLARCIFRADELKEGYQGELIKHEDLFIGLEGVLIVVAVFALCIAHPGFAFRTKSAIQYSGINPGISTHENMQMYKPYASGHASDS

SEQ ID NO: 3687 - protein, 402 aa, Unknown
  Kingdom: Fungi, Phylum: Ascomycota
MASNIPRPGPANLGPNAGLDEWLEEAKQCHYLPERAMKELCEKVKEILMEESNIQPVCTPVTVCGDIHGQFYDLLELFRVAGGMPGETNVQAPKTATTVITSDDIEPPSQITNPKLRKKVKPSIDGDSIGGGDGDDDDAEMDAASQSGDSGVEVTSAPAHTSSQSAETRFIFLGDFVDRGYFSLETFTLLMCLKAKYPDRIVLVRGNHESRQITQVYGFYEECQQKYGNASVWKACCHVFDFLVLAAIVDGELLCVHGGLSPEIRTIDQIRVVARAQEIPHEGAFCDLVWSDPEDVETWAVSPRGAGWLFGDKVANEFNHVNGLKLIARAHQLVNEGYKYHFAENSVVTVWSAPNYCYRCGNVASIMSVDNDLSPKFSIFSAVPDDQRHVPASRRGPSDYFL

SEQ ID NO: 3688 - protein, 425 aa, Unknown
  Kingdom: Fungi, Phylum: Ascomycota
MHSKTPFADPLWLTRGLSPYYNESHKRLQKEARDYVDTHITPNCNEWESNGVVPQEAHKRHAELGYVAVAVFPLARDHLNGQRLPGDVPAQEWDAFHDLIVIDELARCGYLGIVWALGCGNSIGSPPLVQFGNEEQQCRFLPEILTGETRFCLAVTEPDAGSDVAGITTTAERRGDKYIVNGAKKWITNGLFADYCTAAVRTGGDGVSGVSALIIPLKAPGVTCKKIDNSGVLASGSTFIEFDEVEVPVTNLLGQENKGFPIIMNNFNHERLWLACTALRMARVCLEDSYNYALVRETFGKKLIENQVIRSKFSMMARSLDSAYSWMEQLVYMSDRAKREGTDAMMGGLFANLKVLAGQTLEKVNREAQQVMGGLGYSKNGRGARVEQVSRDLRVMVVGGGSEEILADLAVNQERKAAKAYGAKL

SEQ ID NO: 3689 - protein, 137 aa, Unknown
  Kingdom: Fungi, Phylum: Ascomycota
MSSSFASHGRGGAGNMAKSSDSPKLTATDLQTPTLKTSVVTTGRGGQGNMAKNTDPAETRLRQDVDPVLRRESYGAQYAGRGGAGNVFKGEDVSNLETTDAVVDDDSSSDATGPKEKTGEKLEKVPSKGKGWFGKKA

SEQ ID NO: 3690 - protein, 561 aa, Unknown
  Kingdom: Fungi, Phylum: Ascomycota
MAVFETLDNALTGVFGSWNIYSTGLTTALVALVTYRIATLREPDVHPMLLARQSVPSTVRHEGESAIYRAQASPHSMPLNGGLNVKAPDAAKWSRGRDGDLRDIWRKAVLGGEAGAKGKLLTALGSQKVIEHKHEDVTRQINLIGQHIAEQGGIRVAVYLPNSIEFLTTLFACSFAKNLTAVLIPFDVSHDLLVSMLQRAAVDTVVTIPGFFPLDAVVSAYPALRNLIWVVEDGNNHMDWSEVPEGTGGSVNVATWQDIINEAPKDASTDLGPSSADTTPQDIVTFSLNNAGQVEQMVRFSQVNLVAGIAGQIAAVPSKDRLGPADLFLSIDSLTNIHTLVLSFVALYSNASVALNSVAGRECDLVLATRSVSPTIIVTSPQTLLKAHADSTSKLGSALSQAAHALSTRTLVQEGILSTSHFLSGFASGSKPALGNEPGKLRLVYVADRAGAGDSKLSSSILSDLRVFLGARIIYALSAPRVAGAVTQTAFFDYRVDEQKDAHFGAPVTSVEVFFKDTKDLKTTDEQAQGEICVRGPSVSGGEAQLGVKGRLNEDHTFSYA

SEQ ID NO: 3691 - protein, 749 aa, Unknown
  Kingdom: Fungi, Phylum: Ascomycota
MVIPRRPLYFNSDAHKWHSSPSADLEDVFHFHKSLPGYNQTDLIPLDSLAQELNLGKVYVKHEGDRLGLPSFKILGASWGTYRAVLRAFNLPVGADIRAIQAATASSTTALFAATDGNHGRAVARLAQMFGMPARIFVPANMDANMITSIRNEGAEVVNTGKSYDDAILEAARGSATEKGLLIQDCGFDDYQELPEWIVDGYSTCLREIDMQLGEETADLVIVPAGVGSLAQAVVTHYRRQGSATTVMAVEPDSAACLWKSLREGESVSIRTTPTIMNGLDCGTVSTTSWPILQSGIGAAVTIADQESHEAITDFDNWGVHTGPCGAASLAALRRLGAVDKDTLGLTKDSVVVLLSTEAARPYKVPKDTRLEDPAQLVEQLTNIMSISSRSGKHERPVETSIAEYVMAWLEHRDIECHWLENITGRPSVVGVVRGNEDGKSLMLHGNLDVKTSADTPPLGSGKARIHETRVYGDGAANMKGGLAANMLTLARAKAMNLRGDVILTAVAGGNGADVGIEQVLAAEWRAHGAVVTKPTGENLVGNSNGTVSLEVDVHNGPDAPDGFVDLETDPITQAAYFLVELDKCRRKKSGTPVELRDGLQRVSVLEPGANSASCTIALEWQMVAGETADGVEQAIQKVLDMVSQKKPSFRFSLRVISSHDPFSTALSHPFVSLISEVIGGVRKQTSGPAADIEWADCAALSEAGIPLIAWGPVGAASNASKGNEEWVDVESVIRIADGLMAIVKEFCA

SEQ ID NO: 3692 - protein, 324 aa, Unknown
  Kingdom: Fungi, Phylum: Ascomycota
MAPRLRAAQHVQIADMIRSHVPIVEIADAIPCTQAAVRRIRTNLQCFGTTTAPKIRTGRPKTLAPSMLTGLLEKLRESPEMLLGEMVAFLKDEYGVNIAISTISSALSSVGWSKKTVRRVAQERNADLCDYYLHQVSAFSSYQLVFVDESGCDKRAGLRRTGWSPKGVTPVQVARFHRGARYQILPAYTQDGVLLSRIFQGSTDATVFEDFIEQLLHHCGRYPEPKSVLVMDNASFHRSDRIDQLCAAAGVKILYLSPYTPIYNPIEEFFAELKSFVKRHWQHSKDAHDEDFGSFLEWAVDVVGSRQSSARGHFRHAGIAVVDT

SEQ ID NO: 3693 - protein, 1101 aa, Unknown
  Kingdom: Fungi, Phylum: Ascomycota
MMASHGRATRSRYSSPAQPQAFLTGPLETPKDSVSESSKHFMARWLEPSVQKKASFEEAGLVRQGVLEGMAPLGALPKAKKPSGDGTSGVRKIILRPSGGIANAAPSPRETAPAPKFPAASSSASSPPPPQPAAAAAPSSPQWQKIPLPPNDDEDDVDYEPKAKTSRRRQSGRVTKGKKPLPTSEPLPSAARPPAPLSIDPEVKEFTDKVVAAAVEEALQHCRYPTAYALRTLYDERSTEPGFVALIEDVFSQTADPDTVSEFASLLEDKKRQGKKDDQGVLYFVPATTSKRHTPRKPKPAPYAKMLKRQNSDADDQGVTPTPRASKKIKIRHSRTPSKSTHTNGAVGAAMEPAKPKTPSSRKRTRRGSGSSDSSLSTTMSISPFDTHGKRSAVAPQSPVSPSFRGAAKIAAAGAKTSTTDSHANDAPNPQPITTRGKTLAAPVSKAKGVSNTSDTPSSSLTHPTSHQQKQRPSRRSRAGRSNSPAVDDARMPGRVSAVNLFPNLPRKTSDTPPDQEPESRGSTKGDDGHWNKKWEARRTTENYDAQDSFLRGSSPEGKATPTVTTRRTRQSLLPGVGTRATRSASKRPNDDIDGTASPIAPSWNGDASSVAESRAVTPSSQRPAAKKAKTGIRIKLSPIKKKGAAGGLPRPVGEAQIAPNGATREQTADNDEYCSACGNAGDVLCCDGCPRSFHFECVAMAQDELPDEWFCNECLFRRFPRRVPVHRGVFGGALNNLEKSNPRAFSLPKKLQNRFEGVKAGPDGDYDDVISKQTRDKKRNTSDEGASYPMREDGQPILCHNCQKGDGTPQELMPCSACPLWWHLHCLDPPAAYPPSRKTWQCPAHSADVTAESHPLAPAHRFRKIKGAQVITPALGRGLKNNGQIDLDWGDEPEPSHNGWPDSRSFGRTYKLPVKGVILDFVEQLRRQGAGYGPRNEEMKWLPTKVMPHSTSKAPLRGSELDRQLQEVQASLTLTALQRERSEGTQQLTSALLNAVDPNVLSLMAKANADNIEFGKLSDDDKLGLRAMMVQMDAISARIRRTLGEDSNSAASALASPGATSVAEVTPMSSPREKMESLPLVTEPTPPSTVEHGDGSMDLD

SEQ ID NO: 3694 - protein, 665 aa, Unknown
  Kingdom: Fungi, Phylum: Ascomycota
MLFSDHSFMIAQPYLMAPRRASGQARGQQQRQENNQGQQQDQAGDGQNGNQQAGTGRNANQPPRPARHISGPQSALTDYLASHNISARRIRDEAEQRRQQAAASARQNGESSNVDEESSVPAAGGSASGRRGSGRASNGAQQTAKQKDEAKTIEKIKASKAFKKRKKDADDSDDEDAIARAIFEERHAPLPGQMENCAVCSKRFTVTPYSVAGPEGGLCCAPCGKEIAKQRQGQQPKKKQARKQTGGVGNRRTMQSRILDGDRGTKSLSTLCVQTLAKNVDMADSFGDLPEHLVDKIARIFSKRRLLRSETLPLFAQPSTEVLHIYDGARLREEDFMQIFQVAPKLRRFKVRCAIQFKDEVMDYLLTRDIELEHFYLHGANLLREDKWHAFFTAKGASLRGVQVYYTDLHFGDETIALLKETSPNLTRLKVENNQKVTDIGVEAAGDLPKLEHLGFQLRNDIHSPSVVKAVGKCGSRLHTLSLKVVPLVDDTVLKSIHDNCRALTKLRITDSEHMTDSGFADLFKDWQNPALEFIDLQKCRHMDSTRPRDNVDLVGLCDQGFKALMAHSGSRLRVLNIHGCRHITQEAFEEVFSEDATYPELVDLEISFCENVNDFVLGSIFRSCPNLKKVNVFGCMRVRQVVAPRGAVLIGVPNAQGMVTEGDA

SEQ ID NO: 3695 - protein, 316 aa, Unknown
  Kingdom: Fungi, Phylum: Ascomycota
MAPSATTVTAPAPAFPIGALKSAPSKQQDGPDELESQLSEMSRGPNALAGIPTFDSFEEHRRHICLHMAAVFRNWARMGFTEGTSGHISVRDPEHEDCFWMNPIGRHFGLLNAGDMLCIQMDTGRIVGGNSTRPYNLPGFYIHSEIHKARPDVHSICHAHTIAGRAWCAFGKPLDMIQQDICDLYGVLAVDTEYAGIVTAEQEGQQIARALGPRSKAAMLINHGLITVGSTVDEASFLFGLLDRSCEIQLKVEAACAGNPELKKSIIPHEFAMNNYKMAGEKNWLYEEAQNDIEYEIEMAGEKLWTGIENVKVDRR

SEQ ID NO: 3696 - protein, 378 aa, Unknown
  Kingdom: Fungi, Phylum: Ascomycota
MPTAPATPPPDDLYSFLDDYSEGAHPALLQALISSNHTQQVGYGNDTFSASARASIRHLAGCPDAGVYFVPTGTSANVISIAACLRPHEAVVAAGTGHIVTRETGAVEASGHKIINVVPENGKLTPAVIEQAVASNWHVPHQAPPRLVYISNATEIGTLYTKAELRAIKEVCVAHNLILFIDGARLGAALASPLNDLTLPEVLELSDIFWIGGTKNGALLGEAIVVKDPTLARDFEFYIKQRGSLLAKGRTIGAQFAELFRVPSLDSETSLSLDEQFRKTLYYELATKGNTNAQKLSEAIKEAGYGLRAETETNQVFAVLPGAMIERLKGRFRFYVWERTGAEGEEGVVRLLTTWATDPKEVERFVQMVKMPLEEQMA

SEQ ID NO: 3697 - protein, 522 aa, Unknown
  Kingdom: Fungi, Phylum: Ascomycota
MESLSDTKWDAVISGTGLQQSLLALIFSSRAGLWKSDHQTRALSRSGKEILHVDPNGYYGGSEAALTLDEVDEWVKRHARANTSGSDDIFNAARVVRENETAALSSRSYSIALAPHFVHAKSELISQLVSSKAFRQIEFLAVGSFFVLQQSSSATPPPALARIPSTREDVFSNTSIPARSKRLLMKFLKFVLDFDSEANQEIWKSHAGDLLSQFLVTEFKLDESLQSYVVALTLSIDGQVLVEEGLRAIHRHMTSMGIFGAGFAAVYPKWGGLCEIAQVGCRALAVGGAVYMLGTGIKDVLETPSTDDSGQAKLEIKLDNDLAIRSPRLIQSLNQRAPNSRSVRRLTAVIDSRLSTLFEAVVDGAPAPAVAVVALPQGSLPSIDGTFTYPVYAMVHSSITGECPNGQSIIYLSTMADPDADAALDQSLTAILTAASESVDGSTSLQILYRLYYEQAEGPSSTSVDGRIVNMPCSSVALAFDDATLQSVRDAWELLREPEADDGDYMKFDDREGQDDVDDIYD

SEQ ID NO: 3698 - protein, 240 aa, Unknown
  Kingdom: Fungi, Phylum: Ascomycota
MRKDMLLGAAGLARLAHSQSSSNNGDGDERIDECFPDDPTAPCVAIANIESICMQRGISTEDHQRCMCEGSYFQDWAGCQQCLRVNGALGEVEVDYWSGVMSDASTALCDSDSSPTTWLRDYFSEAAATAAPLTVDGSAISKATLVSETDVSLYFTATESQGPGITPTVAPQSETETTSTTEETTGTGTDTETQTGTGTETETGDGQDNGDEDDAAGSLYVHGASGVAAIMAVAAIFVVM

SEQ ID NO: 3699 - protein, 279 aa, Unknown
  Kingdom: Fungi, Phylum: Ascomycota
MSAKHVVHRGAQTPAAKDWVPFEWEEPRLGKQVHGEVTVARTFGAAGNLTSGFWRTGATSPGANADGSHRLTYSAPLGDELACVIDGSATLTVVSTGEKFHVSPGAIISSPKGLEVQWEIDAPFFKKYWCIWNGSKATAKPPTTLQINHVSDNPAEWTDYHFDEPKEGPQVAGELYFISTGGSTGTFLSGVWRSGKGIAGTNVDKDGTLSTPYTGILGDETILLLEGEVEVIETETGAKHNFTAGDAIGLTTGMHITWISKGPFTKKLWVITKDEIAEE

SEQ ID NO: 3700 - protein, 434 aa, Unknown
  Kingdom: Fungi, Phylum: Ascomycota
MDTRSEETVTVPDNQTPTLQEKANPQPAAPAGPDPASFPDGGLRAWLVVLGGFCTIFASFGWINCIGIFQAYYSENQLQSYSLSTIAWITSTEACLMFLCGPFVGMLTDQYGPRVPIAIGSVLHMFGLMMLSLSKEYYQIFLAQSICSAIGCSFLFFPAVTAAASWFLRHRALAIGIMVSGSSIGGVILPIVVNELVGSIGFGWTIRVVAFIILGMLIVGNLALKSRLPPSKRRVTLKDFLTPYTEPTFLLLTIAGFLTYLGGFLPFNFIIVEARANGMSENLAFYLVAIVNASSTFGRIVPAHFGDKYGVFNVFIVMTGLGGIFTLGVWLGAQSDAGVIAYAVLYGFTSGCTFSIVPAMVASISDIRQLGARNGSLYAVSSIGALVGSPIAGAISETSLSNLIIFCGVLILAGTGVAILSRIKITGFKFLVKA

SEQ ID NO: 3701 - protein, 612 aa, Unknown
  Kingdom: Fungi, Phylum: Ascomycota
MSPSTRHNFTSPPTSDPSSHNMARSSSSEPSKSNGSSNGGSKRKGTRSVSTLTPSQLARKRANDREAQRAIRARTKEHIERLEKELDDLRSQQSRDQTVQELMRRNKALEDELMRLKETMGVSSHIVNGATGGPPPNTSPYSSTPGTASSAGTSAATSSMEIDTFGILEGAPSLTSSPYTVYDDAGPNSTRGSPFPGSGYDGSISDYGAASSFVPLPDNASNADGSNWPPVPNAIPSTVSSPSSSVDDYTTAGGAPYMPTSMPNGMIPSANGVVKMEFDDGDRGMFPLKKTPGLSTSGWIYRTEETNCQHQDIGFPQHLNNDLLQLQLQHHHQQAAMLVHSNNSSNMSSPDQPPRSMPPLSQHQHHQPPALWELPILYETPKGRADELLLGFVHECRRQPRMDSVRMMLGPAKMDVRALFPEDMRQHFQSNVQMPPPPARSPLGDLITSVIANAGLVRPLERLGVVTPMHSYVAWLAHPSRETQARVASHLIPRHSQLEIQHPAWVGMIHWGRLRCAIIHSQDIYGTDEFLRVYSSCLRLVNWPPTSPQSQQQQGDGGLVDAAIETDPSTGQVWLSDSFIAHASRFDSWRLDVAFARRYPELANLVDLVDLS

SEQ ID NO: 3702 - protein, 246 aa, Unknown
  Kingdom: Fungi, Phylum: Ascomycota
MDSTYNYVSPDLVMGNNTFGDDENLAAYDPSFFLGTTTLPNEPLPFLAEGASFPVPVDFSNTQLGTPPMSGFDGYLEGNIDFDENLFNNMGDLSWGADMYNQTFAMGMDDFAVPPPPSTASESQGLSPRELYLPYTPPEDLTFTPSMPSPSTNASPSSSHQQSNRKPTASTGPKRQLRKLIKPETCPVCGKGHAQIRERDRHIITQHYDVAVRMGLNVNRAECSLCDQTFRRKDHLTRHMKRRHGW

SEQ ID NO: 3703 - protein, 588 aa, Unknown
  Kingdom: Fungi, Phylum: Ascomycota
MWHTVGSSPDSACRDDAQRYRSVTVTHEALTFRPPTVNVRRASFPTPSQTLEERSLGLTLSQWVGRLKARAFESTISIYESIGTFVVASLLIRVFIGIVLIMASYHSIERRSDDDDGKPSTQDGNGGVSVAFAAKDEERITRKVDTRILPFLLLAYLFQQLDKSTLMYASVFGLAEDANLVGKQLSWLGSILYLAQLIAQPLAAMILVKYPLGKVIAIAILMWGLTLCVMSRCTTFSTLLFTRFVLGAFESIIAPSCLAVTQMWWAKDRQTTRVSAWHAMNGIAPIVGGILCYMLGHLEVQGLFTYQILFATFGIMTICLSFPVWRLLPDTPAQATFLTYEEKIILSDRLRASRSDAATKVWKWDQTRECALDPKTWCWVAMHLSLAIPAGGLGVFGGLIIKDFGFDKFKTILFNIPFGLVALGAISGMTCILLLTPRGGKQGAHMAQLLFAYVLIQFQSAFVPLNLSWQAQNTAGETKKQCTTALMFIGSCFGNVVGPLLFDPDQAPVYKTGLMSSLFMFAVTFVISTATYFHLTYLNAQRKHSAYVSLNEEDEEDVESAGGLLQQPAHHLGADLTDRENKSFRYMT

SEQ ID NO: 3704 - protein, 920 aa, Unknown
  Kingdom: Fungi, Phylum: Ascomycota
MSTWQPSPESLNQLAAFLKDSLSGFDKNAQKQAELMLQQAKASPDFNNYLAYIFSSAQPPQGLQCSEQDYHVVRSAAGIMLKNNVRNEWKSIPEDSLRLIKLAIPMGLQDKNSQIRNFAGNVATETIRKGGLLGWPELLPQLLDLISNTSGQTPNEAQEGAVSAMAKICEDNFKMLMREVNGQRPLNYVLPQLITATKSQLPKVRLGALTAINVFTSRESQALLNSIDELLQHLFVLSADESIDVRRQVCRAFVQLVEIRPDKLQPHISGLVDYILTQQKSDDEDLACEAAEFWLAVGEHDNLWQALNPYINQIIPVLLECMVYSGEDIALLGGQSDDEEEEDREEDIKPAFSKKSHTRNVANGDDTGEDKNASYQKLEGMDDGLEDGEIDDYDEDGDENPDERWTIRKCSAAALDVFARDFRGPVFEAILPYLSQNLKHEDWPHREAAVLALGAVAEGCMDVVTPHLPELIPYLLSLLNDQEPVVRQITCWTLGRYSSWAAHLPDENQKNMFFVPMMEGILSKMLDKNKKVQEAGASAFANLEEKSGKALEPYCGPIIQQFVCCFGKYKDRNIYILYDCVQTLAERIGPVLALPELSSQLMPALINRYQNVPDQSREVFPLLECLSYVALALGDAFAPYAQPIFLRCVNLIHVNLEQTLAASSNPSMDQPDKDFLITSLDLLSAIVQALDDQKASELVKSSQQPFFELLSFCMEDPTDEVRQSAYALLGDCSKNVFNELQPFLSTVMPILLKQLDLDTMPDEDIDSGFDVINNAAWSAGEVAVQYQKGMQPWVPELMQRLVEIMTNPRVPKALSENAAIALGRLGLGNAEQLGPALPNFADDFLNTMSEIEPTEEKATAFHGFALTVVQNPQAIEKVLMNFFVSIARYEDMELRNPTKNELHQAFQNVRTPFKSILKQN

SEQ ID NO: 3705 - protein, 338 aa, Unknown
  Kingdom: Fungi, Phylum: Ascomycota
MSKQLVLVGACYLDTLLSVPFFPSEDTKLRATSSTTRVGGNCPNSIRVLQQLLDPSDDVQLHLISCLPSQSSPASHRIRNFLTKETDPAGKQRSTTSLKHCIYRGDHTEPPSSYIICSGDSGSRTIVNYNDLPEMSASEFEERVQAFDPAQETWWHFEVKSDMGGGRIPSVTLACMHLLRNLLPQAGISVEVEKPGRDGLAELAAEADVVFYSRVWAECDRIPVEEEVNVVEIKTWTDNPLHCNSLEELMSYGCVRDDETTMPRCYFPLLNLITADMGSVVAYSTVGAGDTFIAAMLYAMVCHLTDWETASKARFAVDLATRKVQREGFEDLNVTSVR

SEQ ID NO: 3706 - protein, 412 aa, Unknown
  Kingdom: Fungi, Phylum: Ascomycota
MMSSRTACRAARQTACRNVALPRRQPVRFQSTATSSSSTSSSSSGHLAAGVAGGVIGAGVFYGIYTFTPAGRTASTINKTAIEANKKYKEASKKLQQNTPSADQAVEYMKQFAYSYVGWIPGGRAYVDTAFEDWEKIRENHREEADQIINDAYKEFQGIAKMGLSMETASKGAEALANLAKRVAELGGDAISDIIDNHPQLKEKLGGNVDKLKQMGEQYGPEAKKQVDETWKQVKEIVAGGVSAANLNKARQLVEDKVQQISKLGDEAWKKAYEQAKPLLEKNPKVKELIENNTDALKQGNVKELFEKAKSSIDSGNIDDLKSYVDNAVSKAKDKASSASGGIFGDLEKYAKMVPQVDEIMPKLKQLAEVAEKHRDEGEKLLKETVEELKKVLESKSEKAKEIAEKAAKESK

SEQ ID NO: 3707 - protein, 176 aa, Unknown
  Kingdom: Fungi, Phylum: Ascomycota
MEDTQNTAPGAATATKLGATRRGPDSQSVTKRLQTELMQLMTSPAPGVSAFPGSDGNLMSWTATIEGPDDTPYAGLTFKLSFNFPSNYPYAAPTVLFKTPIYHPNVDFSGRICLDILKDKWTAAYNIQTILLSLQSLLGEPNNSSPLNGEAAELWDKDAAEFQKKVTARHRDVEDE

SEQ ID NO: 3708 - protein, 947 aa, Unknown
  Kingdom: Fungi, Phylum: Ascomycota
MALPALPVTKTRKSTGGIPTTSSLRAASGLPQSSLRAPSMGLGPPSPAPTSALPQPRSLGGARSPAPQTPAPKTIRKTVSINSFPHPPRTEISRGGSLPPSPLASEKPRSSRKSRSSKDSMLSAFNPSTPSLLNGSGEGKSITSVRMSDGLISVGSDPQSRSSSAQDSYSTSATTYDDPAEGSAPKQDSSTEKRSSKIDGKGNVLVSVRVRPDTNADHERPEGEWMVDGRKSLISYKGKEGGDHYYDNVFATHDNNSRVYDHCAKRLVRRVMEGYHGTVFAYGMTGTGKTFSMQGTASSPGVIPLAITDIFSYIRETPSREFLLRVSYLEIYNEKIHDLLSMPTGTGLGGATQQDEIKLREDSKRGVYATPLKEEIVQSPTQLLRVIARGDQARRTASTQFNARSSRSHAVVQIVVESRERVPGAGIGEGKRSGLAPGGVRVSTLSLIDLAGSEKAAESKERRQEGAHINKSLLTLGTVIAKLSEWKEKEGKGGDKDGKHLPYRDSKLTRLLQGALSGNSLVSILCTIQIGAAGSVAAANSHTTETLNTLKFASRAKNNIVSHAKKAEEALGAGGDGGARVLLERYRMEILELRGQLDTQAKKKKTDEPEEESPRDEEAERVKEQEAAERHEEQMLEMQLARTALKERIDHLNRLILSSKSVGVNSSGSLSSLGQYGRFSQVSLPASVRSSVATSTGPKSLIERTSSMTSTSSTIGRRSSGGGTVQRLSDGAEATEQDEDSSGDFGDGVASLTAQNRALQSDLVDKNRYIATLEKRLLQARRASSSRTSVGLGASSKGIMVGEDHSVAAAIKERDAEIADLRARLDDKDRMLTALRSAARSRDTAEGTTEPRSPQSLGSPDLTGPLSPSKPDRIRRKSVDEMNKMLEEMIQDRVDNGQIVRGTRGSFRFASGQKMDALAEPVHDLEPLRQSPTPTPGSAPVSAGPDA

SEQ ID NO: 3709 - protein, 247 aa, Unknown
  Kingdom: Fungi, Phylum: Ascomycota
MDSPTVPIASSQASRLLTSFTTFLTLTIHSLLHHRNLYPKATFLLTRAYNLPVPQSRHPGVCAWVNDAVSSIAVRLRKGEVQRVVFVVYTPIGKVLERWVFDVGLFPREGWGVEDDDDADSGLQAQGEDGVNWTDVQEALRGALRRVAYAAESKPELPPGCTFTLAVELRDDAPAPIGHPQAWIPAQPDLQPPTQNSPAGQGSSIGGDSTTPLRSVQAGPLFFECWVEDSKEDPGSSHSNMESSGKS

SEQ ID NO: 3710 - protein, 499 aa, Unknown
  Kingdom: Fungi, Phylum: Ascomycota
MDSFDLVITNGVCVTASDVAAFDVAIKDEKIALLAPSGSLAKANAGKIIDAQGGFITPGGIDAHVHLQEPPMFGKGSTSDNFESGTRSAIAGGVTTIIPFAPQQKHEASLLKALSDTHDKARGNSYCDYGFHLLVGNPSDQALSELDTIPEEQGITSLKIYMTYTALQLRDDQILSVMLKAREKRILTMIHAENGDVLNWLTDQLEARQLFDPKYHSHSRPPVLEAEATNRAIALSSIVANTPILLVHVSDPGAAARIRQAQTNGQPIFAETCPQYLFLTRDDLESCTGFEGAKHVCSPPPRDKPSQDAIWAGVKNGTFTVLSSDHCPFNFDDAESGKKACITDEHPVGRFRHIPNGIPGIETRLPLIFSTDRLPLTKVVEVSSTNPAKLYGLYPKKGAMIPGVSDADLVIWYPKDASRNITITNSDLHHATDYTPYEGQTVNNWPRFTILRGKVVWDKENGGIMGAKSYGQFLKRLPSSIDGIWDTVEKQGPFDVSAF

SEQ ID NO: 3711 - protein, 392 aa, Unknown
  Kingdom: Fungi, Phylum: Ascomycota
MRFTTGVTSVLALVSGLAAAAPNLAPRAPTNSEIKDAKSVDDFRDLAIQALQAQQSDLQRRGEQGSCTLENARVRRDWEHMSKCERKEYIKAVKCLWELPAVDTEFSAAQNYYDEFVAIHANLTDFVHGTANFFTWHRYLIALWEDTLIDQCNYKGSLPYWNWYKYQSELHKSPVFDGSDTSFGSTGEYFKHNGSLVGSRTVWLPPGEGGGCIKDGPFVGYTINLGPIRPAMNGYEPWMTNQLDYNPRCQRRDLVHAASERYTFDGLYDLLAGENSHNIKLFQDKFQEAGTLSQHGAGHYAMGGDGSDVFTSLNDPAFYLHHGMVDKLYWMWQALHPKEAATVAGTLTFQNIIPSRNGTVDDLLDVGVLGPKLKIKDTFDTLGGTPYCYIYE

SEQ ID NO: 3712 - protein, 109 aa, Unknown
  Kingdom: Fungi, Phylum: Ascomycota
MRSHDAMKNEEANQAAWEASKGGLIGAAKMGVVTAILGAVGFGMSPLYRGTTIQFKVYLQMSGMVLGGMVSAEHRLQEFEAQMRYKRRMIAEKERWERYENEFSGSEGK

SEQ ID NO: 3713 - protein, 2148 aa, Unknown
  Kingdom: Fungi, Phylum: Ascomycota
  misc_feature (84)..(84): Xaa can be any naturally occurring amino acid
MVPDDDNELRREPDRLWRGGMHWDDRWQSAQIDIWSFLQVVSAPDWASLHRPASVGPLIRATIASPSRPESAPFIRYCSRLALXLLLAQGSTAMGRNRGKDVVHVEAQDFGAVGLHPTDNGNRGSSSLDFNAPYSQPRHSRSGEAHRAQELSTHRRSSNCQENPAQSLARDNAGDVSLDSVMPPPLQRRLNRSSTAPLEQRRRRHSIDEDDLEEERSLLVRRHSERLESPRRERRSRYKSPSESELENDSDSESDLSDESDLSDHRQHADHIRDTIEVSDDERPTYTRRRNDAGGPSRHDGRVHARRREEDSMQSRSDGEHNDSRALVVRDEHQLNQNQHHESQQPEAHRRQHRRRSHKVPVDSRARHGSQRTSRRLEQHDQTADDTVRSQRESTVASSRSSSASLRRPTNVLSTFFKPPPTPKRQSKHAASGSVPKGSPAHAERVECVICMSDVSIKKAAHLKCDHHMCNTCLKRAFTLSVEDSTHMPPKCCTKDHIQPKHVERLFDLTFKKAWNRKFVEYTTKNRLYCPAKRCGHFIKPSRIKGDKGRRCNNRWHKTVDCPTDNTINDFLAQAKEEGWQRCYQCRAMVELREGCNHMTCRCGAEFCMICGSKWKSCDCPWFNDEAIAADRRRHMNEGPPPQRGRIEDIFHGEGPPMPPELRGMAGFGPAPHMLAQMPHGYGLDAPRDFRRAHENEDADLARRMSVYGNLDDDYSSGTYHAPGGSMANGISNAVHQQAPYHYHRGSQSMVSPSMPPNWDRSSVTDYVSEVSRARGVREDSMERRLADRLAERPMLHSAAMHPISGSSIGQLPQPMYSYAGVPSSGRVDPVTGMPWTSIGNSIAFIYAELRRVLRATKDRSEYAQTTTKGAGTRTRKEIIIIGSSHIKYRGQVIILGRVNGTRTRNGQVSIDEEPQWAWTLCQVLLLDQEKLGVLKVEEAIGAVLRLSSLHPAHVKSIASHLHVLGFFATTLHHELLSGPEEHPSASRFSSADRTMLLLHQVGSVKIGEVVRYHVTYTPSQDRILPSPEHLYVRIRNTSAIALRAAFVHGPYTLAVAAWPSNFDPNEKFEDPRRYGVPEFEPMVKAGGSWECELTVPDNIRQSAGIGSHGGFGESPDHDNESASWVIEVSSQVIFSTSAAVGYEVVVARDKKSLNLGLSLPIVGNQTQAPQPGRVADHQQSIGAKDGHHPAQIKGVFSRAVKVTVEDTAALWNTPRLPAWDDAGEHRLKHRNPVNEPVESTAKTDDPKTKEKDERKPRKQKKVHLVILTHGLHSNLGADMLFMKESIDSAAKQAKVDKKARKARERAAKGRPSTSASSASSQSAKPGDQKTEDPDELKDEKKSEVEGDEAKSSEESEMTEKQTEEAKAPMPKVDEEDDEDDDDEEVIVRGYSGNATKTERGIKYLGKRLARYVLSMTYPDQPYLPMGKEAVHAVTHNSQQANDLHPSHKHSTIHSEAHRERHAKQDRPYRVTSISFIGHSLGGLVQTYAVAYIQKHSPEFFELIKPINFIALATPFLGLSNENPVYVRFALDFGLVGRTGKDLGLAWRAPTIARSGWGALVGNLGETAHKKVYGESQPESKPLLRILPTGPAHRALKKFRNRTAYSNVVNDGIVPLRTSCLLFLDWHGLGRVEKARRDAGLVETMVGFGWAELTGTNLATPRQKQMLAARDAPLPTNEEPPPVSGETTPKGKNLSQVPQPADDAVIEDNRQSLEHTVTTPGVEVASSSDSASDMITNGPLSGFFNFFKSNEPPKPPVTSQKQKKAFRSGQIKPSEEATGTSPPSPGSSSPGPAKASAGHDLDDETENMNAPPRTTFFEAAGDLLNPKLPDVDYLLDPSKRPRTIFHDRVYHPSDIPPPPLKKRHSTLSRRAFSRGSTSSQHSQGSTASSPYPTTSREDSVESSKDYDNGAHGHDEVVDSSNMRVEEKIARAYHRDLSWRKVLVKLEPDAHNNMIVRRMFLNSYGWPVVKHIVDAHFSDSAVARSRDEDEYTGERALDMGQPPDEHGGETRSVPTGRILVTAPTASPEQRSTSEAQEALDKVPDLPKLNTSSLPRSTDGKDHADSLSPPTPQRRGIDRYDSATWSDRDFQDSDNDSDNEGSSDGRRSPSALKGGDNKESAKKQSHDRGPSHDWNWTEKIVGKGDASKKK

SEQ ID NO: 3714 - protein, 471 aa, Unknown
  Kingdom: Fungi, Phylum: Ascomycota
MSFERLERLLLANTGSSTPAEALVHLGTPSTSIAVLENGAISCVCHSSVGDNDETVFQACSISKPITALAIMRLIEDGHFTLESTISQLLPADVLDILIQGSPLSQKAMVEHITVEQLMSHTAGLSVHGFGGYSSSDKVPSTKDILLGQAPSNSLRVKLDLLPGLTFSYSGGGITVLEIILETVTGKPFPQILHDVVLEPLDMSRSSYGPLPDGERNAASAHFTGHVKADAPHHIQPELAAAGLWTTPTDLLKAVRAVQKSLKGDDFLKQATAKDMLTKRKGNVGLSWFISHNNTDFSHAGANMPGFRCVTAGFAKLGEQSVPESCGYAIMTNSAEGMVVLGKVGQALCYLNKWPLAPVTGSKVQETPLYDNEAAVGDLWKDYVGDWKDDDGNIYQIAEDNGQPALCYNKSGPIRMLPAATPGAQNSRKDTVLFVLEGLSLLLKLHDKDDEKPVKVENGSDRTSRDLERMT

SEQ ID NO: 3715 - protein, 217 aa, Unknown
  Kingdom: Fungi, Phylum: Ascomycota
MKAPESVSDQALVLMADIFPTGYYGVRSAIELCPKVKVQDSVMVIIGCGPVGLCAIAAATHFGPKRIFAIDSVDSRLELARGLGAEPLNFLHDKDGMLASIKAATNGRGADMVVEVVGQPAALKTAYDVVRPFGSISSIGVHGAEIPFSGEEGYDKNIRLQMGRCPVRGVFAESLAVLETKQHDFGFMFDKIMPLSEAVEGYDLFDKLKVQKVVFRV

SEQ ID NO: 3716 - protein, 387 aa, Unknown
  Kingdom: Fungi, Phylum: Ascomycota
MKFQNLSTAALAAATASALPSYPIMPRQTNATGRVLLSNSGKIYLADYTGSSFDVTMTENDAGHSASWMAYSQPELLYAVDENGNLTRVFELDVAGDKLEKKAEEAGSTGVVHLEFNKDRTRMVGAAYGEGTIDVWDISDGGLSLMKTIKSEDDLGPDKDRQAAAHPHQSVLDPSGRYFAVNDLGTDHILLIDSTDDAFKVSNSVAVTPAGAGPRHGAFYPANADKATHYMVLCEIKNIIVVYELSYTDSSIEFNHIQEISSFDPDFTPAEGAAAGELAIIGDHVYISNRLTGADTDDITHFRIFNCSGKFELQFSESVSTGGTRPRMFSVASSGAELLVGNQDGALGLVAIGIKEDGALETTFRASVKASVFGDAGFGPAFVQQIA

SEQ ID NO: 3717 - protein, 756 aa, Unknown
  Kingdom: Fungi, Phylum: Ascomycota
MRFQQAAMALAMQGFFPGAEAGIMFKRTGQLGGLEGPGGSPVGAVKPVGPSGPGGPGGVRPPGGPGGPGGPGGPGGIRPPPPPPAGTDVLTPPGVELPEATPITDANELPILVTETPVDIITTSIEVLEPPVETPEFGVPPVLIEDPIETPPAPPAPPAVTPVETPEVVIPPVLIETPVETPIETPEAVIPPVLIETPIETPEVVETPIETPEVVETPIETPEIVETPTEIIEPPVETPLETPEVVVPPVLVETPVEVTQEVTVTVTQDDGVVETVTQTLDGETIIGGEVTVTVTQGNGEVETVTQTLPGATVTAIIAQPIIIIVEQTTNFNFDFSLGGVCPPVVADPAGSGGFVVGEDAMLPTLPQACRAACQIQFEQCSAKAGENFQVADCQKQLDACNAAAATETLIEAPAQTVTKTVFLPPTEVPGIEAELSSDGCVIITTETLPADEVATIGDEGISVITTTVGAEATAAAPELVETTMVVTLEAPPAGGIGAPQPSVVTMTMTVPAAPKPSAGGPPPPPAEHSVVTVTVGDSTGVVTLPAPVATEAGKPGKPGNNGPIEDSDEKPVVGEEGENNGPPPPPAGTDAAAPSPPPAGTDAVPPPKPTGGPAGPGGERPGRPGRPGAGGPGPAEECPPCLGQGGVCPDAVTVTVTEAAVTVTVTKGDDGAAETLAPENTETLTIVEPTPGATPPALETPPVLETPLLPTDGTTLTTKIGTSPTEAPVEIPDQLSVDEEERPAPGKGLFSGLFGN

SEQ ID NO: 3718 - protein, 365 aa, Unknown
  Kingdom: Fungi, Phylum: Ascomycota
MASVVESLSAQPRKTPFLAPLPDCKPAPKPELTADQLSKYEALLAKAEEFDQITCPKEADKSGPITDSERAWLTKECLLRYLRATKWSVPDATTRLLATLAWRREYGIEGFTPDYISPEQETGKQMIVGFDKQGRPAQYLNPWRQNTDASPRQINHLFYMVERVVEMMPPDVEQLSLMINFKTTKQRSNTSVPIATAREVLYVLQNHYPERLGKALIINVPWIVKGFFTIITPFIDPITREKLKFNEDMTQYLPPAQLWSEDWGGKMDFDYDHETYWPALNELCRLRREERLRRWEAGGKVIGESESYLQGGTDTSVQGLKYDGEKVGWGESGVDAVTEKLGEAKLDEDEKVKEAEATPAASTAA

SEQ ID NO: 3719 - protein, 422 aa, Unknown
  Kingdom: Fungi, Phylum: Ascomycota
MEEASANLRRHKAMGNSTLLNKGSIRLKVNTPLHSRVNILRKVNIRLLSILLSMAATSNNRHLHKVIILHPKASILLKVIPNKGMQYGAPPPQMGYGNVPPTPPTLGYGPSTRINWDARPEAQALRSAMKGFGTDEKALIRVLSNKDPLQVEAIRLSFQSDLGRDLIKDVRSETNGYFEQGLVQLIRGPKMNDAYLLYDAMDGPGTKEKMLNDILLGRSNADLNAIKQAFRATFGKALEDVVKGDLSMKTERHFMMVLAANRAEDGAPVVPQQVDDDVNRLYQATEGRMGTDEMVVCSILTQRNDNQIRAISHAYTQRYRKDLAKVIKSEFSGHMEDALLFQLQHAEDKYMHAASLLEDAMAGTGTEDVLLVSRVVRFHWDPNFLANVKAAYEKKYGKNLAKRIAGETSGDYERLMLACIKA

SEQ ID NO: 3720 - protein, 141 aa, Unknown
  Kingdom: Fungi, Phylum: Ascomycota
MGQRLSPAVVAVPCERAKKHPSPSKETLEDLEIALHKVSWLKVANSKATEPDELGGNHDQPGASLRRRDPNRRVLKSQPNGLGSYTSISNGVAVKSSAKTDTSPSVPTRPSNANVANGTGAGKIKLRRPPIAELGELDELH

SEQ ID NO: 3721 - protein, 281 aa, Unknown
  Kingdom: Fungi, Phylum: Ascomycota
MSAMQSSTMETAPSPPLNPLAITEDLTPLPELKPAGDTHVQFEGQLSRPLRLHEDVRNGCGGQTWPAGMLMGKHLLRYHMDTLRDARILELGAGGGLVGLGVALELEMLGQRDNKLMITDQAEMLDLMKINIGLNQLDESVDARILNWGEPLPEAVVTQKPNVIIAAECVYFEPAFPLLLQTLKDLLALNEDAIVFFCFKRRRRADLQFIKMAKKTFLTEELYDEDRPVFERQRLFLFSIRSRKARPEAKKQPKVTKKEAAENRKIAGLDSAAALGVKVKI

SEQ ID NO: 3722 - protein, 785 aa, Unknown
  Kingdom: Fungi, Phylum: Ascomycota
MANSVLACSACMRRLVLSSPFASRALSRTGSIASTNALRTRRAFAAKAVQSNDFGALFNKDPLTEEEKEAREKESKEKLAEKYARNKLSKIDDPFHIGQAVNAALREGKFDNALLLTEKASRTMDVVVSWNALLGYQLERGQVKAAFKLFNNMKKRGQKPNVRTFTTIFDGLSNCPNKQLAVNEAVKHYNILVQDDRIDANIIHTNAVLKLCARAHDLDQMLLIANTLDNSTRAADATTYTTLLEGIRHKVLAEVKDMDPHESERYRQDMADKAMVLWSEVLRKWKAGRLRVDERLVVAMARTYPFQEERNTRPEDSKILDLLEEMMDIPNYAKYPDWDKEEAKRRSAESFDPQDDKTKKPTKAVGAARSRTGMKAVPTTRTLGLILEVIGASRRSALAIKYWNKLVDDFKVHPDHDNYFRMLILLKTTKSSGHIVWLLKHSHGSVLNAGHINIALEACINDNINTNSVNNAQDVLRRASEVLPPSHPELMKLHRMYLRVALVSHHTFRQQSMRGEDEAARAAYGRQILAALEYLWEPYRKLNKQWFKTAPDYAISNEAAANIRAASKSQESPKKQRPATKPTPLSQGELRNMQREVIALARNMYASYNKLRTEKMLPEEELEPVLWRAANLNREVQHFYSDRGEFEPNLPPQDYARRESMRRGRLSGTASAKALPASDKHFDAKERSSTSYKEEESADDRIAAEADELAREIAPDDQDIASDIRRVGAEFVWSTRSPMGSKKISTRTNTRRQSDVRTDSRRKPTRHAQKWEGRSQQDKLFARKA

SEQ ID NO: 3723 - protein, 386 aa, Unknown
  Kingdom: Fungi, Phylum: Ascomycota
MSSETTTTSEDGSSPTAASSAESMAAGAPARSDTENSSAEPLPPMTTEWNVPQSCTWTYNAASEPVPGATGAVAWLDLEPDAEATTLSCYPDGMFKGERTGVFSPGTCPSGWTTAEVLVNTDEDHDHATTTAICCSSEYSLVDTICKRSVPTVLAVPISYNKTASTHEVLSDSTTTLYSATIAVYTIMAMFRESDKPMLGIGDEDDIDDEDRSSGLSINEKIGIGVGSAIGGLLVIAGAIFLFLHCRRRKRRANGTSHEMGAVHRNCRGVDRDDDASFTSAEDDETRRRSYGHEPPPAYEATTETNSLADTESGTSASREEIRVLRAQKELIQRRINELESVETDDGVELPQQQRLSGEQEQTRMQQEAEPQNRPDTPTRDERSPQ

SEQ ID NO: 3724 - protein, 520 aa, Unknown
  Kingdom: Fungi, Phylum: Ascomycota
MESNTKMAVADSYDDKRMAAQADQVSDNATTSDLMGNVVDPVLAAKTRLLNDAIDEIGWTSFHTALSCLSGFGYAVDSLVAFLQSVAAGQAYLEIGNGGFRTGSTMALYSGLLVGALFWGFFADSIGRRTAFNVTLFLASAATIIAGAATNWVFFSVFIAILGFGAGGNLVLDPTVMLEFTPSSKQWVITAMAGWWGIGQAAAGGIAWGFYTRSEWSCTTECTWENNKAWRFIMFTGGAVVFVMSALRLLVMRLPETPKYLVATGQDEKLVTTLHIIAKKHNRPCSLTLESLQACGQVHQVEKALHQSKGQRAVSTLIHQVRGLFATRRLAMSTLMIWVSWMGIGLGYPLFFLYLPVLLSSRVPDYQPTFTETWRDYTITNICSVFGPLIAAGMVEVKWLGRRYTMAIGATLTAILFFGYTAIKTPTQNLALSSSISIAINLYYGTLYAYTAETFPSAHRGTGNGIAVALNRVMGLMSAVISVTADSTTSTPLYISAGLFLLLAVVSACLSFEPLGKSAS

SEQ ID NO: 3725 - protein, 508 aa, Unknown
  Kingdom: Fungi, Phylum: Ascomycota
MEESKTKADVELAYEGPPQEVEEDPRAVRSLVWKQDIRILPLASWTYFLCSLDRGNIGNARILNHSDGNDLLTETNMTQYQFIIALMIFLIAYGLFEVPSNILLKKYRPSRWIAFLMFSWGAITIGLGGVQAFWSVTFVRFLLGVFEAGLFPGLVFYLTFWYRSEERSIRVAMILASATLAGAFGGAIAYGIGHMNQVGGHSGWRWLFILEGIPSCLSAILVWFFLPDYPETCNWMIPEEKALAARRLAVDGSKADAPSMTKADAMWVLKQPRLYMHYIVYFGISVPFSSLSLFTPSITAGLGYYDLQAQLMSVPPYAVAYVVQVLTSWSADHFNARALHSATLATVGAAGFIGSALLPATSYSQRYGCLIVAASGSFACIPPLLGWLSSNVFSGPAIGMAIALNIGLGGAPGQIAGVWIYKTNEALEGYPTGHWTNAALLLMVAVGCMILRFWYIHLNKRRHIDEPGATRIHEVSSDVTPRMIGAWNEEDKESSIVIPAGCPAVEIR

SEQ ID NO: 3726 - protein, 351 aa, Unknown
  Kingdom: Fungi, Phylum: Ascomycota
MKLAVFSSKPYDKRYLDAAVETSNSSSKSPITLHHFDFALTSDTVSLVPDQTDALCVFVNDHLPASSIAHLAKHKGLKLILLRCAGFNNVDLKAAAEHGVEVANVPSYSPEAVAEFAVALVQTLNRMTHRAFNRVREGNFALDGLLGRTLHKKTVGVVGTGRIGLAMAKIMKGFGCRIIAFDPFENDEMKAIGEYKSLDDLLAESDIISLHCPLMDSTKHIINAESLAKTKKGALLVNTSRGGLVDTKALISNLKSGHLGGVALDVYESEGSLFYDDHSGEIIHDDVLMRLMTFPNVIVSGHQAFFTEEALSEIADTTVSSLVEFKGEGKCSNSLVTKLKDGVKSEPVRSL

SEQ ID NO: 3727 - protein, 668 aa, Unknown
  Kingdom: Fungi, Phylum: Ascomycota
MRSFSLAVLATQVLSAFGATIEVDGSGGNATSGRQYGFLHEDINHSGDGGIYAELIRNRAFQHNEFYPQTLDGWYPVNGASLELRDLEVPLSEQLPTSMKVSKGKNYKHGKIGFHNDGYWGMDVKKQKYKGSFWVKGDYKGHFEASLQSNITNDVFGAVKVKSKAKKNEWIEHKFELNPWVDAPSSNNTFVLTFDPNMVKGDIDFNLISLFPPTFKDRENGLRVDIAESLYELHPSILRIPGGNMLEGLTNQTWWDWKDTLYPLRYRKGFPGVWSYQQTHGLGMMEYLWWAEDMECELVVGVYAGLSMDGSITPRDELQQFIDDALDQIEFLKGGVDTKWGARRAELGHPEPVDLHFVEIGNEDWYAGGQEGWDSYKEYRLPMFVEAISAAWPDITIIASGTHTDKDGIDLPEGVYGDYHPYKKPDVLVEEFDRFDNDGPHIIGEVAATHVNGGIGWDGALNYFPWWIGTVGEAVSMIGYERNADRVFATFYAPILRNMNFWQWAVTLVQFDAWTVTRSTSWYLWELFAYHPMSHTLPATEEFDPVFYVAGMNEAKGNFIWKGACYNTTNGADEPVSVKFDGVKEGTKASLTMLTNAVDDPMRWNDPYTGENIVDRSTIIISANENGAFEFEMPQLSIAVLDTDYKHEGCRKKKGKHSKRSIGSSFAA

SEQ ID NO: 3728 - protein, 301 aa, Unknown
  Kingdom: Fungi, Phylum: Ascomycota
MTSTAEPQILKAVIRSCFDLAEGQLPTPTEFIAIMGICDRAKNTLLNGCRLMGRIRNRDLVFLGLEFCISVGLLALFSLAYPDRYRSKLWENGGVEGWNSNPNLRVLFYANHKEPPEIPFIWTQRFTDSNLAIAILTFIIHVTRLILLATNYLPLWIATAYDLALVVLWAMNVSGQASGDYSDLDHPCPYPWYLTHSCHDSWVSTKGFCQQAQTGFALAAMAIVLYLCFTASHFLDYLMGWRRRDLDEDEFLDWDHDIESKFSDTDTLLDSEERYVAAIQDAAFSPVLAFFPGDNKKGGWY

SEQ ID NO: 3729 - protein, 997 aa, Unknown
  Kingdom: Fungi, Phylum: Ascomycota
MALYGRPAELPPPASWHDNSGSPCLPTTSSQDFSTVESVDQFVPGPEEYSAAVFPFPPLDDNNYATKQPNIIFDVCQEDIWTSSPTDITSEPFVPHIPQPSFHRRKCPSSTISASTSISSSAASTWSSVQTDDDCQTIVPISSSSRLPSPSAPITLPQRMVCLGPQCSEAFTSDADLEAHVRAAHTYTCKWVGCSHPSFASREGLVWHVESEHLLICPCRGCDESGFEDPRVLMNHIAVGHPEVAKDGIKQWQLSTQVTAQSTEAIQRPSTSTKSAHEPVETTSAHLGKRKNMADDQERQAISNAKRKFQEQLRTAINKRARRASNQPSTLQPSTEDRSSPRGKFACRACSDKRSFAKFEALTRHYRVVHPEYSMPQASRPRGAVVTSPSSFFPTPVSVTSTPTYFPISPGTVRTPTSSSGGTLWTTPLSPLQESLSRSATINDKPVPFPLIFEHAILPFLVAFLPRWTGPRHVVSVTRGRTPQARRICITTPEPISRARKILIAKHLHDLLSLPESQHHRSSISFLFPVGTVDRTYGTSCWARGISRENMDDVCVPRNPFYFSSPCMGDSIGISATEEFDESTATLGPCLSVDGGNYWLANFHPFVDAYQSADPIVVEHPSAQDRAMCVSEAHDAVASKSTFQIGNVQVTSGLTLKTTRISHDPYWEDYGMDPPLVVTDWALIDARSSHANILRRFPIDYPHRTAPEPEPLVRETSAIVPGAPVVSSGRTSGYGTGQICEIPAYVSGAENGVQKATREWFIEESYASDDEEEWIRGGIGVHGDSGAAVVDAETGCLVGQLWGRNKYWGPGPRHTFFTPIADIFDDIQEKCGQQTRPQLPQYRSEGDCYPIEPPCRTCYDTYRNLDSRRSSRLSLQSMVIATGEMGEQDGATSIEAASELATPRPLDRNPNAGLEEIGMTFGTVLWSAPTPSRASQGIASPGFNDMRSPYAQTLELDDLQERDHSTSDPLRKRASYNAFGLSPRASSQPSKRPRLVE

SEQ ID NO: 3730 - protein, 897 aa, Unknown
  Kingdom: Fungi, Phylum: Ascomycota
MYWSVTLAVTLLGYIVAASDNDQTQPTRNSFIIEYDPTSAARINTLASDDSNDIKVVKSFNSDVFTGASVQSETYNIDSLQQLPGVKRVWRNTFIALSPPAPDFIPDDVAAREYSSHNNTGVSKLHDKGYFGKGVKVGVVDTGTAWDHPALGGCFGDGCKVAGGYDLVGDGTWPSGPQLPDDDPMDYSGHGTHVAGIIAGKSEYWTGVAPEASIYSYKVFTAGGGTTEEILIEAFIRAYEDDCDIITASVGGPSGWGDGPWALVSSRLVDRGIVVTISAGNSGDNGAFFGSNGSSGKGVIAVASVETEVFPASPFEATFTTGAGEEETVQLGYLPSTNYFPPSVKDWPIVPMNPDIVDNDGCEPYPDDTPRLGDVIPLVRRGTCTFEIKARNLEALGAKYTLFYNNENPIITPGTDFVVLDSLIAMITAAAGEEILKTVKAGGKVTADFSGNPESIVGLEYPAGGRPNTFTSWGGTNDLQLKPEIAAPGGQIFSTWPEGQYALLSGTSMACPYVAGVAALYIGAHGGRKVHGSGFAHMLRKRIIASGTALPWSDGTALDYNFSAPAAQVGSGLVNAYKVLEYSTFLDFDPIALNDTRYFNRYHDVTVTNEGDDTLSYQFSLAPAAGIEAAGNFTLTPAISDRRLKSRKEMVPINLVPTVYLPKVFSLTPGQSKTVSVNFDNPDKLGWKPENLPLYSGNVLVQASNGEQLAVPYLGLGADLKSQLRTNYRATYPFSKSGVRIEDIKDKSWYTFDLALNSQDFPKIYAKLIWGTRQVRWDIFDTTYKEHEWSYPPVQGENGYIGTVASWVGAGQINYFDPRRADPNETFSFPEYNLFRNAQLSNAYHEFWWFGKLGNGSQIDNGKYKMRFATLRPFGDPKMSDAWDIFKTPEIEVRGKY

SEQ ID NO: 3731 - protein, 644 aa, Unknown
  Kingdom: Fungi, Phylum: Ascomycota
MPPNAPEHRPSLQGHRLWSGLSILSKRSFRSFTTSSFEADDERSFSDEDDDMSDPGSRDERSVPAPLYLGQDSRPTSRKELLGWYAYAFAAETYIICGIASFIPILLESLARENGVLLDDPTKKCGASEDKNSSNSPCVVYVLGIEINTASFAMYTFSISVLLQAILVVSISCAADHGNYRKKLLLMFAWIGSASVMSYIFISKETYLLGALLTIISNTSFGASFVLLNSFLPLLVRNHPEVIAARGTSTPDLGRSDLESRSMEITPPDSDSSMNNSTSALLSDDIPNNGFVTSARNGRIAISDDVTSKELQLSTQISAKGIGIGYSAGLFVQCLAIGILILMNNTTWSQRIALFFVGVWWTVFTIPAAMWLRPRPGPPLAQHGKGTLAWVQYFIFAWKSLFKTVMVARRLLDVMLFLASWFLLSDAIATTSSTAILFAKTTLHMKPAALVLISVISTTFGVLGAFGWSYVSRVFGLRPHQTILVCIGMFELIPLYGLLGYLPFVQAWGVGGLQQAWEMYPLAAVYGLVLGGLSSYCRSLYGELIPPGSEAAFYALYAITDKGSSVFGPAIVGAIIDRTGNIRPAFWFLAVLVGLPAPIVWFVNVERGKREGEKLAGGVGIEVAHEPSDVHSERETRGMLADYD

SEQ ID NO: 3732 - protein, 1074 aa, Unknown
  Kingdom: Fungi, Phylum: Ascomycota
MPVTGRRNRHSLPAWTTTDEQDTTPVTASSTARAPSSNWINANAGNIYYRPRNHVDRHRRSAASHTAQLPAPLIGPRRTRPHSIHILTYPSGYVPRELRPKASQSLRRRTPASSSGSNQTKTSKSRARRDTRDQQKNQARAQKAGRDKSPIRPALHKLLSTFTNRETPQVASLPRSRPSSTLIDSIPESIPESSSFSPTTSTDTVGIHPASSPAVNHSSTIAGVPLARSATTPALTSISGELGRVTTGGAQRHIPAERPADDVVGLALSPGANNAYHHYHQEEPAYSHGEHLHHSALGCSYNSRPGQFQSLSTTDITSNTTHPASHEMAGRIAAPPSAYHLPHATRGNSLMSVRSAKSAVSSFVTEVPKPVASGSGVTCSILLAEPNVFLSGFDHDGNSQREGSSGTALLRGRLQLNVTKNIKIKAVQLKLLGRARTEWPEGIPPLKADLFEEQGLRTQVLTFYNAMNEGWESEYGNQCTYKLRNSSANNSSTNLPAGPPMHRPGPSATSSPVSSTRHATTAKDLKRLSLQNNQSRSFQKGDSPIASSTQVKGYKVFYPGTYDYNFELPIDHHQLETTKLQYGSVKWELHATIERAGAFKPNLHGVKEVSIVRVPDQMSLEMTEPISISRQWEDQLHYDIIISGKSFPIGSKIPVAFKLTPLAKVQVHKLKVFLTESIEYWTNDKRVTRKDPGRKILLLEKSAGKPLDPQWASSDMRTIRGGELSRDERNQARNTAARRRSMEASRNRTSPEALPAATDNILGDLDLGLESLWGSTEIEANVQMPTCEMMAKNKDLRLHPDCSWKNVNVYHWIKIVMRISRLDPEDPTGQKRRHFEISIDSPFTVLNCRATQANTVLPAYSGSQSAPSPYQAVCGCPDAHSVPTDHSPNSSSGALPNLDGGADMPAPPQAAHLSNNHPMNPASGTQSPPNASTDTLHNGARPMHLLRAPSYNPPAFEDDTAPPPLPELVATNPDAANAPFTTPPPQYDVVVGTPSVDGLADYFTRLAGHRFEGDDSGSDSDESPPRLLERTGRVNVAHPHTPGGRMPSRSLEIARPTIQLDMNSLVSHTRPTAA

SEQ ID NO: 3733 - protein, 531 aa, Unknown
  Kingdom: Fungi, Phylum: Ascomycota
MSNLQHVPTHTSVHGHLRQRFSVLSTMAMAFAILNTWIALAGSIGLVLSSGGSTALLYGFIFCVLCNFALAASLGEMAAIWPTAGGQYHFVYAICTDRWRRPMSFLTGWANIFGWLSVITVQAFFAAQFICAAAVIASYEEFVITQPKTYGIFMAVLVFGTIVNIWGNRILELWSKAALYWSIFGVVIISIVLLAMSPKTTADFVFTEFNNETGWPDGMAWLLGLLQPALSLIGFDVVMHMAEEMPRPSKDMPRAMIYAVAIGGVTGTIFILVTLFCFWDPATLLASATGIPTAELILQATKSRAGATILNLMLAICFINGTVASITSTSRLMWCMARDNGIFFARTFAKIKYSLDVPVYTILACSIFNALFGLLYLGPTVAFTAYMSSCTIFLNVSYAMPVICLLIRGRSELAKSRYPGVPHQLGKWGWTVNIVAALFVIMTTVLFSFPPALPVTSSNMNYVTAVFGIFLVFVSAFWLVYGSHFTGPDFDSIFSHSRAMMQDGASHATDSPAPENSKEEEMVKGSHLSNV

SEQ ID NO: 3734 - protein, 319 aa, Unknown
  Kingdom: Fungi, Phylum: Ascomycota
MLLLDYQNVLIQSVLNERFSGAPPASIDQTVSDFDGVTFHISTPETKTKILLSIQIRCFQDLVEHGANEVLLREYGSYAVDTEPGYDFSVMVDLESLPESKEEREALALKFALLKRNAMAAPFEAAYNEHYKLREEASKFSSEDAPQGVREGGQVKAIHYREEEAIYVKASHDRVTVIFSTVFREETDRIYGKVFIQEFVDARRRAIQNAPQVLFRNDPPLELQGVPGVKSTTTGEIGYVTFVLFPRHLTPQRMPEVISHIQTFRDYFHYHIKASKAYIHSRMRKRTADFLQVLRRARPENEEKERKTASGRTFKVSSS

SEQ ID NO: 3735 - protein, 478 aa, Unknown
  Kingdom: Fungi, Phylum: Ascomycota
MANDATSGPTRPQLGGMRSSSYLSDHQQYRPPHRSPEGFHGIDTVVEDRNVSSHAPSPKPIMPFNGIPSEDNPPTIVDSGVNHDYSHPNCAPHQGEKTDKLIATLFYKTKERTALAKAASTGSLGATRTGDSNEHLPANMAPTTDMDAFPLEPPTHENESLDHLYGNYISPLCITSFLHLMSTFPMPHDGDEPHSSHRCLDNPENPRVVELTLSPAPRADYLSLQDLRKHEMIYRFEQEWNVDVVLQKESILRRHPRLVVFDMDSTLITQEVIDLLAENIMDPPDLAARVADITNAAMRGELDFEASFRQRLALLKGLPDTTFNALRQVLDVTKGVPELIRALKRLGVKTAVLSGGFLPLTSWLAGELGIDHAHANEVITEGGRLTGEAKGTIVGKERKQELLIEIAAQEKIDIKQTVAVGDGANDLLMLGTAGLGVAWNAKPRVQMEASARLNGESLLDLLYLFGFTSEEIDELIAA

SEQ ID NO: 3736 - protein, 549 aa, Unknown
  Kingdom: Fungi, Phylum: Ascomycota
MAGGIIKKPVNIFKLSDVDEPKGVFNWRLWFAVFSFGMMGAARGIDEGLISGAFKSENFQESINYDSYTTVEKANIKANVSAMVQIGCVGGALIAFLICDKIGRIWATRQLCIVWIVGIVIFMANGGNLGAIYAGRFIAGLGVGQTAVVGPVYLAEIAPAAVRGLCTCVFSGFVYLGIVLAYFANYGASRHMGEEAKARWLVPTSVHLMFAGIILVLSLFQNESPRFLIKKGKSEEATKVLARLRQQPEDSDYIIREISAIQFAHEHELESVNNSFLGSCKELFLNGSNLYRLYLASMVQILAQWSGAGSITLYAVDLFALLGIKGSETGLLVTALFGIIKLIAAISCALFLVDVIGRKRALIGGIALQAIAMIYIAAFLTAVPEPNGTSAAARGAVAMIYISGIGWALGWNTMSYILTAELFPLRIRALATSFAMTLHFLCQYGSTRATPNMLLPTAEGGINPNGTFWCYGAILIVGLIWVVVSVPETAGRSLESMDRLFELPWYKIGLFGNRDAEQKDIAYNEKGQMMENTQGQVTYVEGKPTAERV

SEQ ID NO: 3737 - protein, 1095 aa, Unknown
  Kingdom: Fungi, Phylum: Ascomycota
MSKEHNGDAPRLTVPKFASFKKKQPPILPTDASSHEPSQKPKDISKDHRRDRHQSKRPRDEDTSQPGEGHTRRDRSKYSQRESKSHPRVPASQRPAELEYPGHPHISSLNGGDGQEDVYTIDTKGDPLLRKYGNNVHYHVPSSFRYPPGRVLGAEGRLYIHRDGTREHFSILQPGDRVESSRQTDALRSRWPRAHPNPTRLKSQTVHAEEEDADMPFIQIRKLKKRTRASSSSSESSSNGQDLAYRSIEGKMKVKPASEDDESEEDSDVAIDIHQDNPLRWLSVQLSRQVKEHPEDIDAWLELVAHQDTLKNAGHRIDQSLLEDEMRSYAEIKVSMLESALSHAKVGNDRTRVLVLLMKEGSIVWDRKTAAKRWAELSAEERQSFELWKTHLDFQLSDVASFQYEDLKSLLIARLKYLLTGESTAESTQARIEEAIYVFTRLTRMIADAGYRELALSAWQALFELNFCCPATHDSANSSLESFQEFWESEVPRFGEAGSQGWRNFVESNGANEPPEPGAAPTSGGDSISRDPYKLWAALEERLGSDARVPARTLDEGNDDDPFRVVIFADIEQMIFFVPPGILKHVAGQLLDSFLLYSGLPTAANSSSWTELVSRDPHIVIGAGALQNDKIGTQPSLDDDDDMSRRSPLFRGRMLACSLVLDVLLPGQAWFQYLPTHNPNGLVPWELIGRVLKQVEHLGWVDHLGNYLLAFTQSFDPTSTRKQAKALLKQHPTSIVLYIAYALAEYSNGKDDIVQTTLGSAADMSSGRDLASVVRSWAWVELERQKKLASLRVLCSTTDPQLRKMADDATSVPSSQVIKTSQLYESEVYTALSAGSSEAVALYGECALLLSYLTSTDSTEPSSSAQGGIEAAMGMVLRLSGELGRRSMQHSSGHEQLLQAAARVLYWHASNGPFRRNYMREYLTAFAEIFPQNIIFLSLLEWADSGLRVIDETRQLLQDKSLTPAEDCLSSRVFAIQHEIERGNVNSARAAFENAVASEACRASPVIWRWYIQYSYTHRSLRSKAKEIFYRAIRHCPWSKEVMMQAFTTLIRVMESDELKAVYETMSSKGLRIHVELDEFLREHELKRSRERRAR

SEQ ID NO: 3738 - protein, 440 aa, Unknown
  Kingdom: Fungi, Phylum: Ascomycota
MAPTRQQPPPLYSKDEKVLCFHGELLYEAKIMDVQAGDKSGDGEAWDYKVHYKGWKKTWDDWVGKDRIRPFDDEHKELAAQLHAQAKRSMQATAKQTTKTSKVGNDSTRGSEERGSAAVQGGRGGRRGKDWELEQCTCSFFAICFCLTSLYDPRYIPTFHFCNMGVPHAHPTVRIAQPAIAPDHLTKLPKPRHQYVSATGRILFDDRYAPTLTKVRKLLRGYHATPGSEPNSKPSSAITGWRGQPGQPEDWTLQEDAFHSKPMINLPVPDHVQAMLVDDWENITKNNQLVPLPHPKPVSKIFQDYLAYEAPRREEGSASMDILEEVIAGFREYFEKALSRILLYRFERHQYMDVRKLWDNADEKSEYKSVCDVYGAEHLARLIVSLPELLAQTNMDQQSVSRLREEVSKFTSWLGRNTETYFVSEYETPSQEYVDKARSF

SEQ ID NO: 3739 - protein, 496 aa, Unknown
  Kingdom: Fungi, Phylum: Ascomycota
MSHATASDLHGRNSAETEMAMLCQKCRQPLKLDGSLEDLNPAAYDLLLGSSTPKSSPKTSSPSSSRSPIPHTQESARKSLYSQASQNAVAPTFKRQSAGAPRDSTMSFIYLTESVMGAPASQLRDTPATPTKMRRANSSKGVDDQETPRGDEVDRMNRLFEILSARSDIDHPVCIECTDMLVDGLQKKLDAANRERNMYVAHLKEIQTTQPTAAELKQQEASLKKAEADKASALEELRKLEAEKDAVDAEILALEEESRQVDKEEEGFWREHNNFVSEMAEFRAERDSVVVKYANDMQMLDKLTRTNVYNDTFCISHDGTFATINGLRLGRMSSKPVDWPEINAAWGHALLLIVTVADKLGYKFQGYDPQPLGSTSKIIKYETVSPASSRLTSHRGPGPPPKKHILELYSSGDMPLGLTFMHRKFDNAMVGFLELVRQLGSFVQAETEARGKMLGLPYAIEGDKIGDVSIKLGIAQDDGWTKACKLTLTCFLYAIP

SEQ ID NO: 3740 - protein, 659 aa, Unknown
  Kingdom: Fungi, Phylum: Ascomycota
  misc_feature (425)..(425): Xaa can be any naturally occurring amino acid
MASSILAAALLISGAFAQQSQWGQCGGVGWSGPTTCTSGNTCTKQNDYYYQCIPGGSGGSPTTSSQPPTQTGGNGGGSTGKTQYFGVNIAGFDFGCATNGNCDTTKIYPPVRDFNGANNYPDGVGQMKHFHDDLGMNFFRLPVGWQYLVNNQLGGTLNSNNLAQYDKLVQGCRSISGAQCIIDIHNYARWNGGIIGQGGPSDDQFVSLWRQLATKYASQTNVWFGIMNEPHDVNINTWAQTVQKVVTAIRQAGATNYITLPGNDWQSAGAFISGGSAAALSQVKNPDGSYDKLIIDVHKYLDSDNSGTTTTCVTNNIDNAFAPLANWLRQNGRKAILTESGGGNTDSCLRYFCEQIKYLNQNSDVYFGYTGWSAGSFDSTYELVLTPTWNGNGWTDRLDSMLRFDHWERASDSHAANDASLRFGXMYLPDTVSLIAGLLSLAAVVKASPVPGIEGRINSARADTACSRRDVQLVSKLVKLSSKPQDLCANFLPQQTKPTRPPIQKASTKSARDLEHLEHRAFKLPTALKNYGTALITQSCKCLYPSREETPTPVVITVMETVSGFPSDFPCIYSLGYTSLLLTNQASTDNYRDAGLECQENCRLDSQCKYAWLGRLIENNIHYLRCYKDSAAYSSSLEQCTDSGAFSAIAGYNKVERTT

SEQ ID NO: 3741 - protein, 429 aa, Unknown
  Kingdom: Fungi, Phylum: Ascomycota
MQPSHNPKPGTTPHIIDQHRHHLHHDCAVTHLHRPTNKNLYNINFVVMAERIVPDMDTLPITGLTELLAHLDELDNDATTPIQPKLFDDVELQLTDANSSAILPTLLPRLTALLFHLTTQNPSPLLSLLIKLLAPIPFQRILPLTTPDALLLALQSPLPGANILALSILQKAAASTEDVKVLVQLWGALIGEVVSLWVGTGDVGVAEKAEKVLREWLEMDCEVVIRTPEAVNGVNGFSGGSALARQRSRLSTPGEGIIWRLLFENLDNLTRIIANCTLSLPESITSALPPGSSTRPQNDITLSQGRLLRLLPQLVVLNSQPLITTHSALFESFGVTSTNLLSWAALEMVDTGDILMRLMIVDFFETLVSVARVAQHQGPEKDEVVRQLIGEARGRPWGDEVRAALVTLPDRTVEEEAEALREYLKDILN

SEQ ID NO: 3742 - protein, 578 aa, Unknown
  Kingdom: Fungi, Phylum: Ascomycota
MSASGQNNVDLDALLDLTEYDAVSNYQSPSLSPTSTSKPTFASPITTAVPTPTISSSQQAMSGPSHNYELYRQQTGFVPGAIANTMAVNQTNNTGYQDYNSLNYLSSFTPEDNVFDFNTSPSQATLGGSDLDMDFDSPSDTQNFFSTINPSTIEQDASAITSPSSAHTQTSNVGRLWPGAHSQAAMAKAQAQQRQQMMQQHQQQQRQSSQQPQKARGKAPQQTDPLVEQKITQLLNSMRAKPSDPDALNQANMGNLPRAKKEDDEMDEDERLLASEEGKKLSSKERRQLRNKVSARAFRSRRKEYITQLEAEIATKVNENGELKTQNRALADENKRLQELTRMLLSSSSFSTFLEDLSTNPAALPLAPQQIKIEEPQQPQTSQQQRQLPKDVNAFGAQPSQQQIGMAMIPEQTMDFSMLSLDNNFNFQPQVFVVDTPEIPAPIDTAALSGKACNLVDETFESEEKMDAPVIERLAALPEAVVSHAAPVDEEFESDPDFALFHSESASTSSATKAADADDLSGLDLFGGIASEKTMSRYEMVDACEEESSAAIALARVQRISDNIESVVSRLELLTMDL

SEQ ID NO: 3743 - protein, 902 aa, Unknown
  Kingdom: Fungi, Phylum: Ascomycota
MAAQDILFFDAYDSFTYNIVSLLAEILPLGPDAQIVVQSLHDPVPGYNQTASEINDDEFAQFLRGFSAVICGPGPGSPLNPQDVGPFTRIWSLSDENMIPVLGICLGFQSLVSHFGGQIRKLKLGQHGIVRPIEHRGGETSSTTPKDIFESVPPFKATLYHSLCADIGQDGICEEDWPAAKWETFTGIQDLQPLAWTTVDLPDASERVLMGVKHMSKPFWALQYHPESICTEDASRLVLKNWFDEAMAWSKQARRISQVVERSGSHSGHGTLPMAIEERIASQASPSATHDGLLFADDWLKQNRPELASTAPTDYVCYEMDVPAGVDAATIVEILGETTGSRIVLDASSARVKDPLAVQSIIAIDVDNAIRFEHVAKECSSVRMHVPKSSQAPSQPVDLTLTADIQAWELISHFWSARHHSEDELRAQVQGVSHKHFKGGFMGYLSYEMGLQTVSPELARTARSDDHADLCLAWVTHSIVLDHKARKAYVQAWGPRCEITAWAQSTMERLENGIQNGSAPSSASSTSINAKDSSRIRFRTPDPAEYEKKVRRCQAEIAEGNSYELCLTDQTVMTRPAPEIGSQRAKLQANGNGARTNGLSNGVHNGKASLNGHDSTNGNHDRNGAEPIAVQGGIHFVQDEHHRSAWNIYKTLRTRQPAPFGSFIKLGGATLLSSSPERFLQYDSKGLCSMRPMKGTVRKSKAVSTLADAERMLRIPKEIAENLMIVDLVCHDLHRVCGYGQVTVPEPFKIEEYATVFTMVTGIQGQLNRYITDAKLQGSAPVAMTGLDVLRSVFPPGSMTGAPKKRSCELLAEIEQHKPRGLYSGVVGYMDVTGAGDWSVTIRSMFHYDDEMEEPDAGESTPRELWRIGAGGAVTILSTPEGEREEMFTKLDGPLGVFRDVA

SEQ ID NO: 3744 - protein, 292 aa, Unknown
  Kingdom: Fungi, Phylum: Ascomycota
MRIPKSQSLRPSIPLRIISFNIRYATETPVLGEQPWAVRGPKLCRQLIFTTEGHDSPFICLQEVLHSQVQDIQERLGDSWSHIGRGRDEKATDGEFSPVFYRSDTWKCIKNDTKWLSDTPDKPSKGWDGVLNRIVTMGLFIHKHNGVAVIVMSTHFDHIGVKARENSARLLIKFAEEWNQSPDDGHVGPTAVLIGGDFNSDPTDGAYKLMTAKGSGMSDVADLVPEREHYGNYITYTSFGEPGEVPKRIDFLFIKEPRYATVRTFGVLANSFDDNIRLSDHRAVVADLSVPT

SEQ ID NO: 3745 - protein, 922 aa, Unknown
  Kingdom: Fungi, Phylum: Ascomycota
MDNFAGTVGQGNSSSGFSTGLPNWPAASSIMDHNSSSENVRPTKKKTTTRRRAGSAAGKRRCISTACIACRKRKSKCDGALPSCAACASVYGTECIYDPNSDHRRKGVYREKVDSMKARSSTLQILIEAILNAAEDDVPAIVSRIRTCDSLDTVAEQLINQQQEAEREEEAAAAGNRPEEQPDRGDLTEEGEIELARKMGELRMENGNVRFIGGTSHLIYLGEPTDSLNDDLDTGDYSADDDPITTWTRVTKDPQVIKHLMQMYLNYHYPYFTTLSKTMFWRDYSRGKAGLAGQTGTIYCSSLLVNVMLALGCHFTDIPEAYSVPGDNRTKGDHFFAEAKRLILENDEFARPRLVTVQALALMSVHEAGCAREAKGWVYSGMSFRMAQDIGLNLEVSGLDKERMSEHEIDARKITFWGCFLFDKCWSNYLGRLPQLPGNSYSVSKLDVFPQEDSEPWQHYTDSGFDNRDQQPPQPARTRAAALQLSALCEISSDLLIFFYHPNHIGRSSGKAVELKKLSELHRRLEEWRQNLPQEFEPRDGQLPNVILMHMFFHLQYIHLFRPFLKYHPASSPLPSHVSPRRICTANAGAISKLARLYKKSWDLRQICNIAVYMLHSACTIHLLNLNMEKTARRDITHGVRHLEEIAEDWPCARRTLAILSVLARKWRCELPAEAAVVLQRADEKFGEYNLSEVPSPHSQSVPSPESTERNGSGATMMPRENSPLMQYAQSQLNQAAAPSSIGDRLSMAGSINNMGNMPVSRPGVLDTTSPTTALDSFAPDWRSQPPAPPSQMQDFPVGYTPGQPQQRQQRQQQQQIPPLAPVPLALNMDSQDWFLNDSARWQQSFETWNAGPGANSPVFVFNDRVASASPASSGSHAGGGANGGHATAGAGAVSGEANMGAYGFEGLGMSLQDGGWLPELD

SEQ ID NO: 3746 - protein, 838 aa, Unknown
  Kingdom: Fungi, Phylum: Ascomycota
METPDPDLQSHRVVDHSSPFKGIVVCCTSIPPEARTNVALRVVELGGIHKYDLTPDVTHLIVGNYDTDKYRHVARERPDIKAMDADWIVAVAELWRNGEDDFDLDALESKHQLKPLERRGSMPESLTGDGSPRQGLLISLTGFGEARDAIAEKITSNGATYTPDLTKQCTHLIVCQPEGKKFTAAKQWGVHTVSVQWLDESIKRGLILEELKFDPQLPLEDQGRGAVVSKEPRRDPSGKRSRSGPAGPNEEGNGPRKLRKTASMKLNSQRDGLWGDILKRPDTVDKPIDAETKAKEAISDETASGMPPSKVMPQHLSHSTGQGIFTNCIFYIHGFPSQRAQILQQTTSSLGGSTTSSIDTLGSWKSPSHPSFRFLIVPQTSQPETHPVLPNDDIHIITEFYIEKCLHNKQFFDPRHHVIGRPFPVFPIPDLAPMTICTAAFTGIELSQVARSVTQLGATFSEEFRPSVSVLVCRSLIATRKEKLKCALAWGVTVVSAEWLWECISTGCRVPLADFTFTELKKRRSLAGEDQQQLSSDSSGPRNKHGSSVSLPPTAPALAPAKVISAKTTGVDRSGFDADGTTKQAARGDGQSRAIGRTIKLDSTTSADFHTARTNLLQTRDTDSTLTELSSASLNKSPSPTKYDAHAEPLRTKSDPTPRQQENPATNRAPSAPPADTAPSDELEDDAARAQVAQHQALLTSRLASLVDTSASIGSASFHASADDPKPRRRQLLGRATSNVSAASSNANVTAAAIPSGGVDAFGVENDTAATSDVEGHAGDAQDQGHPGTQLAYGDPEAQGVKAQIISRMAGEATNGRTRNHNGGQTTTVGGRALRKRE

SEQ ID NO: 3747 - protein, 323 aa, Unknown
  Kingdom: Fungi, Phylum: Ascomycota
MSATTTQTMQGDPRAPAGIEGLQRHGYLFGQHLANSYSPYLHDVIYSNLGLPWGQVRLDSSDMNLFLDLVQHPDFYGASVTMPNKVAIIPHLDEMTDECRDTGACNTLYIREDPATGRRKLCGAQTDVIGIRDSFVYNVQDLPQVVHNKPALVIGGGGAARSAVYALRKWLKVTDIYLVNRDPAEVDAVVQDCRRQGYGDGLVHVASAEQAKSLAGPGAIVACVPDFEPTTTEEKLAREITNIFLDKSKGAMLEMCYNPTPFTKLGGLAESKGWQVILGTEALIWQGIEQDRYWTGKSVEELPVEEVKLAIANKVAQSSKQKL

SEQ ID NO: 3748 - protein, 211 aa, Unknown
  Kingdom: Fungi, Phylum: Ascomycota
MAASTQSSGKTFIVEHLDPELGPWSELEYLAIGNEARDTGGKFILSCLPDGFQVPEGLKTNAAFTAEQRGVEELYAANKDRVCLLDPAAAKDLSPEDAETFDAFLFGGILGDDPPRDRTSELRKKGYEGRRLGPKQMTTDTAVRVTRIVVQDKIALDKVPYVDFPELKFSKYESTEMPFRYVTDDKGEPILPAGMRELIQKDADKSVNDLF

SEQ ID NO: 3749 - protein, 544 aa, Unknown
  Kingdom: Fungi, Phylum: Ascomycota
MSNITIVPVVVSQDPLVLYWPSDGPNTTPALTANLVCRVVFGFIASVVCLVPLRLLHKNGEFAATVFITTAVFKNLITIVSALIWHDNNMESWWPGYGLCDVLPYFQHFIFLLFITCLLAIMRNVAHQVGLLRANPLTAKEKRRRNLVQALIMFPFPILQVILTWFLTYQRFVVGTLVGCSWTGYPTWTYIVFFLIPAPVAATITTGYAILTWIRFRELSKTTGAALSSSRRANNRAQRTRRRLYLMVVVIIIPFFPIVLTLMVLNILDLKELKPYDYDAIHHHTEPLPWNTIVYLRAEDLGFAYLNVSWIPILSCIPIFGFFGTTKDAMNDYRRLLLFFGLGKIFPRLYQEYDPDRRAEGSSYGSSNMASTTTGAGKSPHKVISLTSSFRMLTKNSSSNGKSAGHELRSMDHITSHDTESGIRSLDRAATNPSDHVVEIPHRKPWLMRTHLNFPIIPFPFSRKTKEQDHVNSPSQVSLNHISTPPGQTSPPIRTRVWHDEHGDGRNADRGDDNDDDARSVASAQGVVVETQLVHESHPSNMHR

SEQ ID NO: 3750 - protein, 1434 aa, Unknown
  Kingdom: Fungi, Phylum: Ascomycota
MPSAGGNKSGSPMIAGSAMSGSGFSDLPDDEILSTGLFDFENSPDTLQTFGSANSVGSKMFISPQELQTAESLPDSPNGSGQDSSSESAPSVKRDGSSVHSPQNMTNEGGMGIGSDFDGAMDWDSGDFADHGHGHDDYNTFNFGQGTTSPRMDDVYPFGADDTFLNSSFDMSAADDGMTSGAVTAMPSPGMPTIESDNRSNIKTETPKKAPVRAKKPKKKPTQPQTQPQQPKSTVSAIPRGTQAPESREISPMSQVMGSDNGIQQTAMQTSPVNAIADFTNSMPNGANGWMPNMNPGHFSVARDLPYHNGLNGQPGMSAPNMNRLYQNPPYPPGYVFSNGPYELLIFTRPTKSRVETQIPISMILNPLPPGIRRLHLPTHKISKPKLLAKPPVAPSPDMLELHVSLVCTTAMEKPKMQEKALKRAREAPHKYLPREDEELKPQEGDEVFICKGCIMRERKRAGRKKIKHVADELMWTQDEQHRAIVFNTKEVQVWEPLENLFDSEVPVETGLPHGTMQCSIPLRIACYCRHHGEKSGFKVIFTLKDWEGNTIAQTMSRSIMITDDHKTHAADKDKTLTAGSKRGLSDHIAAANANIPSNGFAASAGPATQQPVVNANLNAMPPNMPINFQTSPSQVTAQSTAISRPQSTPNSPGQGGPSTKKRKSSGGSRVPNDLTMTRLETSVSPGPTGPGSQISTAASPFSPNMNPFPTGDQLFGQPGPLTTGPPTPNNNDQIPFFGAHRSGSMDNLTMAQLYSAPTSNHPSRAPSPNGLRNAMGGAAQPQLGQAVSNSLNNMYNMPMNMSQARPPPTIHKIVPAEGPTSGGIDVTILGSSFFSGLEVWFGEQKATTTTYWGEPSLVCLLPPSAVAGMVPVILKNQMGQVVQTLGRTPQMFRYLDDNEDKLIRTALSVLGHKMSGQMMDVSELARRILDNSGSSNWGGNSGGQSSGSGPAFNQASREHLESQLLKCLDLIDLDDSPHRTFLDLKSETGHTMLHLASSLGYHRFVAALLARGANPNARDLGGFTPLHMAAMRDHPEIVRRLMLAGASPSAKSLSKLKVADVAKSRSVVRAIQKSVRHTRSRSGGSLHSRASSTSSLRSLWEPITKIRTHDGIHDGPTSPDSSDESPEYSTSDYDDDDEQSDEPQEFLHMRRPSGFHADADKPHPDELNEGLPSPTMNAMTAAFKDHLQQQFHQFQQSMTLHFQNLPHLPQMPQMPQMPQMPNFPNMPVLPDYQAYLQQRPFMRKMTQLMPGKPGSRPDSQDSDSSKADNKWWTLSSYMNNHGALPPAYEDIFPHEARDTKHLSAAQAATEAAADQKCSQQFDHDSSATVEVSTKVQVPSVLKIGRKDAITREQQEQFLEAQKQKYKRLSNDRNLFFIWIPLLLIMVCAMLYNYCPSLFTTAFSFILMALDKGISQANRLLSRLEDRAAASITA

SEQ ID NO: 3751 - protein, 807 aa, Unknown
  Kingdom: Fungi, Phylum: Ascomycota
MAADNAKDPAEYNLAIERLHAVYLDHAGTTLPSRTLLESFSREITTTLYGNPHSASWPSQLSTSRIEDVRLELLSFFGADPSQFDLVFVANATAGIKLVVDALRSMPNGFGLIHHEASHTSVVGAREEASWTRCVKDEDVSTWLAESGGLKGADKDLGATLFAYPAQSHFDGKRYPMAWSDDARRASSSRVYTLLDASSFCATSQLDLSLSDSTPDFVVLSLYKIFGFPDLGILLVRKSAEDAFLHRRYFGGGTVDMVVCGDQQWHASKSQNLHERLEDGTLPFHNIIAAGIAIETHKSMFGTMSRISSHTSRLAGHLREELAQLKHMNGLSACVQYGANNEDDSLGTGPIVTFNLCDSAGTWVSLSEFEKLANLKKMYVRTGGMCSPGGIASALGLKPWEMRRNFSAGFRCGAEDDIVAGKPTGAIRASLGPMSTMSDVTLFLEFLTEFYVDQRSHLDADLLGAASREAIDEHPLRVKSITIFPIKSCGGYSIPKEAEWEVKPEGLAWDREWCLVHRGSGQALSQKRYPMMALLRPKLDFDAGNLRVYFSNRMEGRETMISIPLTEDPNLFESAQSESTARVCGEPVTMMRYASNKINDFFSEALGVPCVLCRFPAGGRGTASRASKARIQSHQRKRVARLPGTFPGVPSPPDSDTELQQPGNILLSNESPILMISTTSVAELNRHITDSGGTAVPDSTFRANIVLEPSETGPGVSGYAEDQWHTIDIGQERFELLGACRRCQMVCVDQERGQRGQEPLSTLAKTRRFDGKVYFGVHMRHMPLKQAIGKPLPLIKVGDIVGIDSQR

SEQ ID NO: 3752 - protein, 484 aa, Unknown
  Kingdom: Fungi, Phylum: Ascomycota
MSEPKKQWCDGPYKLISSSRAGEKTGDKWSGPQAMAREMIIVHNLMIRGINCVHRQALRVSNEGTAQDKLDFANFAFQWSRTLHHHHDLEETVLFPRFAKEAGEPDLMTGPLAEHREFDEGLERYEAYLTEVKEGREELDGEKLLAIVDEVMPVIHRHLSNEIDTLLDLKRYEDKVDWMAIFEEVVGASASRDMKQSWYRTDLFPLVLHLHDKSFENGAFASFPPVPWIVVLVVEYFNDAYLQQEHLHCLKVLATPRIERDPADFLPSHLWSSLPSIDIYLSSLNFARSPNPATMGKSQSKLSQEQLAELQKSTHFDKKELQQWYKGFLKDCPSGTLTKEEFQKIYRQFFPFGDPSSFADYVFNVFDADKSGTIDFKEFICALSVTSRGKMEDKLDWAFQLYDIDGDGKISYDEMLQIVEAIYKMVGSMVKLPEDEDTPEKRVKKIFRMMDKDENGSLDMDEFKEGSKRDETIVSALSLYDGLV

SEQ ID NO: 3753 - protein, 1183 aa, Unknown
  Kingdom: Fungi, Phylum: Ascomycota
MAPASASPRHTPSSNGRRRGRPPGTTNAARAARQAALEAAMASEPPPKKRRYIPGGPGGGGRFVDADSDDTTPTVRAATASRPRAPRNSLNGSTPSVLPRRERSARTRSFAAEDAEDVQWGTAAAVAASVQQADDYKPREERGWEEFHPNLDIEGTFMVLTADEVDGTLPQEAPSTPMAQTPGTPLLGNGTPTRQADPASTNNTPNASQRSETNPFETSLATPTRRPRRLTRDVVSFHGTRGLDAISTPKTPKILPIQNQTPKERLDLKLPSYRKTNRIELFESKTFGQARYVDRAMSNAGYQESDSFPRPERNLLKAVEGNAEDDAVTTAPADTEEATHATRPVRVEYDMDEQDDMWLENYNAQRKQNELEAITREVFEITMTGIEKEWHALERRIPKPNPKPPQTHRPRSSSAAAVNGESREGEEPDSKCAICDDGDCENTNAIVFCDGCNLAVHQECYGVPFIPEGQWLCRKCQLCGRGIPTCIFCPNTDGAFKQTNSSKWAHLLCAMWIPEVSLGNHTFMEPVMDVEKVPKTRWKLSCYICHQKMGACIQCSNKNCYQAFHVTCARRAKLYLKMKTSHGALAVLDGSMVLKAFCDRHCPPDYTKENSVHQATRTAKKFYKRNMRGRIWADNHAMANVLAARHRNAVSEPALAEAQVSGTKLPAVTGDVKKSQPPKNVWKLPSGAPVIPQQVFEVVESSIQRFPFRKRKDYLSEACRYWTLKREARRGAALLKRLQLQMESFSSMELTRRNFAAMGPGGKQRLARRLEFAENLITDLDQLKALSDELVQREVIKLEAAELEQEFVDECYFPVAKVLGPAMDKAISLDKDVFSEALSKMQAQMEQRQYVTGLSFAQELGDAICAGITTPFEPPTDNGHHSSELADTSPVKGSFADIRERRKLGKRILKAVQPYVEIALQIEAEISNRSYGTLQAELEAIIEGSVEAKQNRPDSVLESAPADDVEMADVADHAHNNANQPGQDNPESMSVDQPDDPQDVAEEKHIDNDTAAVEEETDPREESQPDSATDDTRPLVTTQAADSQTPPGTNGAYVALARPDQAGPPTPPQSNGSLGKVSVDPLSEGGIFWHLKIFQPKGTSVLAEQWPGRDAIRMLSEDLTDLDDDELKGLGVDVDLRGAILTPADLDEDAGSSSAATGAKGKAGKVLSNTNAHQKRRTSARRR

SEQ ID NO: 3754 - protein, 334 aa, Unknown
  Kingdom: Fungi, Phylum: Ascomycota
MPGGVCAVLDYEVELMTEYVAEMATRVVSPDGNVTSSFRKFVSQILTSTRLPSTTILLGMNYLAKRINGMKSQGPYKASEGQVWRYLTVSLLLGSKFLDDNTFQNRSWSEVSGISVMELNRLEFDWVQAMSWRLYVNLDLSKDYQAWLENWREWQDMKKRQAAQASRDRLAAIVPAIDTELARYNSHHRQSPQSRYIQDQVAEYERYQTLKSQQHNYRSREAAWAHNPWNAPLTPPDSGYGTPEYGMSSATSANARYNDWFSQASTQQYASRYQQPCPPASFYPQRQNPYATQTHCSQGMWEHGLAECSCPNCIGSMKQAPYFVTQGYGQPVMG

SEQ ID NO: 3755 - protein, 552 aa, Unknown
  Kingdom: Fungi, Phylum: Ascomycota
MFPNGATRQTEAENGQNHSGEPTQAQLKARKACLNCRRQKVLASEALAAPGTDVPGVGLDAQQNGSLTSNILRRLQRLEDHLDLADYGDEDMNEDPTAVGAPEAKLPLEPQDDTLKPLWPSIRCLEQTCSAKVDPMIWAENRIKRLWTSFHDTMLGLHFLPSRQTFSSPTPLLLAAMLYCSSTRGSPEVAVLASGYFAVLCNAIGQLCIPGSLIGDQPDHPARAEEWAFQTILGIILAGLLREGVSRETGVWISIAYRLLLEHCPPDIGERSLEWQRLMTGLQIVDLEHASIHLACPVIPLTAPFPRLRVSPQDQLYRLSQMMHTGLTHFTGRGLPTIWSYFTNESPLAMDPSTTFSGVDAAVIRDWARQLDDWLAEFGARNSDPEGEEKLTFRQYVLHRALVLSIYLPARGSDLLSSTTPNEQHELLISARAALRLHLADSSIWSNFDLVIITWSALIIIQGVEGGFGEPDDLEVVNVHLSKLREIHGQGDSLQELLATRLEARLEALTTPAVLTTDQLDPDGGFDSSWAIFNQGSLQAGYDMFAYGVQPN

SEQ ID NO: 3756 - protein, 307 aa, Unknown
  Kingdom: Fungi, Phylum: Ascomycota
MSVPDSEYMSPVWRDGIFEGRVAFVTGGAGSICSMQTRALVRLGANACIIGRNVEKTEAAAKDIATARPGSKVIGIGGCDVRKPEDLQAAADRCAKELGGIDLVIAGAAGNFIVPLSQMSSNAFKTVLDIDTMGTFNTVKATMPHLLRSPCARMLFVSATFHYTGAPLQAHVSAAKAAVDSLSVSVALEYGPLGVRCNVIAPGGIKGTEGLARLGSADPESMRTYLDNVPLGRLGEMKDIADTTIFLFSDAGSYINGEAIVVDGAAWRRQSAIPLGVTHEAKYPHFLRTGDIAKDLKDPRKEKKSKL

SEQ ID NO: 3757 - protein, 140 aa, Unknown
  Kingdom: Fungi, Phylum: Ascomycota
MFRFRKTLDIITLFHKPSNPASTRVATLLKQASANAQTEATADQASDHSHQSPPSRDDFELNITEEAPTQDQVQTILEYIGQSNIQRVIKGAQDQKDALRKFKENNDSFQRPITVDWNNGKAVIGENESEILKLVKASQQ

SEQ ID NO: 3758 - protein, 127 aa, Unknown
  Kingdom: Fungi, Phylum: Ascomycota
MPIINQASLLPDSYKDLPVVAGKPLLVFFAASEDPRTGESWCPDVRAALPVLQATFSAEDQPSLTYIKVGQRTEYRTPDNVFRSSKWNVPNVPTLARYERLDGEVKEVGRLIEEEILDKERFRQLIA

SEQ ID NO: 3759 - protein, 625 aa, Unknown
  Kingdom: Fungi, Phylum: Ascomycota
MPSTKGPIRVAGASGGYTDRQRAIHDLAKECDVDVITGDWMAEGTMVMHGVNKSKKLADPKAAAGPCYDPYFLGTLDPALPVLQEKGVKLAVNAGASDPALLAKEIADRVKERGLTLKVAYIEGDECIDQIRELRKKGDPLRNLDTDKSIEDWGFEPIYAQCYLGSFGIAEALRRGADIVVAGRVADAAPTVGAAIWWHGWDRSNLDELAGALMAGHIIECSAYATGGYYAGFKNLMENCENLGFPIASIEATGETVFTKGAGPGGEMSVGTATSQLLYEIQGPAYFNSDVVADIENLSLAQIGENEVRMTGVKGLPPPPTTKVGLTSETGKLWQAEFHFFFVGLDIEEKAKWTEKQIRYAMRDHIHKFTQLKFHTVGSAGPDADSQDAATVDFRVFAQTKDPSIVGAGGGPAGTGLGTMTTGTFVRWCLENFLQSCPGATVEVDTRQSMARPMLEYWPTIMPQDLFQERAVMEWSGEAVDIPGPTETREYGPQKSYAATNPVDLSSFGPTTRKPLGYVVLGRSGDKASDANVGFFVRNDDEWDWLRTVLSTETFIKLLGKEYTGNRIDRCEFPGVKAVHFLLKDHLDRGSVSSSSMDPFGKNLCEYIRARYIDIPDKFLERGRV

SEQ ID NO: 3760 - protein, 673 aa, Unknown
  Kingdom: Fungi, Phylum: Ascomycota
MMISLSRFRTAAIDAASAAADNNMPFPDKDLSSAFPLATPYVCGWLAGRGHSSATGGALPLHDLAPRVTLGTVKDADADGSDGEVSAFKQQRLADLAKAREGENPLITESYPRLQSTPDHMSNAAFRSRFAKLDEAKPVKSPTQRTPAVNSSKSPVSARIPSVSESENRDRKPTNEEFKDGYNEAERETTVLHATLTGRVRAKRVVGSGLVFVDIVNDFQKVQVMINKKKVLATEHRQAFKMWRNLIQIGDHISVTGVSRLTDAGELTLEAESLPKLLSPTMEQIPEKLTDSKTKREERHLDMLVNKQTTDILRLRASITKHLRDHFHSNQFLEMQTPILADNAGGAIARPFKTRATEFSDKELALRIAPELWLKRLVVGGIDKVFEIGPSFRNEGIDGTHNPEFTTCEFYSAYSNLSELIQQTELIMGTMATECQKLISTELTTLPEINVEKFRGPYKQVEFLPSLEKALGIRFPNLSAEGALPELIAVLKLAGIDLQGETPRSLHKLLDRLGAIYLEPMSFEEPIFITNHPACMSPLAKGFLCTKTYQLVSARAELFVGGRELANMYEEENDPAEQSRKMNAHRRLVNKPSGEIALRRENAGDLEEPEEIDEEIPPVDQAFLRSLEYGLPPTGGWGCGVERLVMLFSGTDRISDCLSFGTLRNVVNRNFGQ

SEQ ID NO: 3761 - protein, 364 aa, Unknown
  Kingdom: Fungi, Phylum: Ascomycota
MNCPRAIFRGARRLHQAPSLRRSYVTESDIEGARKYCLAQLQSSDYDAHLLRRFVPPSVRDAYAALRALNLELVRLPELVSNPTIGTLRIKFWQESLDKTFAGQPPREPICILLHKALTDLEARTGSRANEKSIRFWLSRFVKTREKQMDNRPYTNLANLEEYAENTYSTMMYALLAMMPMRSMHVDHLASHIGKACGIVAILRGVPVLASPSPPVKTPSGGEAAPSREPSLLLPLDIMAEEGVKEEEVYRQGPVAPGLQDAVFKVATRANDHLITAREMLKRLKAGQDPGHEFEHRGEAEHMYEEGNHTTEDTKRAFGILLEAVPASQYLQSLERANFDPFAVKTGGWRLPWSIWQALSKERL

SEQ ID NO: 3762 - protein, 205 aa, Unknown
  Kingdom: Fungi, Phylum: Ascomycota
MSRQSLGQASRLASRALHGPQLRNLPIISRCTAARPAVRLVPSPACRAATFFSTSSPRNKGIMPDTENPSHSAPATKQQYTPVELSENEYHEIADEYMERLLERCEEAQDEREDLDIEYSAGVMNITLPDRGTYVLNKQPPNKQIWLSSPISGPKRYDWCVSGETQGDKEGTASGSWVYGRDGTKLDELLLEELGVDLGPPALEG

SEQ ID NO: 3763 - protein, 393 aa, Unknown
  Kingdom: Fungi, Phylum: Ascomycota
MTKEPRSTQAQAPNPDTPTSFKRLYGTYADGKWWCNCQPNRRPAALREVTKDTPNKGKFFWTCPIFNGCNFFLFWDEAKLREGGLNSTTLPEDQPPRPKTPTLTQPKLTSFGVQLTPGRRRQSRSDGEEQESPRGSQEQDSSAMRKGKYPSTQEMTNVFRTPESAKRKRDAFAVPVSGQGDSDDEFSDFAVDSDDERQLINLTDASAKKASASRAAPVTPETGTRTVAGLPTPSSVSRNLFPSEKGRRKSVSFEETTPTRRSADGEEDNDSNTIVGESPLNTNSFNSTATLENTASAPGTPQVDPASEVISLLSSHGVDTSVQRSVSNILAISARRTRGVEKSRDTLREELRRQKSRNAKLQEKIAALEDKLKVRSRSMTNLKAGLMELYEDN

SEQ ID NO: 3764 - protein, 1162 aa, Unknown
  Kingdom: Fungi, Phylum: Ascomycota
MAPVQDKHIAAGCLFIARDDPGLVPTDWDLEALKNWSILTSKGDSNDVEIPVRQRLDPDTQARLLKSPSLSNCARLFRARWIRLEFKLAGASGIFRVYLLPDDIDRRIVDRSNGSLRKARRQLLEGLDTSTAAWEKGHPSEGTEEQVIFPSPKASEEKTSLLQLFNEIPSPTPDPDTVRDPYAQDAMVDLLDSRVSGLVTTLYPYQRRSAALMCQREAQIELTPDPRLTQRIDHHGADWYIDPVSGAVLRERRSYDGISGGVLAEEMGLGKTIICLALILATRYLPTPGPDIFGVAEPPRRSRIASLADMAASCATRHGVPWKPYLDAYETQTGYEYTHCAEVLRRNPGFYNIPPVEMRRAATRRPPHPDTPVELPKSIYLSNGSLVIVPNNLIAQWKQEIQKHTQGLKVLYMGLSKSNDFSLPDVQELVKFDVVLFSQGRFEKISREIGGFESSPLSQIRFKRCIVDEGHKLGNSRMGNKSVLLMGLDMMHFSSRWIVTGTPSHGLYGTDGTVTELSSTASRPPGPDETSEAGASANDSSSEMEKKDLERLGAIAALYLKARPWANTVLETGDTVAEWSKYVMLPKHDPKSRGNWQTLASTLNSLIVRHPRTDVGNLLPDVHERLVVLEGSYQDRLSLNLFSMMIIFNAVQSERKDLDYFFHPKQKKHVLQIVSNMKQSSFFGGSFFSRSEILTSVETAEKFLEEKKVPISEDDETLLREAIQLGRIAAENKLRTQSNEFHEMPLIVESFPGRSGPSWSLSGEGDPDQGISTSASLILALQKLIFETAGAPEALNSLLNGGLVQEGIAERHKILTGQNLPTSAPPPRSETLAGNTKLGNDNPRKSRSHGINGVKTKKNVDPDAFKGPLELTKISASVSAKLSYLIDSVVEHQEEDKMIIFYENENVAWYLSATLDVLQIQHLIYAKGLSKLEVYHVEIEIELTPRRVLLMDLSQAAFGLDMREASRVYFINPVLNPQVEAQAIGRVRRIHQKKPVYVETLVLKDSIDEVILERKEHMTQAEHRQVKSILDVRPIYNWIKNAKVSTLPTAGNDDATQMTPLRTPQNVFGRGFGQRAHPDEGLVLDYSPQGKAGPAKSLFTNGSSSNTIAGSKRSHEEIVTSLGLPNGNGSGSPGINQTEGPLPTQDLADRPARRVRFAGGDD

SEQ ID NO: 3765 - protein, 531 aa, Unknown
  Kingdom: Fungi, Phylum: Ascomycota
MLPPVIRKVYPRASDNRQSVSHPAVRTSRISFFKAAALNFAILQLLFLGLFSYLFGSLFQQPTRTHGLRILWVDYDGGAIGDAVRDAHSSLKSESYPTIVERSAVDYPSVAHLREAVCNTDYWAALYTVPGASERLVDAISGSTTQYNSSNALFYIWNEARYPTVVDAAISGNLGLLSNNARAAYTKSNSSFALEMMPANDSAALLAYANPWLLSSINIQPTTQGARVVYNTISIVLILIQDFFFLAHINGLYAQNKIYTRIWPTRIIITRDLISGTFTMVGSLLISAVIWAFKGNWDVSGKQFAINWMILWLFSHVNFMAIDVFTIWVPPQYVPMMLITWIVTNVTSIILPFALSSPFYRWGYALPAHAVYEILTDNWSSGCNPHLHFALPILFAYEIVGLVLTTIGVYRRCHLAVEAEEAGQEAMRLRVEVAVKKEREQARLEMLNDLSPDGQGSNPEAGNLARSRTRRSSHQEGPPDERDAARNEKDNDESLERDIESMDNEIVRMETYASQGRNLGPSFRLVGSNPI

SEQ ID NO: 3766 - protein, 221 aa, Unknown
  Kingdom: Fungi, Phylum: Ascomycota
MANSVDNALARFLYAILKQKNLKDIDWNLVAQDDALIDPCPNGHAARMRYSRYKTTIEKALESGDSHKKSRTSEKGGIVKPKKSPSSRKGSIVKSESGMHMASLAQFSPASIASSVFTGDNQDGILSARFLTPCSDDMTHAIPAQPNDAPADYPPPGSQFLDAASHDPTSPSYSAFNAAFDLGHFDTGSDALQTTHSLDLGGNQILGGHDWNDRFHDNNTY

SEQ ID NO: 3767 - protein, 951 aa, Unknown
  Kingdom: Fungi, Phylum: Ascomycota
MAASMVSDRPVGSAPMPIMTDASGHLSPTLDSMEAPPSPRQPRAPPPNPPFSFPALPSPSSAPPSFSRATGRRPQSAIESPSPRFDLDSEDLEAPNGRMALPAFSFNPGASLPSEPLSPMLLSPPISPNTPRAGGASAQKPAGFGHRRGGSEFVGGRLRDGNSIAVMSTSPTKSESGFASPTFQPPRRGHRRGFSSAVSSNEIPILPPPGDDSFTKGSSAPTSPTDFQRSEFVTFPPRQDPPTPPEPKAEFQSLPAAVEPSIDDVAQSVAPVAPEKVEPKPASRTRVGFSDTLEFIPRPLSLVSSDTSSTMTAKPGHSVTGSMSSLISLSSPGDPAGRGSPSPLSRSPTRDLDESRPSTAGAVLEHALKEPLPDHTTLSPRRRNSIPALVDIPAVPSSLGEPTPSPSKTPKRWSFFGLDAFASSSPIKNRPQSVSSNESMSREVSLGSSSEHGSESVGETSESTSGKKSRKDKKQKQKKKRASAWAGVILPRKQKGQSKRAKISERPPTPPAAIVSLEDEDEEESTTPQPLASPTPTVTITESQPLSSRPTPAKRSMDEPSTPMIDLDAALGPFNTPLPSNPEWDAAQAAGNINKRRLHSAQGLKGFSGPGMHYHRRAESAPDLPPFDPGRHGIHRFGSSSTMADVFEEDEEDDSALRTKAKSADGHSVGDQDSDGELTPPAVASKDLVLETQELVPPMVRRKSSGLSDRDHSSAHSVRNERSKTSLHDNVIVEDHPSIIFRSANVFSNRPESSHSAATSHRKSSGGKELSPVDVGPLHSSHSNTMPVSPYSTSLASSYPSPRSPMSVDAQRISTAPSSVNDENNFHSLLMGEPGPEVRISMDYDIPSLTSSNSTMTRDSTFTGPNPRYPKPNSREARPVSVGSTAFGRRRSSLVSLSRLISSSHGERSKLSMEVTLDNETDKKKGKSGKSRRLGRLMNFWKPNKEEQSHA

SEQ ID NO: 3768 - protein, 308 aa, Unknown
  Kingdom: Fungi, Phylum: Ascomycota
MPQSNHAGSSPALVEAVAGLSAGTVATLVVHPLDIVKTRMQISRTSSTGSERATTMAIVRSLTSNPNPIASLYRGLSPNLIGNASSWASFFFFKSRAERLIGGSRPSAGDYFVASALAGAATTALTNPIWVLKTRMISSDRSSKGAYPSMIAGIRSILRTEGIRGFYRGLFVSLFGVSHGAVQFAVYEPAKRWHLTRRQHGVHEKDAEATAAAPLRTEATVLLSSGAKLVAGAVTYPYQVLRSRLQNYQADERFGKGIRGVVSRTWAEEGVRGFYRGLVPGVIRVMPATWVTFLVYENVKYYLPRWLD

SEQ ID NO: 3769 - protein, 318 aa, Unknown
  Kingdom: Fungi, Phylum: Ascomycota
MLKLQNIFLSGFIAAATLFSGVKGQYPNPGVVTGNIKVHDPAVVKTPGGSYILAHTAPNIALKTSSDRTAWRDAGVVFPNGAPWTTPYTGGDTNLWAPDISYRNGQYYLYYSASTFGSQRSAIFLATSPSGASGSWTDRGLVIESSASNDYNAIDPNLIVDAGGAWWLSFGSFWTGIKMIRLDSSTGKRSGNDLIALARRTEAGGAIEAPYITRRGNYYYLWVSFDKCCSGAASTYRVMVGRSTSVTGPYVDRDGRQMMSGGGTQVIASHGSIHGPGHQAIFTDGDADVLIYHYYADNGEARLGINLIRYESDWPVVY

SEQ ID NO: 3770 - protein, 717 aa, Unknown
  Kingdom: Fungi, Phylum: Ascomycota
MVQLGSGLGGVLLLCLAQSTAAFYIPGWSLKSYKPDERIPLLVNKAFSDNTQLQYAYNELPFVCPPSENHSKAGDGLLTGQNIKLNLGEVLRGDRIVTSDMVLEMGKDKKCSLLCKKTINIDELEWSKEIIGNGFQVEWIVDNLPGATTWIQDSEERKFYSSGFPLGFTVDELEPQYYLNNHFTIVIRHRKAPGRAGARGEMLIVGFEIYPRSLGPGYKRGDDGCPIDLGSEGEIADGGGFELFMPNVESLDTEEENFVDPDDDGLGGSVKDEDDQTLEIPYTYSVYFKEDETIEWSNRWDRYLEKPDTAYVHSLAIINSLIICGMLTGVVLIILARTVRSDIKSYKDSAMEGGKLRKKAKSRSSGPTGLLGQETEEDDESLSDDDGQALEDVTGWKLLHADVFRAPMQVSILAPLVGCGTQLLFMSFGLVLLSAAGVLNPSFRGGFISVGIALFVTGGVMAGYFSGRVYRAYGGTEEFRNALMTEGILPAVVVPVVLLQDIVVWANGSSTAIPFTTLLALVVLWAGVQIPLVHAGNWYAFHRSLVWEHPTKTASIPRQIPTQQPWYLRTFPSIALAGLIPFAVIFIELLYIFQSLWQDKSHYYYAFGFLIIVASILLLTVAEVSIVATYVRLGSEDHIWPWRAFAAGASSAAWVFAYSVWYYFGKMGGGQRGLLDGWLFFAYSATGCAVYAVSMGAVGFLASYAFVRRIYGAIKAD

SEQ ID NO: 3771 - protein, 241 aa, Unknown
  Kingdom: Fungi, Phylum: Ascomycota
MNVAYNTALRQSKALRGDLTSLSIKDSPTPSDIGNVSASLASFSKALDEYNNLARQEIVPKKQEEALERVKRFRQELSESRTQVDALKKTREESQHQSNRAELLGRRPYNATPENPYANPSSTTTHSTFQPRHPQQQQQQYGYGEEARENHAFREQSFIANTNSALDEYIARGQAVLGDLGQQREMLKGTQKRLYGVANTLGISGDTIRMVERRAREDKWIFVAGVIFFFAFCWLVLHYLR

SEQ ID NO: 3772 - protein, 106 aa, Unknown
  Kingdom: Fungi, Phylum: Ascomycota
MADQEKNEVIEAKAPESEADSSKGALEKLRREQIAKFGPWKSPTKSVEAEMALFGPDFIYFISDAKLAELEAQGIGRPDDKEERIEWFKKHHTMKRKNGPRLQKRV

SEQ ID NO: 3773 - protein, 317 aa, Unknown
  Kingdom: Fungi, Phylum: Ascomycota
MPASPTLVFVPGAWHKPSCYDKVIAILQESYGLKCSAITLPSTLDNPMATFKDDLDVAREAISTETDQGRDVVIIAHSYGGMVANSAIKGFSRPSDAVTSESASSTGHVIGLILIASGFTLAGMSFMDPFLGYPPPAWRVNNTTGYAEIVVDPREFFYHDVPTEEAERRVSQLTTQSLKSLFEGGEHAYAGWRDVPAWYIGTIEDRGLPVVAQRINVGFAREMGTHVEHRELQTSHSPFLSRPKETASLLREAVGAFAGAPIGVTTNAEIPAGIMLPTSRLLQPSSWFRYGLPLVLGRVFGRGYLVFSWVRSWFGRK

SEQ ID NO: 3774 - protein, 1072 aa, Unknown
  Kingdom: Fungi, Phylum: Ascomycota
MMQSFKEFPDKERAPLSLFSLPHSSPHHHLLLSPSHIVTIYTHRSDVQPLATASSISRHSSLFAPCAFVAPPETTEQYREHFIDREISEALCPKLPGKSLLVRRQTTDMASESVEWQEEGYGNEDGVSNQHSDQQVEEFDPESHIAGDDQDDGAEDDGGDYDPESVTLSTPAQLPERQSSSAQPHNPSQAQKPKVSGGFLIEASDDEDEDGTPVQTGSVPPKPSVTPQIAESSNGVPARPNTNPHPALAGLDPKAILEARVKQDPRGDMDAWLELMATHRQSQKLDEIRATYNRFLEVFPQAAEIWSEWIEMELGLDNFVDAEQLFGRCLMTVPNVRLWTVYLNYIRRRNDLTNDTSGTARTTITQSYEFVIDNIGVDRDSGDIWMDYIQFIKSGPGQIGGAGWQDQQKMDQLRKAYHRAIVVPMSTVNALWKEYDQFEMGLNKATGRKLIQERSPGYMSAKSANIALDNMTRHLNRTTLPRLPPCPGFDGDVDYRAQVEMWKKWIAWEKEDPLVLKDDEPKVYQQRIMYCYKQALMAVRYWPEVWVEAAEWCFEAGIRENDQDAGVEMLLQGVAANPESVLLALKHADHIESTFPGKEGDKSEYAKAVRKPYDDVLGHLYALGDKVKEREKLEISTLKQAAALATPVQPSIENEEDENGEPKKSATEEKISAITKAYEREHRLSWRTISYVWIALARAMRRIQGKGSPTDGGLREVFTDARKKGRLTSDVYVAVALLECVVYKDPVGQKIFERGARLFPQDENYMIEYLKYLHSKDDTTNARVVFETCVNKLVADPVTLPKAKPLYQYFHKHESQYGELSQISKLEARMAELFPEDPKLKSFAARFETDTFDPISAPVIISKATQMRPKQLVPIIEQPAAARHSPLPMAHQEQSPRPQYARATASPKRPLGALDDDDLNPPKRFQRGPSPLKGAAGRRLDQQRRNQASALHRDITFLLGILPPSHSFDGPRVNVATLVATLQNTHVPDQVQSRPQAAAHSRQVSGDYAQRGASPFGRVASGGAGYRSSPLRTEAPAGYQGGGYDAANAQAGWPAAGGYGGQPAAGYGFNRY

SEQ ID NO: 3775 - protein, 796 aa, Unknown
  Kingdom: Fungi, Phylum: Ascomycota
MAASSTFSYAQAAKGQGTTPSNPQTEQDSSVQSPETKPVMNGQHASDTVDHDSTPETRPAVTEKTEQDNTPAPEDTTVVEPTRNSSRAESRRDEEVSRLDRPWRRADKGPTRSSSATTRSVDESEQRRPRKGRKSKAADKTNGDDGAATDKKSEPEPEPQPKIELSEAPIPTVNIWHQRKETLASKPKAVTTPARDVKVNGTGQHTERNEAATKPTAEAVETAPARETSSANGVKASRKAGDGSRPERNASRGNRLADKASKTEIPPPVADSVAWPTPETAVQDVKKPTETGDKTGDKSEKAVVDDGSQKPRSKDKWVTYDYVPTVTFETQIQRPSGSKPRGGSRGTGSGRGGHTGAPAADKAVPVNTTPASKSSETKERTREQSNGVPRTSSVPPASKQPVAEPAQVNKEAKKTTPQTSADKKEGPAQSMEAPVQREARSERGRGGYRGRGGHHNVNAHGQSHGAQTMSGPGFAPNGMGPRGQPYSPPPRQGAHGQMFPPPPQRGGRGGRNAGGNHYNRMSLPNSASRLPPVQTQFAPYEYPMAPMSAIPFQPPPYWDNMVMTMLKQQIEYYFSIDNLCKDLFLRQRMDSQGFVPLHFILAFQRIRDMQAELAMVRAVCEESNEVDYIVGEDDCERLRRRHGWETFVLPLEDRDVGARNHGPIQPSFKSRSYNMGSPYNGMGSPPMHFPMGSPHGYSAPPEQSFQRFGNGPMGSSNGQEQVNGKRSSANNATQLSANVPDFSPSGSFPVGDQGLGAPNGEVSNGKTDTSALTNGHVENGIVNGNVNGVHADAGHA

SEQ ID NO: 3776 - protein, 756 aa, Unknown
  Kingdom: Fungi, Phylum: Ascomycota
MLPTAIFAAERIDAQRAQGRYYNPPRGRRASAVSSNSTSTTATVPARVSADLIIRDPRQPALNLVYGLPPTTPSKSTAQILSMSSSFEKSVKGATKIKNAPPKTKYIEHILVATHSGEAGIAEVFRTLQYRLRDSTWTVVFKGLITVHLMIREGSPDVTLQFLARHRNMLAISNFTDAQTQGRNIRHYANYLTERARSYRDTNTDWVRAQETRLEKSTVDKGLLRETESVQNQLTALLKCDVLDTEPENEITIFVFRLLVLDLLALFQILNQGLINILGHFFEMSRPDAERAMAIYRNFTKQTDFVVAYLSSARQHEHRTRVEVPKLKHAPVNLGRQLEDYLKDPDFEIHRRQYIAEQEAKRKGGGGGGLVNRSKSKSPRPPVSNKPMTDADFPEPASNNPFPRAGTNGASSSAPANPPQANKGPDPDLIDFFDSIEQNQTQMEMQPQQQQQQQLGFQSQPGQMQTANTFPIQQTGMQGFEQQQPQQQQQQFNGNFMQAQPTGFASNSPFQQQPQNDIFTQQQQVPQQQMPQQQQQPPPLQPNYTGAGFGGYTPQPSFQPGALGSIPQESVPFQNTGMVSPPAQQLSPFQQMQTGQQNTNPFRQSMLMNQQTGMQPQQTGMPSSTMSSPVGGTQPLQRQSTNPFARSANSSPFGTATTGQSSPFPAAAPIQSQPTGTNPFARASTMPVEQQQQQNSPGIAPQPTGTNPFRQGAFVNHATGMGWQHTQAPIGGGLDQLGTMPVFPRPQQQTPWSQQQ

SEQ ID NO: 3777 - protein, 380 aa, Unknown
  Kingdom: Fungi, Phylum: Ascomycota
MASSFFDLKARKAAAANGTAEAKPEKQTNGRTQPWVEKYRPKTLSDVTAQDHTITVLERTLQASNLPHMLFHGPPGTGKTSTILALAKELYGPEMMKSRVLELNASDERGISIVREKVKNFARMQLTNPPAGYNKKYPCPPFKIIILDEADSMTQDAQSALRRTMETYSKITRFCLICNYVTRIIDPLASRCSKFRFKSLDQGNAKKRLEEIAEKEGVTVEDGVIDTLIKCSEGDLRKAITYLQSAARLVGAGGKPAEGDDSMDVDKQPVTQKIIEDIAGVIPEKTIGDLVQAMRPRSSGSTFAGISKAVEDMVADGWSAGQVVTQLYQALTLDETIPDVQKNRIVLVFSEVDKRLVDGSDEHLSILDLAMRVSSILSGR

SEQ ID NO: 3778 - protein, 647 aa, Unknown
  Kingdom: Fungi, Phylum: Ascomycota
MVLFRDLGCLFFLAAPLGALASAVANDVRSLRSLKLSPSPQHISTTGYRVQLNRQVTIVTGDFSDEPTIKVIEDIVASAGGRTTVSSTSKGHGTQIIVGTSEDNYAAIKAANKLTGDAADSLDAEGYVLAVGNLDRKPTIVLNGVDARGTFYAAQSLRQLVQSGRYVPGVEIRDWPLMAVRGSVEGFYGIPWSHEARLDQFAFYGKHKMNTYIYTPKDDILLRRQWRDLYEGSQLEAMQELVDTANANHVDFTYALSPGNDLCYSSDEDFEATVKKFNQIKDLGVRRFYLALDDIPTDAFHCEPDQKKWPWTDDWLPLADAQAFYLNRIQKEFIEANDLEDLETVPTSYIGSQPTPYKERFGSSLDTKIRIQWTGEDTMSASITSESATRASESYVTDNLFVWDNFPVNDMAFDRLFLNPLTERALDLHKHLLGFTSNPMQQPYASMLALINYGDYTWNTPEYDPSKSTVGAIEELAGSKKAVREALVAFIDLNQNWPYRQPEIFAPALSKDVEKFWEARKSKSWFTKQRGMQPLKDRLALLSKLPKTLSGMDEEKFALDVAPWTASTMQWAKACQELISMLDLLDKGKKKQAGEKLSKAEEWIEMTKEETIDTLDREGNPDTYAPKVGDGVFQQFLEDATEIYESK

SEQ ID NO: 3779 - protein, 527 aa, Unknown
  Kingdom: Fungi, Phylum: Ascomycota
MASTTETQQPTAVDPQITAAEQQANPTEQYAQVNDNKEGDDAKKPETDVEIASVEEEGKAYYSKKSVWLMILFSGLAIGSDGYNAAVIGNIQILMKYIYPEALTDTIYSRLSNAFLIGMIIGMLFFGVIVDQLGRKTGAVATTILLVLGIAMSAAANGADHTGLLWMLIVARGVAGVGAGGEYPVSGAGAAEATDESGKYRKHRGFMFAMLADLSASLGYVWAGLVPLLLLLCVNKREDKYEIVWRAAFAVGAIPPLGIFWFRLRMAVATAYRKSSMRKQRVPYWLALKRYYRPLIGVSSCWALYNWVSIPFGIFSATIITRTNASGDLVKDLGWGVVINCFYLPGPFLGGYLSDKIGRRKTMALGFTLQAIIGFILGGATAQIQKIFPLFVVLYGLFLTFGEVGPGSTVVLTASECFPTSIRGQMMGFISACSKAGAAIGTQVFTAILNSYVDKPQEGDRAVFLIGSAFAVLGAVIAFFVIPDVSRRLEDDDAAWKVYLADHGWEATWGDNETKDPNAVIMNRAVS

SEQ ID NO: 3780 - protein, 104 aa, Unknown
  Kingdom: Fungi, Phylum: Ascomycota
MRPTQALSVGRYRHLKLTTKDVNKGFYKGNRTGSMGRHTKYGGYIIEWDKVRTYAVPENLKEFKLSPYVSRQVRAEPGDYKGLEKGPQDPYFYVEQWKRYNGVD

SEQ ID NO: 3781 - protein, 791 aa, Unknown
  Kingdom: Fungi, Phylum: Ascomycota
MTSRPSHSRSSSYSNDQTRRPNNPSGLRQAIAANLSGQSGNSRPATPPSPGPASASRTESTPLLQNDSSTRRPSIHPAHTGYCNHGTFSPRPSSPAGQSYEGYRDDETASVNTGDETPESGTTIAVLDNAITHIVGHEDWKRWLKKRMRTKKMGHSSRLAEQAGLQDTTLMYLSYYIPCLTWMSQYKVSYIKGDLIAALTMASFYLPMALSIASNLAHVPPIHGLYAFVFNPFIYALLGSCPQMVVGPEAAGSLLVGTVIKSNVDSGDGSTEDNDLLHAQLCGVVAGMAGAMVFIAGLARLGFLDSVLSKPFLRGFISAIGFVIAVDQLIPELGLARLADGTGVTHGSSVEKIQFIVENIRRTHIPTFLVAGISFVIIMICREAKNRLSKRFPSIVFIPDRFIIVVISAILCYKLRWDELGVEILGTVKAANGGLFTFRWPFQPSQMTQGMSTSFLIALLGFFESSVAAKSLGGSDTIQGIQLSANRELIALGTANLVGASFMSLPAFGGYGRSKVNRTTGGKTPMSSIFLSLIALLSILFLLPYFYYLPKPVLSAMISVVAYSLIEEAPHDIAFFLRIRGWTELGLMAMIFVATMFYSLTLGMALGVGVSLLLVIKHSTRPRIQILGRIPGTNRFENAESASSHLEFIEGCLIVKIPEPLTFANTGELRARLRRLELYGSSKAHPALPRLRSQDANRNIIFDIHGVTSIDGSGTQVLEELVRDYRERGVRIFFSRVPSRKDSPVWRLMESSGIVELCGGETHFVNDVEEALRWTEYEESVEMGSGEVDGR

SEQ ID NO: 3782 - protein, 547 aa, Unknown
  Kingdom: Fungi, Phylum: Ascomycota
MGLGILPDKHLAHVPGTSFMNEKGVVANIEDVPASHSNLKHDPTGKIVLVPQPSDDPNDPLNWPRWKKEMFTVSIIIGCGAVGAVGPLLSPAIVPLAMQFDIPMQRFTLGFNGASLIGLAVGNLFCNSLAMMIGKRPVYLITAIGLFLTTLWSAVANDFVSLAVSRALQGVCISPMEALIPASIAEIWFVHERGFRNAVFNLGVLGGVNLASPIAGPIIDKAGYKAALWGMTGAFGLQLLLTIFFMPETTYDRTTQGIRDRQVIEDGSLHEKSPEDVKSTSVPDNLPPPKAHSYLYTLRPWSGQFKRGMFWSNIIAPFKMLGSPLVIWGSFQLTICMSWLVLLVITLSQIFSGPPYNFSVTAVGLASLASSGGILIATALAGFLVDGLVKFMSRKNKGIYEPEFRLPIVILLTTLSGAGFFAWGQSLHNAEKWPIPVIVCLGMINLGVQFGIVGVVSYVVDSHRHEAVEAYAMMSFCKNVFAFGMTFYVNNWIAAQGVRETFFVIGGITIAVSSATLPMYIYGKRARSFAHRIGLMEETTSESAEEN

SEQ ID NO: 3783 - protein, 1157 aa, Unknown
  Kingdom: Fungi, Phylum: Ascomycota
MSTPTTAVALPHYHHNHAHGHSHRYHHPPYSPYQQPHPHQQGNHHQNHSSSSATVSTAPVPNIQNISSNTNSNNRAAASNSLIHHHPPSLPSPTANNPPRLLPLYPPASAGYSTVTDGVTQPRHHHQQPHSPVPPPHSAGHYTHHVHQNAAAASTSSSSRLAFDDGYPSSTMATTGTATIAASSGAHQNDFDDDQPSRKRRRSREPDWNTFYRNGLPKEIIVIDDSPEPEANTGRKLANTGPAPAYEASPAHQQPAKKRRRDDAPSAGYHVQYLSHTNTPNGGTNSTDRTNSAINTTAPTSLSSNGQYEEPALPLKRKRTTRQQTANDAKRRDVDGLGSQFLTYKPPPFPPKKVPEVPVRVIRDDHHNKNVKVDDDDGHFIVVPDAHLTENYQISRLLGQGTFGKVVQARDRKRNRLVAIKVIRSVQKYRDASRIELRVLATLKANDNENRNRCIHLRDCFDYRGHICIVMDLLGQSVFDFLKGNGFVPFPNSQIQNFARQLFTSVAFLHDLNLIHTDLKPENILLRNDQYQTFTYNRKIPSSSTTISRSATQRRVLLDTEIRLIDFGSATFQDEYHSSVVSTRHYRAPEIILGLGWSYPCDIWSIGCILVEFYTGDALFQTHDNLEHLAMMEAVVGHRIDPHLVAAVNKGTSGRSGGSNPASKYFKRLKLDYPQTSTLRGSRRFVKAMKHLQDIIPSNNSFFKHFLDLLSKIFVYDPAQRITAKQALNHPWFREIAHPDDGTEAAKIRIENEEKARHAHFVGLPSRAVEIRDECPIRADELIFARTERPGSYNLRKDESVDSRSRDWTILIHWALPLLEKLLPGDFVAKLPSAVCNPNLDFNEDVECLPVYNGATDELLFKSPTPGARRVSRQRTRRLLLEGLDIRWECKVKGIETLHDEDAVSLIFEKGEAVQVEFVVGADGASSKVRELLLSEEKARATGCGLMFATGMATYGDKEKVMKIVEKHPVSSVSMGADAVGSVGVFFAGASDKMEDWTTFWVKIWKGEPVTLQGAEALSFIKKNTHGLIGVFKDAVEWTPEGSPCLISEMRYWIAEPWDNLGGRATLLDGAAHPMLIFRGQGMQHAIMDAVNYVEAVTKILGSEKGIEKVKLISELEQEMIERGNKAVKQSLKEAAKALDSEMVSKMMMVTKGHGQG

SEQ ID NO: 3784 - protein, 1068 aa, Unknown
  Kingdom: Fungi, Phylum: Ascomycota
MDKDKLAQLLKGSQVPNTEQVKAVTADLQKNYYSQPESLLLLIEIAITNEDGGVRQLASVQASRLVVRHWEKIPQDKRSLGRNHLVEGALKEPTPTIRHSLARLVATIVSADMELGEGDDFLKQLVQLNTSDNVVAREVGSYILYAILEDDPTHFSDHTHQLLQLFQTRIEDPESKEVRINVVRAIGAILMIVEPDEDPQALKAMQSFIPHMVNILKATVEAEDEENYKAVFEVFHSFIAYDSALLGNNLRDLLDFMMGMAANTDVEEDARSQALAFLIQCVRFRRMKIQGMKDMASQLMVKAMHIVTELDSEDEEDISPARTAISLIDQLASELPPRQAVVPLLEQFPSFASSENPKFRMAGMLALGNAAEGAPDFISTQLKQLLPTIIGLLLDPDNEVRHASLVGLIHLADEMADEMSSHHEQIIDAVLKNLEAASQGTSDKKNISIIRCACGALDTFGDGIDTKIMAQYGPNLLGPMVRLLEHSDYGVKAAAASAVGAIASSMEDGFKPYFKDVMKTLGNFVAIKDSEEAMELRSATCDSVGRIALAVGGEEFQPYVMDLMTASEEALNLDNPRLKETSFLLWSNLSKVYKDEFAHFLPGTFKSLFSSLELEEEEIELPGVDLSSLGDGAVVVGGKRVKVKAPDSQDDLTIATNGEDEWDDIEGLDDLDDLGAVTAVALEQEIALDVLGDLISNSCNQQSLESYVEKVIETVVPFAEHTYEGCRKTAISTLWRTYTRVFQTWEEGAGVKWQRGMPAKPEPPASINTIGQALQKATMSIWADDVERTVITDINSNVAATLKACGPAVLGSKNGMLQEIVSVDMGDEQEEQDAEAGSSEYDWLVIDTALDVVVGLAAALGSDFAELWKILEKPVLKLASSTEDLHRSTAVGGVAEIIKYTGDAVTPFTDSLGQALVRRLGDNDPLAKSNAAYALGLLILHSAETSKTFPMYGPLWEKLEPLLSVNESRMTDNVAGCICRMMTKNPDNGFVAEALPAVIRVLPLTEDYEENAPIYECIVKLYNNSNPTVQQATPQLLPIFEKVLSPPEEQLEPETRQLLQQTVRTLQG

SEQ ID NO: 3785 - protein, 886 aa, Unknown
  Kingdom: Fungi, Phylum: Ascomycota
MATTMEDIAHLVVTPFQEIVDKGKTAIENAGESQPMTKAAQSLVKEGERALKRIEPLCKKHVAEFGLNFRDALRDNGGTQLTAAFLRADEITEYRSELNDLLWEFDDYIDDPDSFDADKFAELQASSRKAAPKIYDILMRMKLEVPYDDLSPIGSLPHSIATQQSPNPHHSTAFFAPLDQTQSIASASPSTEQRPDSGIYTIEDATSQLKRLMGFEDGFEERPVTAQSHYQQSPAREPPIMPNTNPWDVNSMPPLDDIQPMSESAIERRPEVPRGGAESPVDPAISPVIATKSAPQARQSLEPPQSEGLESVANDSESVLAENDDRYYLPSTGNYPNSPGRDRRYNVFPPSTTRPRTVSQIAAAIPEDSVIDGTGGLSLSMASVSANNLNESTQSPRSLTPGGYAANTSFSGFENTQRPSMVSHQTQNSTSETVASSHLSPGTRPVQESEGLQVVPNNHRLDQELPIPVEADNKQERASSSSQPWMPDCTITPQSSFWMAKGFCEGAKEVSRGGIGVRKTKKPVGFTTSATVARCTSCMCELDFKDIENDVNKLDAGNFSRGSINYRVRFLQKSHVTAKRVDDVQYGCLFCLQQGHTLDESDATVFFTPRALMDHIAHHPRPLPDVSGLVVIEGPEVPTHLTNDFDIQFKKPPVPHPVIEARSDIIHLPTAVTKEQARRLYGQRLLFDRTPALELAVGARITGLTWPAQHNGEWAMGWHDGVYASVPTDILKLDTPPNQHVKIGGTSMIRARAKWRFNPGKDKGSDWLKFEKNDVIKNIAWSYFDHWCWSGTNSKGKWGIFPQAFIDTNTLEEPNGLNRATSLSDEKNRSTSLMARFGRRQSSQSQQTQFQQQSMRPPSVAGSTSSRESRGVQHVARGSHGDVHAS

SEQ ID NO: 3786 - protein, 373 aa, Unknown
  Kingdom: Fungi, Phylum: Ascomycota
MAENQGPRALTIMWAMTALTWVFVGLRVLARVIIVQVVGADDYVYFLSAIFLLCYNIFLQLSLRYGFGQNAGSLELDDLAKAIKSEMVGQTFAVIGMAVAKASMGLFLLRLVAVRWHKVAIWSVMGALLFVSGLTAIMFWVQCRPAKGIWDPRERRKSRCDIEITPFAVTLGVACIIADFFFAIFPSIFIWQLNMRRREKITIAGSMSLGLIAGAAGIVRTYEVATGFTENYTQDTVPLIIWSSVEMAVTMVCIGIPVTMPLWRRLLGKGNSSADRNYRKYKRHDDSSEPRGYQLDNVHHRRNVKPSGHIDGSSKLGLNCTQSTDIGATTNESEEEILPSKAGDKVDTGESGLEGQPLPRIHIKDEVRVERGH

SEQ ID NO: 3787 - protein, 405 aa, Unknown
  Kingdom: Fungi, Phylum: Ascomycota
MGSIPKTASLEELLARSLNRNRETLARVSADIHSHPELAYQEFRAHDTLCDALTTLGYKVTRHAYNIKTAFEAEFGQGGAVVAYNAEYDALPGIGHACGHNLIATSSLAAFLATAEALAETGQPGRVRLIGTPAEEDGGGKVDLIRAGAYKDVDACLMGHPGPTSGGWDNILLPRLMARSSVRVTFKGKSAHAGNAPWQGLNALDAAVASYTSISMLRQQTPPNQRIHAIISKGGERPNIIPYLTEISLYVRAEANAELQKTLQRIVECCEGGAKAAGCELSFEWADSYKELECSQTIADVFGEKASSMGQEYGRELPSVSGASTDQGNVSFEVPSLHPMFGIPTESTDIGPHHPGFESAAGKPSGLEAALTFARIMSATGLEILSSEKLRLKMWAEHHERFGST

SEQ ID NO: 3788 - protein, 211 aa, Unknown
  Kingdom: Fungi, Phylum: Ascomycota
MAESAPDSDRYKSATDDPLVWIDCEMTGLNPDTEEILEIYCILTTGGLDIIDEEGFHAIIHWPSSRLDQMDEWCTKTHAKSGLTEAVLSSTTTPEQAASQLYDYITKHIPQQRVALLAGNTVHADRAFLRREPYAKVTDHLHYRILDVSAIKEAARRWSLPKVTKKAPSKKGLHKARDDILESIEEARYYRDTIFRLTFDEGEKSSKGKKK

SEQ ID NO: 3789 - protein, 1703 aa, Unknown
  Kingdom: Fungi, Phylum: Ascomycota
MAVTTSARQADHALASLPTRPPTPPKEASSRIASTSIKPAVRQALVHQSLQTPPNIQSLISPATTESQSSANRLRKKVEWSAHTEYKEPPQYQEGARLAKSSPVASGTISRPIKSILKASSSPCQPSAALNTRLGSLSDQTSISDMLDSTIKQLSGADRDSKVDAYMALARALKSSDNLPDRVALQGKLSLLTQFIQRDITLKDDHGALDRSLVNHALLLLTTFLQFNAIASTIPPDFAIFITDHAIRSFEDPAMPKEVVRYLMQVMAFQTFAPKVMSHDRVGRLVLAIHNLEGHLSGKSIVMSRIQLYKRLVKQCPHHMVVHSHWLRDLLTDMLSLTKEIRTEAISLGSDAGFQLRHEKQILRHFLDILHGETEEKTFVQHYIERLQEMLKDRERSAAVPQIWAIINLFMRCPLERWEQYGPWLTVVQTAFNTADNTTKLEANYAWNRYVFLCLSETKLTAKSLTVLCQPLLSQLRKKATPKNPEDVTKLRRAAVGGACNLFYYAFRPGNDRHSPDMIWDVAVQPIMLQLTTLGDSSDAQGDWTFQVAKLLNGLLDGATPRVWREDRIQDHTLVRSDELPPLDPKWIRRNCDKVFKVLDPIIERKILDLASQDSLVSRLWQSVVGAVAAASAKDIKVSDETVKFLAGAFGLFHRIWLQGPPRTQPEASSLLKGVRHMMQVMVNGLGILPFTEKKLSMTEPNLFEAVATPSARFERLDKSRGVMRSPLLHLLNLFCTIPEGAADDEEYAAFIRSIFEPFLAGKSEKARLDQARDLLGALPRNALCPYGIWTLLSQSFLVPFVLPAAGEDKGNKILGPEYREMISFMERGLSCHPNLPVDQWLSTLDSVDFHVEHHFGHAGRALVIVEPLAKILVDLVDSEQSQVPDNTFFELTAKLLAITQFPKDKLAMDGARRQLWGAAPSASQHSPFRPLDYLFRAASLALKKAYGSLEVSNEGFHVLRLLEAVKAFVIVSKQFGEATLTALADGFRLWIADEKALVAMSNVPQISEAVLGLWGEVCQILVTIGQPNRGQLGALEPLLTSACESNHPAILKLAAETWNTVVNKVDAPHCSDSLKSILSSLNSKLEVDMVSTPGAVDGSGAQPRLSLSHDTSHDVLKPALEAVSEISNRGQRTSTASKTNSTIVKRSLNRGKYDAMPRRTRSRASKRVGTPNLRQDNSQIELTAVSSSSPLRKESRHLTGRQKAVRERQQGRSVASSLVEPELNLPGTPEVATPETTREAIRSDAAGQPKDLTPERRTSYEDIISSTPTPRRGQVLQLDDLNDPPSSPPELRPYPLLTEIQTRSRTTDSLQGWEFSSPPNSPSASGSGAIARSDQVEMAETQLDLRLPDQGEMPGPVAPSVEVSAKVDEAASQAKVKTGGDLVTESHRVVVKQAFPEIQVKARRQKCGRPKKTSLAPLKPDVFSQQQRTLRSQSHDATQINLPRLEDPSFAPGDRSKSNTTQVVAVSAQIAEEIARPTTPMVTRKRARTSACIGDDAVPSQATTDLPDGHMGDSKKRKIEHIKQAAGADVRTKLSRDRHSSQQAGISSPGYASGSSGSQSRTRRSRRVRREKAREISDEEQGHALYDSAVDSTRLGDDAGDTDEELLSQLMADSQAASQSQSQSRLTRLPSDDAKMDGEPEAKQPSPETDENAVASVIALLRSGKEILQSTAISRMQVDELETMIMDLKREVYQAEYRGRDQ

SEQ ID NO: 3790 - protein, 573 aa, Unknown
  Kingdom: Fungi, Phylum: Ascomycota
MPNPILDLHTIDESTFPYIFEQNATVEIRNGGGLVRCNVYRPKTADPVPVLVTYGPYGKDLHYKDFIHKFAEVNLAHKSDHSAWETPDPGFWTSKGYAIVRADERGLGQSPGLLDTMSPGTSDAFFDVIEWAAEQAWSSGKVGLLGISYYAGSQWRVAARKPKGLCAIVPWEGMSDYYRDRCRHGGILSNNFIRFWWNRQVVTNQYGRPGRKASNWGPDTIEGDLSEEELKENRRDQTEDNQMYRFRDEPYYAAREYDMGDIEVPLLSVGNWGGILLHLRGNIEGYVHASSKFKYLRIITGRHDLPFFYDEEVEIQRSFLDAFLKADDRVGWSQPGKVSPVNLVLRKGDVGFDNAEAEATYERREEGEWPIARTVYTKFFLDSKDLSLSTSALDTRDLKRKLSYKALGTMENPEMIQFTTPPFETETEITGHIVAHLNVSVTADPGPITPSDIDLFVTLRYISPSGKEVFYTGTAGDPVPLTKGWLRVSMRKVNTKHYKHRPWLPHRDYTSKDVLPVIPGEVYPVDVEIWPTNVVAEKGGRVVFEVASGDTQGSGIFLHDDEKDRYVFYEARP

SEQ ID NO: 3791 - protein, 1369 aa, Unknown
  Kingdom: Fungi, Phylum: Ascomycota
MEQQQQQPQQQAQQPSQAPQPQQQQSQQQPPQAPHAGGVQGPAGRRLHIAHRRSPSELTPLMSMFQNPGMEQLAIQQQIELLQQQQQQIQATQQQYMNMGIMPPQQAVGAGFNPMQPMGNMQTAFQFPNQMPQQQQQHQQQMVPPSQPLSHRRNQSALPNMGMGPPPAPSSGASGSQFGNFEAPPSTNRENTSGRGGRGGGAAGGGHQRRHSLALSDAKKAAELAQQKRTTTGFSFPAAPAPEDENKTAGSGADAPQGATPTRGRGGHGRSQSMAVNGRGGSSARGGLEGSSDFQRRGSGAGHARTGSRNFEGNWRTPNQAQEQPGNAAPNAGFQPGHRSRGSMNQSVSSIGAFQYNPNQPQVMQMPNQMMMPQMYGGQLNPMQISQLQALQAAQMGGQQFQGLQGSQHAGPLGGQQQQQQQRKTLFTPYLPQATLPALLGDGQLVSGILRVNKKNRSDAYVTTQDGLLDADIFICGSKDRNRALEGDLVAIELLDVDEVWGQKREKEEKKKRKDITDTRSGSTNQGNQSSGNADDSQPGEGGIRRRGSLRQRPTQKKNDDVEVEGQSLLLVEEEEINDEQKPLYAGHVVAVVERVAGQMFSGNLGLLRPSSQATKEKQEAERAARDGGNSRHHDSRQQEKPKIVWFKPTDKRVPLIAIPTEQAPRDFVEKHQDYADRIFVACIKRWPITSLHPFGTLVEQLGRMGDLKVETDALLRDNNFSSDEFSDAVLRSVGLQDWSLAKEDEAALSARRDYREETVFTIDYNGAAELGNAVHVKSRPDGKIDIAVHVPDVAHFIKANSLVDREAKKRGTSVQLLNRFCALLPPKLAGEVCSLMPDEERLTVSVVFSVNPHNGAVAEGDSWVGRSIVKSSAKISLQEIDAALSDESTYKNEAVPVKTLQILNAVAQKFKEARLGAGGELIAPLRLIQQLDDENNPVQENLFDSSAALEMVEELMHKTNTYVAQRLAEGLPEKAILRRQSPPNPRRLQTFSERMNALGYDIDASSSGALQNSLFKVDDADLRKGMETLLVKSMQRAKYFIAGKTAKQLWPNYALNLPLYTHFTNPTRRYPDIIAHRQLEAILSEGKVEFTDDLENLVKTVESCNTKKDSALNAQDQSIHIESCRTMDKKRLEANGDLIAEGIVLCVYESAFDVLIPEWGFEKRVHCDQLPLKKAEFRKEKRVLELYWEKGVPSSAYVPEDERPKAAASQRMNNAMAAARQKEEADRARKERDEAARKQTETGTMSTDDVDALFDDDDDNTSDVTEAMAGASLAERPTQSVPGSPARSGSNNGDLQRARSDSKVHAAEGPESRLSNKEKYLSFFKLRSEGGEYIQDVTEMTRVPVILKTDLSKSPPCLTIRSLNPYAL

SEQ ID NO: 3792 - protein, 654 aa, Unknown
  Kingdom: Fungi, Phylum: Ascomycota
MSGNDSIPATPEDMIGHDKELGAPGSPGSESSSAASTPLDGGLESPTEIPKRVPSLRSVSDPRTLNPRSTALGVLGAARKPIQSASSFAGTANMSLDNNSAMAKARALQQQRMQKGFSPASNSPTSPSSNQSGSPINGFPGNLRMPGAGVQRPGPPAHPNSSPAAPTALQLRRQKMMGGMSMSLSDMGSGGSTPRLSRPGAPKLSDITGEKPEDQQQNGGRHHSKMDDFKQYIDTEKGWITFDGAATITREGVNFSNGQTFSISLDEVEKLDELGKGNYGTVYKVKHARPRVPRFGHGLSSKAPPLPHAQSDPPPVRRQDSSSEDNAAEGGTTGKVMAMKEIRLELDDAKFTTILKELVILHECVSPYIIDFYGAFFQEGAVYICIEYMDGGSIDKLYSGGIPENVLRKITYSTVQGLKSLKDDHNIIHRDVKPTNILANTRGQVKICDFGVSGNLVASIAKTNIGCQSYMAPERISGGNMAQSGNADGTYSVQSDIWSLGLTIIECAKGAYPYPPEVSGSIFSQLNAIVEGEPPALPAEGYSDTAKDFVASCLNKIPKLRPPYAMLLKHPWLKPLSKPQTITEDAEEGDAAAEVAEAVGKIDLGSGTEDEEVAAWAKGALARLASGEVGGDDTRPALHAAPLDSVSPLGSPAS

SEQ ID NO: 3793 - protein, 636 aa, Unknown
  Kingdom: Fungi, Phylum: Ascomycota
MSSSKAQRHAPRDKRKIENDLNDFAEYVEQQQNLRYPAKPPTAGADAPAESTEHHAELDELFDNLDLGDATPRVPLKQLLLATDDDSLQKLQAVVTERIEEGFGESVFEIGFENSGESMQLTLDNWNTASARLAEAAKGVHADCQLLLTKHVGGDMEAASTATSQEKVKHCSGKILVRQNPQNIEDVIETRIAVVGNVDAGKSSLLGVLVKGELDDGRGKARVNLFRHKHEMETGRTSSVGMEIMGFDSVGNVITSDTPGRKLSWEEIGKRSAKVITFTDLAGHEKYLRTTVFGLLSSSPNYCLLMVAANNGLVGMSKEHLGLALALNVPVMVCVTKIDMTPPNILEETITQIKKVLKSPGARKMPTFIKNREDCINTATQFVSQRICPVFLVSNVSGENLDLVRTFLNILPHHGRYNSDAPFEFHINDTFSVPFTGTVVSGIVQSGVAHEGDNILIGPDSLGQFIPTAIRSIERKRIRVPAVSAGQSASFALKKVKRKEVRKGMVVLPKLEGQPNPKVHREFIAEVLILSHATTIKKRYQAMLHVGPVSQTCAIIDIDRELIRTGDRATVAFKFVQRPEYLAPGDRLLFREGRTKGLGIVKAVGYDYKQPLSKQIQDAEGGAAQSGVQNEVEVSA

SEQ ID NO: 3794 - protein, 151 aa, Unknown
  Kingdom: Fungi, Phylum: Ascomycota
MLQRTLAHPTNDGATSRHIWYKPPGKDFSIKFSDVPHAYDDVMVKHADLVGMIDAFTDGQLWLMMDGKRLFRVPTNGAVDPEAVQHSSEVEIMTPDELREALKSKPSCQEAYDKFIDSPLNQKSFDGAVPRDDSYCEPVQCDEHKNCRSHG

SEQ ID NO: 3795 - protein, 326 aa, Unknown
  Kingdom: Fungi, Phylum: Ascomycota
MSRPQHEYNARQASVSIPGLGMISNQSQQAPTTDSHNSRHSQAPAQQKGRKSKHAQRIAASRQTPAPQVAHVNQASQSQLQQAAIPPNLVEKDAQWQNDSSRPRTVPSQASGGIPDPSTQYLAQTLFPSATLPVPRRILVIIDLNGTLLYRPSRRRPTDFVERPHARDFLSYCLDTFYVAIWSSARPDNVKKMVAQLLTPQQINRCVLIWARDRFGLDANDYDARVQCYKRLTRVWADPAVQASCPFQGGKWDQSNTVLVDDSLEKGRSEPFNILPLPEFSGQENEPADVLPQVHDYLNTLCTQSDISSYMRRNHFRLNPNYVLPQ

SEQ ID NO: 3796 - protein, 861 aa, Unknown
  Kingdom: Fungi, Phylum: Ascomycota
MAAPTQHLSAPTHHSEHPPPSPGQRPNGTSSSVRRGIAPSQSSTSLAFPQSVTMQNLGAKQAAPGRNSRTWTASSGDLGLLSDTDELEDRAAFVLEYNRLAKKHGVRVMVLEDFEGRKSSAITGSEKRGWLYRLFRSSSNDIPAPTASALTSKVNPRHRRSVSDIAHNLALSRREWPQTTDLQTMVRISGKSVLYLPSEHASGPIVLPTCIRATAQHLANHAMTRGIFRIPGSVKIVNALFDYYCYVEGGGARVSGTVRCVNLPMHIQSSVHDVASTFKKMLSVLPGGILGSLGIFDAMVAIHSQLNGSPEFPRTKQTRVRARLIALALATIKSQFRRDLICAVFGLLSLIGRVAEVTPREDDEGRALPTADLMGYNALGIVFGPVLIGELMDDYTMKIADPGSGLMLFPVTPQKVRRDRRKSKPQDGVPPAQTSVDKIRVANGIAEMLITNWRDVIRQLKALGTHEKTELLTINPRAGSLRPSASATFVIRKPQDWDQKTMQNEHRNAKFEGLDPSTPTAHNKRQRSRHHQSATSANMAQAQGVALSPTFEETGSGEQPRDLTSGNKNPTPRQSRNATQSRRNQYEQELLKLATAMEKSQRSAEDGKGREKGHGNGDQETSESAESKEEIAILRSPQVSMESVPPRTSSRPRQPFSRIDRPELYKKSSSDDKHEDDHGGSSKHTRGRQSSRGAPDARSMERSPLPLSRRKRPASRPTPHSSRASRWKRYEASAHIEHSPYLYDEESRRLDSQETSLRRERPHGRHESLEHLTEPMGRQTRPDEAYNETTADINDQKTTYDYFYLSPTGDVERLQRPDSPEQVRGHDETPRQSYAAMRTPSSLLKLNEARRKESTVANADI

SEQ ID NO: 3797 - protein, 718 aa, Unknown
  Kingdom: Fungi, Phylum: Ascomycota
MAPTIPASAQGGMFHTFQGVTPRKPATEAHDGNKPAGPTGSKRITTPHATLEALSQSLEECRSILKRLYPNHEVSSLLPLSRQELLGMLDHCGESVIALPSPPHNTSPTKTESGSPLGLDSEGSLASLEPLSSRDMDWEEDQRCHEALSSEADDATGLSLHHDRQASYLGASSIKAALVVMLKVQPQLRSSLAPPLNSVEMANNLPVIRQRSAAPKDSSRIPWSWKGQTLIDAYFKRIHVFIPMLDEATFRADYLEGQRFDSPWLALLNMVFAMGSIVAMKSDDFNHINYYNRAMEHITLDAFGSSNIEMVQSLTIIGGWYLPYINRPNMANAVIGAAIRMASALGLHRESLAQGGSDIAAAETRRRTWWSLFCLDTWSTATLGRPSFGRWGPAINIQPPEFGLNQARDSAQHAGILPLIENIKFCKIATQVQDMLASTPLLRTEDRCNMDGQLVNWYSGLPWLLRTTDPCAEPLYIARCIMKWRYQNLRMLLHRPVLLSMASSGPSHQMLEQDLAAVETCREVAKQTIEDIAREWTRNQMSGWNAVWFLYQAAMIPLVSVFWEWNSPRVPEWQKQIETILELLDAMEEWSLAARRSREVVWRMYEASRQPSVVNGTGISSGANITPTTLATTVGQDMLALAESDLHMSPIGLETDDMMSLLDQQGLWDLDGMQWGQQNHGALPVDAGLCGLGDGMMQMDYGAIGGHPPNMDPAFFVN

SEQ ID NO: 3798 - protein, 349 aa, Unknown
  Kingdom: Fungi, Phylum: Ascomycota
MDTSKLKPNDPRVSYETANVNGKTYRYILGLPPNGQEPIDTIFLCHGFPDMAFGWRYQIPVLMSLGLRVICPDMVGYAGTDAPKELEAYSGKSVADDVKELCRQIIGEGQQIILGGHDWGGAAVFRVVLWHPELVKCVFSVCTPYAPPNPKWTSLEEIVRTRLPNFAYQLQFAGPDVEEHVQGPEKIGQTIVAITGGKNTRGERANDTTTGGLDFKKLEGMDESPFMSKEELDHYVSEYMKHEAPQMRGPLNWYRVRKINYDDEVKLLEAKGPQVGKLEIPVLYIGATHDVALPPIMSMGMDAVVAEGKFTRKEVKATHWALWQAADEVNAIVTEWIGDVLGKKLRASL

SEQ ID NO: 3799 - protein, 376 aa, Unknown
  Kingdom: Fungi, Phylum: Ascomycota
MLSTILFIFGLIYLFVRMQPFIDRLRSVRVGPERLRPGRVRSGQSSGRDWPQDDGSYKPSPIDVVVVRTLLTRGRKLPPDLVDDIFDYAEYWAHSSNEIDYILEHKLPLLIAGRSKKEDHFLLRSYPIGLTSLADREDPDDVLRYDTDESKPRPLRSEHPPSFFAKLADYPTPRLARPVRKVVFTVRSKDQGRGGARGSDFPYDQGWTWIEAGLERFDADKTCESYCVSDSRFKSKDSTSRALPTCALRPIFPAFSEKPPQSSSSDSPSEQPVPKEPEYQYDHGYMPAEERLIQRNRTRHREMTTHVVEWSWTDDIKPESDGGQELKNRGRGRATGDGTFVRDLKMGDVITVWGKAKFPAWQNNIEKVRIDVYWAV

SEQ ID NO: 3800 - protein, 532 aa, Unknown
  Kingdom: Fungi, Phylum: Ascomycota
MATTNLTRYLRSLTLQSHLQFKALGERLARHPTTHLSLTSSIFQGGSYDENIQLIPRLVNFDVFDRDLSPKMWSLKKKIITTILVTEISWLVQFASAIDASAPEAIETRFGVGPYVSALATSLFLIGFALGAPIAGPMSEATGRNPVYILSLFCFLISLLIAAVSSSLPFFLMARFAAGFFGSTPLVCAGGSISDLWCARDQLVVFPLYAAGGMSGLASGAAAGGILAYVGSINFAQATEWSTLIIGAIVFVFILLLQPETYAPILLKWKTGMIVDGMKTDERDMAFPPRKYTCLADDMKLLSRTLWVAFSEPFIMAFNEPLVMILSVVLSIMYLIVFTLLPGYISIFSGVYHFGYAARGLTFYGLAVGMLLGLGFAMLLAKYWRKHYPGDTLPTFEAEAPLDFAVLGIPAVAISLFWMGFTARERISYWSPICASVLLGFGILCTFLSSYMYIIRAYGLQAASGLVFITLVRYLLAGGMVVAGVGLFEHIGIAYTFAIMGVMATLLIPVPFLLYRHGSRLRLRSHRSARVL

SEQ ID NO: 3801 - protein, 146 aa, Unknown
  Kingdom: Fungi, Phylum: Ascomycota
MCLQTVRQHMCRHCRSEWTQADILELCPEGDKIILKHGYCAPVSRLLEMGGHHVSLGQIVNPPHQQQQQQQQQHNGGGHIYPLLRTPSIPNATVGMASRVLEDMCEDCKDKHYRDWAVEARARQAQQQQQQAQQQAQHGHSHLGGV

SEQ ID NO: 3802 - protein, 250 aa, Unknown
  Kingdom: Fungi, Phylum: Ascomycota
MSSTEPTEPKVEETKPAETTEAPAADAAAPATDAPATEESKPVTSSSVFSMFGGGAKKEKKEDEDRGDTSGSAKAQREAAAADEDQAPESEDVHFEPVIKLTEKIETKTNEESEEQLFKMRAKLFKFIKDSSEWKERGTGDVRLLKHKENGKTRLVMRRDKTLKVCANHYIVPEMKLSPNVGSDRSWVWNAAADVSEGEAEAVTLAIRFANSENANLFKDAFIQAQADNEAAFKKEEGAEKSEEAPAPAA

SEQ ID NO: 3803 - protein, 539 aa, Unknown
  Kingdom: Fungi, Phylum: Ascomycota
MSMITAAQWVRRGFAAPFPTKYDLDETEYERIAELAKLQLDDAEEDLREAQEENDGEKTKASDDDDEQMEVEGSKKSKKKTSSNADDDDLKEYNLDNYDDEEDDGAPKDGPTSIFGNVKSLAYYNSNKDDPYITLQADDDDEDREDLQILATDNLILSAKVEDEMAHLEVYVYEDEADNLYVHHDIMLPAIPLAVEWLDIPVNKGAEGSEQVGNYVAVGTMEPDIEIWDLDMIDCMYPNAILGQGSNPQSGEKKKKKKSKKTSDAYHVDAVLSLAANRKHRNLLASASADKTIKLWDLNTATAAKSYTYHTDKVCSVAWHPVEATVLLSGSYDRTVVAADMRAPDAKAPRWGVESDVENVRWDPHNENYFFVSTEGGAVHYHDIRNAPSDPTGTKSVWTLQAHDESVSSFDINPVIPGYMVTGSTDRTVKLWNISETGPSMVVSRNLDVGKVFATNFAPDPEVAFRLAVAGSAGSMHVWDTSTNGAVRKAFAERVPEAKGKDEDRLVGVDADESSSDSEEGDDDDEEEDKESDDSMDED

SEQ ID NO: 3804 - protein, 466 aa, Unknown
  Kingdom: Fungi, Phylum: Ascomycota
MAQQPLSSAAQPTDVYGGDEVSALVLDPGYCHTRAGFAGEDVPKSILPSFYGHVASDPPRDLFGDEYLVPRENLEVRNYMNKDSVVEDWDVAAKIWEDMLVKRLQPEKQTPPSKNGLNDDPKEDGEGDIAMDEAEQQEKPLSENPLLVTEAPWNSPKSREKAIEIIMENWGCPAFWMSRTPVLAAFAAGKATALVIDVGGANTSVAAIHDGMVLKRSIQRSPAGGLWLSNQIRNMWDTSDPRVELTPTFMVENKTPVDDRAAAQFRPRKYGFEISPSFKAYEEERVLTEFKESVVEVWRGPGRYSAPGNEDYVKTQPGRVFEMPDGYNQMWREQRMRVSEGLWDENAGFPVPESERLNKSQTIPELIRASLSAVDVDLRGNLLANIVVTGSTTLINGFNDRLNNELMMMYPGLKIKIHSAGLTSERRFGAWIGGSILASLGTFHQMWISRKEYEEHGANIVEKRCK

SEQ ID NO: 3805 - protein, 292 aa, Unknown
  Kingdom: Fungi, Phylum: Ascomycota
MPGWIPKIAGIAAVPALMAASWPYLSDSRTSLTFTNLASDIQSYLFPDSPTNITYECDPLHSYTTQIVSLSPLVIYIHSFLPENDINSLLETATPKFKPSVVTRAGRTSTDPDRTSVTAFLPASDPAVACVLARARKFAGALLEGKEEDEMGSPQLVRYTEGQRFNLHNDWYNLPQRLTVRDGSHRFWNRIGSFFAILEDGCEDGETWFPNVTAVTGPALQSGNQVDDQSKPLWRAHERGGLAFRPVKGNALFWINLDADGEGDPRVRHAGMPVTGGRKTAMNIWPRKYFYS

SEQ ID NO: 3806 - protein, 336 aa, Unknown
  Kingdom: Fungi, Phylum: Ascomycota
MTLTKRLSRRGSQASPRAVRIVARRPSKSSGSPTEAEEPEKAAPVDKEDLPIGFNISEIKFVDDVAQLPIASLTLNVPLIPFKRKPQPPPTPFPFLELPSELRIKIYEYYFEDVDEVLDLDPENYKRYHKLMGFTRICKQIHGEATHLFYSTHSFRIFPTHPARQKHKKPILFRLKPHQRQCLSTLDLRYGPGWGSPPRSWVVNDTLGFKDCINVTQLNVFIECDPSDGIFKGWVRSEGFYEKFSRELLAEVISKLPSLQVVQFDAWSSVKKRGGMMTGLMDVVTQSKLMISWGPERGWTDSLDDDDEVKPTRANIWEPLPHTPPSFASNNLLVMA

SEQ ID NO: 3807 - protein, 405 aa, Unknown
  Kingdom: Fungi, Phylum: Ascomycota
MLFKRLAAAVASLTVVRRDDEPQDLGSILAGHKNLTKYYSLIKKYPDILLQLPSYSGVTIIAPSDAAFDHIPYTALNEIWDPEDKEVTVPLLQYHILQGTVAAGALEAGPSYVKSTLLKDSTYTNVTSGQNVVINKSGDDNVVLTTSMGTRCTLLETDIVFQGGLIHIVDNLLIPPARLDKTTDAFQLPSFLGALYAAELMPGVAEHKNVTIFAPQNKALSLVGGSLDNLDKEELKRVMGYHVVPNQVLVSSSLSNNSMLETLADDTAGNPLSLRVLAEGNNRFINSAQIVQPDILIANGILHIIANVVNPEALAVTPNPDIPTQAPVFPVSEEPGVFTSDLPCTTDCPITTTPTPQSSSDDESATTSSDLFTSDSEDAALPARPTAFAGVALGALGLGAGVVLL

SEQ ID NO: 3808 - protein, 542 aa, Unknown
  Kingdom: Fungi, Phylum: Ascomycota
MATTDSILQGVAILGKVDEAHRKILTPDALAFLALLHRSFDTTRRSLLERRIQRQADIDRGQLPDFLPETKHIRENDTWRGAPPAPGLVDRRVEITGPTDRKMVVNALNSDVWTYMADFEDSSAPTWENMISGQVNLYDANRRQVDFKQGPKEYKLRTDRPLPTLIVRPRGWHLEEKHVTVDGSPMSASLFDFGLYFYHNAFQTVKNGHGPYFYLPKMESHLEARLWNDAFNLAQDHIGMSRGTIRGTVLIETIMAAFEMDEIIYELRDHSSGLNCGRWDYIFSVIKKLRQNPRYVLPDRSAVTMTVPFMDSYVKLLIKTCHRRGVHAMGGMAAQIPIKNDKEANDKAMAGVRADKLREVKAGHDGTWVAHPALASIATEVFNKHMPTANQLFNRREEVEIYQKDLLNVDFPGEITEDGIKKNLNIGLGYMEAWVRGVGCVPINFLMEDAATAEVSRSQLWQWVKHGVKTSEGKKVDKAYALQLLKEVADDLTKKGPQGNKYQLAAQYFAGQVTGEDYADFLTTLLYDEITQVGSPKSASKL

SEQ ID NO: 3809 - protein, 180 aa, Unknown
  Kingdom: Fungi, Phylum: Ascomycota
MATSPTPFTYPPEYNFPPFYTRQPNATTHHAQLTKWSSLVLAYCRHHRIFRLNLLDDESPLFRNTTIDRRLSQRDIRDVALFMHKEGRVEFLSGGVNGDSVFVYWKKLEEWAAAVEQWVDDTGQKGAVVTIYEITQGDGTKGTDLHGMDTEVLLKALNILVKRGKAQIFGQEESQGVKFF

SEQ ID NO: 3810 - protein, 274 aa, Unknown
  Kingdom: Fungi, Phylum: Ascomycota
MYASSECFVATTQRQGSSRAKQNTSEAARGGGPAPGLSGTQTAKISTQAPASSLAPQPSQSPSFNSNLTSNSRIASSSALHDCNRKTHSSSPEDTPTHKPTMSTRRPQFDQERLIDLTPLPDSVPAVKEIGASSAPLLSASFFIGARCRDYNDDYMQCKTEKPGVGEIECMKEGRRVTRCASSVLADINTHCLTEFRKHWECLDNRNHQLWQCRPAEWKLNECVYNKMNLEKKIPNQPTNVTPVELRQKQIFADVRIGPGDGKPFVAAQNEAKQ

SEQ ID NO: 3811 - protein, 263 aa, Unknown
  Kingdom: Fungi, Phylum: Ascomycota
MHFSKIAAPVVLATLTLAQTFTDCNPTLQTCEANKGLDVGYYHVDFTSGADAAWPMILGEAGYDENGVAFSLAGPSPGPTMESDFYFFFGTISVVAKSAPGAGIVSCIVLESDDLDELDWEWLGGDAAQVQTNYFGKGNTTTYDRGEFHPVADNQATFHNYTIDWTPEHTSWIIDGEVVRTLNFNDAVGGTNYPQTPMRVKLGIWAADATGNAGTVQWAGGPSDWSQGPFSMHVESVTIVNANPATSYTYGDLSGSWQSIQKA

SEQ ID NO: 3812 - protein, 387 aa, Unknown
  Kingdom: Fungi, Phylum: Ascomycota
MSSASKVTTVIVGGGQIAQQHAKYIRASEGCDLVAVIDPFDTGRQLAESFSVAHFASIDDLLSSYTSLNTPEPELYYVCTPSGLHVPVAIEIITKASPKAILVEKPLSTDTVSGAELLALVKEKGCKLAVGHHRRFHPRIVAAKEVVTSGSLGLITAVTSVWTLKKPDSYYSFAPWRASRAKGGGPVWTNLVHDVDVLHHIVGSRIVRLWARSTTRRRPAPSTDIVPADDLVEEGAAVMLEFENGVVGTLVLSDNVASPYNWESASGENPSIAANTSEGGLDAWRFFGTKGSLSAPDGIVWNYSQDKATKLGQEVGWGMPMERKALDVKEGIPLLRQAEHMARVVRGVEKPTCPGADGLAAVQVCEAIVEALDIRNMGPIELPELST

SEQ ID NO: 3813 - protein, 579 aa, Unknown
  Kingdom: Fungi, Phylum: Ascomycota
MGVVDNDGPYSHLKYAGVHDAILQIELPTRVIKRESIDSESGGYPSSSEDPTDADSPEPWRPLNNPGIDPKAANASKIINKAIRKIVQERSRACDSVRNGDWHISSEMVMRAAHEAMPPPKPVDNFFDDLRHLPMAPTRLNNELVRTHLQLLCRFKVSIDGNPGPDNAFMRHWIPYTIQEPAMLQVVLYTSACFLKETGHVPKTLAMAYKGAAYQALNKSLRNEKTQCSDGVVLAVGQLVMDEWYWGSTADLHAHRHGLRMMIRMRGGLQYLGMHGFLAKMLLLNDAGLALAHEIEPGLFDRPGYEFEDPIMVPFQTSLNSPFVSGWPTFASSSSSAPMHPSTAAILDDMRLLIETVLSGMGENFEHADPQKLASTVSWIEQRLKTLPHEIFQLPDRHSREPSKSPTADSNDSTYSSPAERVPNAPDPTYSWVRRTATIYCRAISNRQPLSMACTPADFEYLWQFTFRIQTDGSWTTVGILFWVITAIIPASLSHPGTRFMKTVMVCCLMNMGVDNWHVATDAVRRALKLQKWLEGGRARDNRIFGGGKGIDKHGFALKDKLGNFGLTPHYEDGEFDAG

SEQ ID NO: 3814 - protein, 324 aa, Unknown
  Kingdom: Fungi, Phylum: Ascomycota
MNTDLNRDIQVQSEAAAMCLFKEALGPLDQSLVPTLYGWASNSDGHGWLLTGLLPGESLGDKFEVLEQESKRSIIAQIAQILKHIQSYTLPSTVKGYGGLAFAEDGAVVVGGTPFPGGGPSTTHSALYAEYLDTQMARSEQCKVIKGWKDTDIPSRLAKLNSTFSGVREWEKDLRPTLVHGDFGVVDFDLAHIGCQVEEYMWSLFSLGHLLLPVNKSSEDVTLHRQFLLHGMKSTAAELVSQPKSFIDWEVTLMADEEFAKAGVIRPRDVPALEHIQTRYLVTQAISPPIFFQAKSLTYGPETLEKMKLGEQEELENCLEQLGC

SEQ ID NO: 3815 - protein, 688 aa, Unknown
  Kingdom: Fungi, Phylum: Ascomycota
MGTSASQVPSKYITLVSADGFEFVVLRQAAMVSPIIKGMLDVRSQFAEAKDARCVFHEMSSMVLDKVVEYFHYWYRYRNSDDVPDMHIPVELCLELLAAADYLGLDHLVKPTLNDKQPRIYIYHFPPQRRAICSNMTAEVFETQGVRVAIEGCGHGTLNAIYASTAESCKVRGWDGVDLLIIGGDFQSVRNASDLTVMSCPVKYRHLGDFPSYYSGDRVAPYLTIFIAGNHEASSHLWELFYGGWVAPNIYYLGAANVLQLGPLKIAGMSGIWKGFDYNKTHHERIPFNADDVKSFYHVREQDVRKLLLLQSQVDVGLSHDWPRSVEDHGDSSWLFSKKPDFRADARDGKLGNLAAKYVMDRLRPSYWFSAHMHIKFPALVKYADEAKDDAAVQATAPAEPPMTAPPQDANPDEIDLDDDDEDMPDPALSAPQQPDPEPQPTETNAVSDELRAQLPASFAAPPPHLRRTPGQPVPDSITNKEVRFLALDKCLPGRHFLQLCEIQPYDQASLKEHPPLKAPSDEGSTSTFTPRYRLQYDPEWLAITRVFHPSLVIGDRAAQPPRDLGEAEYLPLIASERQWVDENIVSKGLLDVPTNFEETAPPHIDGSPEIVQEGPKEYTNPQTTAFCKLLGVRNLWDASVEEREERLAAGPPPASERGGRGRGRGFGGGRGRGGRGRSRGGRGRGGW

SEQ ID NO: 3816 - protein, 723 aa, Unknown
  Kingdom: Fungi, Phylum: Ascomycota
MLSNALKSIITLCLAGQAMKQTHVEAAQTRVAVYRGPATLEGTPESAADLFTSAWKDSKITYVGPKERVKVTKETLKDFDVYIQPGGGDLTPAWRDVKKYQKTIQDFVAGGGHYLGFCVGAYLAGPDEGFNLFPSGVRADQEIDQRNSQVDDEENTVIQVDWTFSSGDKQCKTEKNRWLYFQDGAAILGKVGKDGNKGKVLGRYSKSKDVAAYVVGYKKGIVGVVGPHPEADKSWYDDEEIENPTGYDLDVGRDFVRAVMEYKEVTSSRLNTPWLNTPVASAMDFTEAMVGMNQRVRLDVEGNVILPKPPGRLAPATLSEGEAYGQCQCASCSAPGCTLWCSACDITDIGKIRTFYCSYECQKNHRSEHKDNCTARLHVARASSILFALFYGFEKATHIKATLKIVERDGVLTMGREEDFPRAWTGGHLFIKFPEEALPAGTPKDVADSVLLDQTCAEIATTSKPLLSLIMERGSSFIFGAYRHPLTTPAAFVKSMQVATGTTRNPARVLYAYQFPSMMGNGGVDWAHSVLKIRAGKSEVYALDLSGAQFGWKDILYDWNTYAKHRSAPDIELCPIAQMNQVENMVLSMCAPNTVHGAQKELRRRVMDQYVSQLRSLLNEHFLSLRPDGDISAIMKLVKKKPEDFVAAKEKILRRALEYPQVIVNGLGNVGRMYMSPTFDECVVLTEEEAARYAKVWFEEGDPRVKDLSMSKLQALWRKRMSR

SEQ ID NO: 3817 - protein, 615 aa, Unknown
  Kingdom: Fungi, Phylum: Ascomycota
MASTSLHPSNIQSIMALKVTIVEVGPRDGLQNIPDHLSVETKLELVRRLHQTGLTTIELTSVVSPRAVPQLRDYAQLLQDQSIQALLSDRNGRYPVLIPNVKGLELGRKHNVKNIAVFVSATEGFSRANTNRTVAQGIEISAQVAEAAIKSNIAVRGYLSCIFADPYDGPTPPRAVLDGVQALLNMGCYEVSLGDTLGVGSPRQVRHLLKYLLDNGIPADKLAGHFHDTYGQALANVWEAYNCGIRVFDSSVAGLGGCPFAPGAKGNVATEDVVYMFQEAGVETGVDLAGLVQVGTWISEQLKKPNGSRAGTALAQKAKSTNKQTSGGFKSTPATAVSWQLVKEFDGLLVHRSGVNLKLTMNRPKKGNILTTSMIYELTAEFSKAGEDPTISRVVLTGEGRFFCTGMDLSKDKTAVGSGGEASDAQFNRLYGLFDAIDRCPKVTIACINGPAFGGGVGLAFACDIRLANKSASITLSEVKLGICAATISKYIVREWGVAFAREAMLTAMTVSPAELQRKGIIMAVADDADGLRSLLDSTLLNLRIASPSGSRMSKELVKLGWADAGQEGQDRGIKQIFDAMMKPGTDGAFGVKEFQAGRKVDWDERGAGKTLSKL

SEQ ID NO: 3818 - protein, 544 aa, Unknown
  Kingdom: Fungi, Phylum: Ascomycota
MAASEASVPAAVTGKAEGRRSPPATTTAQSKRDRRRQALMERLSTMNDKFQRERDMTYRDQLQKIQFDTSLVQRFDPYDPRALEVIGDLQTEHRQTQGPDVNHERARSLLDMAGIRFSDFIEDVEDLIEIRDFQLAQSKNEYERKVQEYKNTYTYKVETAKREHRALTSTLRDRLINTLTQKKNRLNREKEVLEINDSNALLLNPNQFSLTNPASPGGTHSKRATRLRKDADDLQMYGDAKKRKRNPGEDDGSPAPMRRALDPNNTTSLWQSEKARAAAKQNGPVYSIDKLFTDKELTLHYNTAALAAHQYILRNQKNGNASSPDDSDSGNLDDLAEDVESLPSAPMMERQISHATRSTRGANQNYVDDKILGIEAIANFDPTNLNLVHAQEPPKMPPYVPQQYLKPYPRTADQNFPTMLSADDISSDLAIIGHFKSYDQTQRKPGAHLDTATGMRKMLENVAIPYQKGRFVAYTSAARDDPESIRDGLGLPSMSSLRDASPGPAPAAGSGHAATAMSRTSSVGGVAMSRQGTGGSNRGRGRRG

SEQ ID NO: 3819 - protein, 411 aa, Unknown
  Kingdom: Fungi, Phylum: Ascomycota
MLPCRVATLSTTTGTRLELKRILLSDELSEYTEEITERKISESRDVHKLPGPAYRPVRWGQPTSQKAKDHQFRLNDSSIKYYYTPRLGADLSEGFDTFVKNDDSKAEHLDSLLKTIAAHEEKTGQKIDANLVTWRGMMTKIMAAPFERFDGFEMNVTLYDDCLFIEEDHESKMHSRRNEQPAKPRRGPPLEYMQFWGYKFETLSTLPKPWAETPRDFIENREREVVNNKEQYCSVVRTGVGATTLCLGGEVDAIWDSKPAVPGSPINWVELKTSQEIRGQGDMDAFHRKLMKFWIQSFLLGVPKIIVGFRTRDGILAEVKEIETHTIPETVNSGPNPQWNADMCVNFAAAFLDWLRNTITEEGVWRIRRQPQAPTIEMFKIEETGHGRIITEDFKNWRIKLKLGPDPSAEA

SEQ ID NO: 3820 - protein, 203 aa, Unknown
  Kingdom: Fungi, Phylum: Ascomycota
MGALKYVEELQKKKQSDVMQFLLRVRCWELRQLNVIHRASRPSRPDKARRLGYKAKQGYVIYRVRVRRGGRKRPARKGAQYGKPTNQGINQLKYQRSLKATAEERVGRRCANLRVLNSYWINQDSTYKYYEVILVDPQHAAIRRDPRINWIVNPVHKHREARGLTATGKKSRGLNKGHRYNKTKAGRRKTWKRHNSLSLWRYR

SEQ ID NO: 3821 - protein, 481 aa, Unknown
  Kingdom: Fungi, Phylum: Ascomycota
MSAPETKSKENAKGKTVLKIPKGTREWVGPELMLRDHVFNTLTGVFDRHGATPLDTPVFELKEILAGKYGEDSKLIYDLADQGGEICALRYDLTVPFARFLAMNNIKNIKRYQIAKVYRRDQPAVARGRMREFYQCDFDIAGEYDAMIPDSEILRIMVEGFRGLGLGKDVTIKINHRKILDGLFQVAGVPEDKIRSISSAVDKLDKMPWEDVKKEMVEKGITAEVADTIGQYIQKAGGRDVLDFLKASESAVANETVQQGLADMELLYNYLDAYQIADSVSFDLSLARGLDYYTGIIYEAVIELPSEKGPKSQETRIGSIAAGGRYDNLVGMYGKTKIPCVGVSFGVDRIFTILKQRNEQEKLKQRSVDAFVMAFGGKNGLLVERMSVARELWDAGIKAEFSPKAKPKLPQQFKAAETAGVPIAVILGEDELAAGKLKVKVLGLPKDHPEKEGKDVERGQLVEEVKRVLAEHGGPTSLALR

SEQ ID NO: 3822 - protein, 695 aa, Unknown
  Kingdom: Fungi, Phylum: Ascomycota
MSSKRQQARNEKALQDLVHNVAGNNICADCHTRNPAWASWSLGVFLCMRCAAIHRKLGTHISKVKSLSMDSWTNEQVDNMRKVGNVVSNQIYNPENKRPPVPVDADEADSAMERFIRQKYTNNVAKKSSSRSSPQFDEGTPPPLPPKNSKFGFRSATSSLFPMSRSKKEKAAAEMREPPSPNMTNKPSKVFGTTVGYDDPDETEKKMNRLRDMGFQDTQRNAMVLKGVNGNLEKAIEALVRLGEGDRRSPAASSPIDPPPLRTSKSMTPLSSNSAGLSFGLSVGGKANSDRPFTPSSATTSNNPYDAFPTPQPQTAQSTGSLQNNNPYNTHSTNPFGPVRQSTDPLSQAFQGLTVAAPQQLFPNHTGGPAAQQPQPQLQQQQQQYQQQQQYQQQQVIYQQTPTQSYPSSPQNYQGLPFPTMPSMTYPQPSQQPIHQQQTGYNPFFSNNMAAPQQTQMSQMQQSMSMQNLSLNTGQTQLGGSSNPFARSPTRIASPSMLGQIPEQSQSTFQSMSPASQQPQQAPMTNNPFFTAGPVQSPAQMGQQQQYFAPQRPDKASIMALYGQSAMSSPQPTMSPQPEQQQQMYQQQQPLSPNYATYAQQPTSPAAPEPLMQLQRAQTAPVAAPSHAPMSPAQNPNSKNPFMNASSMASPTAPTDPFASGRHVTRESIILGNDMAWANGRHSPDAFASLSARHG

SEQ ID NO: 3823 - protein, 87 aa, Unknown
  Kingdom: Fungi, Phylum: Ascomycota
MEQTTQQQPSSPETAPIMMNESPVVDNKGDRRMSDEWDAAKTPPSRFQKRKGSIYATPSSRDGHIDRNYADKYHAKIAEMSSKPAKQ

SEQ ID NO: 3824 - protein, 347 aa, Unknown
  Kingdom: Fungi, Phylum: Ascomycota
MPSTEHFGYLISNLGPLTTTFTAAVSCETQNLALADQRAPFNFLDEEDTPVLWRSECDFPSLASDCQPSASEYWDLHTSFKSGDIEGYQGWAVYHSPASICPSGWETVGLASLSSGAETASQSGIFTKNARPDPTLSLGGWPLYAADWLVGALEEGEQMIWCCPHTALTEMIRNHTVYTNGVCLSKVGPWDPQEYDQFSTICNYGYADEPTEIATVTSFDGTSWNPPLLSYDFGDEQSFTSYKETLPATVAATTTSAEFEVVHSVVALVLVNKSTDNGKSGDNNDSTGGNDNDNNDDDSKDNNDNGDSGGSDGDNDDAAPSICALSFLPFTMVGIGLLAGMGILMPW

SEQ ID NO: 3825 - protein, 248 aa, Unknown
  Kingdom: Fungi, Phylum: Ascomycota
MPPKTVLAFDLYGTLLNTGSIASTLAQILSDEDMAQTVATHARRLQLEYSWRVNCMGLYKGFDELTRASFRQAAREQAGYKLTALDEARLMQAYNGLDTFKDVDEAMKILRDARSKGNNNVEAFIFSNGTPSMLSESLTTSPALSSASTVLPDTKLISVEGAGCYKPDPRAYKHLVEVSEAAAAENVWLVSSNPFDALGAVAAGLKSAWVDRDGQGWRDGLGVALEMRPTVTARGVDGAVRDIVAMSQ

SEQ ID NO: 3826 - protein, 309 aa, Unknown
  Kingdom: Fungi, Phylum: Ascomycota
MAARGAAGLTEAMGSLRIGAKSSNLSRTFTRSMATEAARAQSLVTSWKPISTVPLTIHSFPSLEPASLEQWSTQHLYLPLRRDLLHLAVVYEGDNTRQGTASTKTRWEVHGSHRKIRPQKGSGRARLGTRQSPLLRGGGKSFGPHPRDFGTKLNRKVYDKAWRTALSYRYRRGELIVCEDGMELPMPEEFLESPAKYLKDGLQEAYLEKYMVGVLKNLGLSRKQGRTLFVTGDQREMLFKAMAQVPDHGRALDLEDVDVKDLLETGKVVMERSVLKEMIKQHQSDLIANVFIHGAPSTGPATGQKVLGQ

SEQ ID NO: 3827 - protein, 995 aa, Unknown
  Kingdom: Fungi, Phylum: Ascomycota
MGSICAGKAAVKCGQCLVSRANSLKHMSIWNARALSSSPSGSNTKRTIERDVLVSVLEAAATKRDAKGYLQKYAPRNPDSLSRTPRFLQDKESDTLQLLPEGSSNIAIVKLRAPAQLDGQTLEGVARTLDQLRVLGLLSVVVLDCGREATVQDCTDQAFRLCEAIDKFGKPGSKLSANIFTRESKPNSTRPSFLADHLKVDDFGVLEQALQLRLIPVLPPLATLYPGHAPETTSSDDLVLALTRYFSGLQLKSIDGNSTTAEDQIEPKGKLASVERIIILDPLGGTPVSTHPNKSHRFINLEQEFEPLTTYLLGSGSQASGSSSVDSSSPAAIHASNLHLAKEALAILPSTSSALITTPAAAANNDKAGTTTALAASFGGFDDMVTTRKKQNPLLHNLLTDKPVYSSSLPMQRMQPDAAKTSQEKRSTSSSATLVKRGMPLTIYPDPWAEPWRAPKPGSPQLRLTDRCIDLPRLMFLIEDSFNRKIDVQDYLNRVNENLAGVIIAGEYEGGAILTWEKPPGMSEEEAYRAGRMVPYLDKFAVLKTRQGSGGVADIVFNAMVRDCFPEGVCWRSRKDNPVNKWYFERSRGTEVLPDTNWKMFWTTPGFLPGDITHQDYEAWFPYQPRLSTPSSSFSHLHPTTAASFNYLSVSPATVDIETQAQTSKLLFLLSPSSASPKMDFKNFGKNLSDFGAQITPFASRTFQYTKEQFGQAEDRTQLPPDYIDLEKRVDALKQAHQKMLTVTSQYQNEAYDYPPNIKESFQDLGRTVTEKVHLLSSATSPAEAQAALVAPPSAKPQPKTFSHALARASLASSQLLHQHHTGAGEDPLATALEKVALAEERVGEARLAQDAQIQSRYLAGWNTTLNTNLQFATRARKNVENSRLSLDAVKAHAKGTTFKIGAAEQGQEPELSPEAQEEIEKAEDEFVTQTEEAVGVMKNVLDTPEPLRNLSELIAAQMEYHKKAYEILSELAPVIDGLQTEQEAAYRKSREEAS

SEQ ID NO: 3828 - protein, 562 aa, Unknown
  Kingdom: Fungi, Phylum: Ascomycota
MLGWREMSAARLGTGWFGIPWADNVTITITITITNTEPSQFSFFISNNSTSTVAMALLQLDLRLVVIAVVIIALGLLVKSSRAPRITRDGKPLRNPPNTLPLVGNGILFLQARQKLFTWFTHCIHQTGPETLSITVPSLPPGVIISSPANLDFVFRNESTFQKGHFFTHRSHDLFGSGIINVDGELWKLQRRAGLQFLNRENLRGLTEVALPRVVEESVRRLEREGEEGRVVDLQEVLHEITTQVMGKMAYDMEMHVHDDFTKAFEYASGATAERFQNPLWQIIELFTPGGFKLRRSLAIVRSQGKQIVSKAVAARANRVKEQRKADEKGDIDQVSGSLIQSLLDSIGDEKLVADSALNYLSAGRDTVAQALTWTFYLLMRHPEFFQKLREAILGTAGSNLPLDELLTPQRLSPTNMPYVLAVFYETLRLYPPIPFEIKQAQQDTTLPDGTFLPAISVIVWCPWAMGRSFDIWGSDACDYRPERWLSEDGQVQHRGAAEFPVFNGGQRLCLGKKMAEEIAVQVIAVLVSKFEFEPAYEGERESVSSLTLPMKDGLPVYCRSR

SEQ ID NO: 3829 - protein, 390 aa, Unknown
  Kingdom: Fungi, Phylum: Ascomycota
MSYYENNPQWTGQPQPQSQSQPQSNSWDSGSSTPVRAGANGPQHQDEYAFSYQFDEVDRAYENLQKSGKGYGMGGGRRKFSPMHGPGSARRTPDFEGGRMPHGPGPRSHSMNSFDESRGGPQGQNLHNFYASQRNQSSRGSNEAEQVMQAKRRMAAQRERELRNLHTEQQYQRNVMTDMNAPPASAPPPPASNSGSNKHMSEEETRELIARQRSALYGEGPFADQGGYVDENGSVRTGAPGPSGPPSLRGHSPMTFDGIARAPTGEAGTPGSATDPTSLPKDPSPRPASTSSPQTGAPTNKVFDNVGPQSRTNTSSPTGGSPPRDLAPGSKQGQSGASVAPIGTRPSGTPTGNSSAKRSTTPGSSSGGWGRGNGVWGQPSGLGTQASVWG

SEQ ID NO: 3830 - protein, 150 aa, Unknown
  Kingdom: Fungi, Phylum: Ascomycota
MQLFNLLTAATLATAAALPGSLQTRDLDILPGHCCFRLKDNAGKLLEQASTGQTYISSSQPLGWYCLDISSSSAKVLRDDANDACIVDSRGRFNCVDPIPGAVAWTLTSAGELKYGGSTTWSNCGGMIHGGARDGCKTTKLKVTGKRGSC

SEQ ID NO: 3831 - protein, 551 aa, Unknown
  Kingdom: Fungi, Phylum: Ascomycota
MSRPHTSETKPLLGAVPVIGSSSAQSHQRTEAQPTHSSDSESNPGPQPSRAVEDDVLPETSALGRTLSWGSCFILVISRVIGSGIFATPGTIIREVGSPGLSIVLWLVGGVVASCSLAVSLEYGSMLPRSGGDKVYLEFTYRRPRFLASVVIAVYVILLGLTVSNCIIFSQYVLFAFGHEDAPAAERKCLAAGLLIGITSIHVIFPSAGVRTQNFFGWLKMGMAGLMVLCGLYVVLLRKDQVKEDATTRHNLPWDSLWEDSVWSWSAISTALFKVFYSYAGLDNMVNVLNEVKNPVRTLKTVSITALVTACAMYLLVNIAYLSVVPLDEIKQSGELIAALFFEKVFGPQLGRTVLPLAVALSAAGNVMVVSFALARVKQEIARQGILPYGSFLSSTRPFGSPLGGFLLHFIPSFLVIVLPPSQGVYSFVLELEQYPAQILSLLLAIGLLRLRYQRPDLKRPFKAWRPAIAVKMAMSLTLLATALVPPKDLYKDGIFYATYAITGTSVLLIGVLYWWVWTVLVPRWRGYRLEEDVEVLEDGTSITRLVHKVE

SEQ ID NO: 3832 - protein, 197 aa, Unknown
  Kingdom: Fungi, Phylum: Ascomycota
MAVPVTSDIDWLNIRCPESLKETLPTPTYGYNGGLFTVCTELIFNAPAIDIYNALLDFQSYSSFSSFVIDIELPAHINKTPDDVYIGLEMVFTTKDIFPIFNTTSVEIVTVMDGSDDGGYMLAAWRYDDTLGGKFSRSEHPNILVEQGDGTTRYVSYETYYNDPGTLLLVPFRKQLQDGYAQHGEDLKAYVEGLQQA

SEQ ID NO: 3833 - protein, 851 aa, Unknown
  Kingdom: Fungi, Phylum: Ascomycota
MAHRTNHDVSQTEPLLGSNATEPSARRDQNGDIPAGTQQGTFKKNLGALEAFGIIISIVIGSGVFTSPGSIDTNVPSPGIALVIWLIGGVLAWTGAVTFAELGTAIPGEGGVQPYLQRIYGDVAGFLAAWTWVVAVMPATLAILSIVFVESAYSAAGVTGEADRIEHKLLAILILVIMSVANSVSTKASTSLNNFFVAVKFVAILDVVLAGIAVLSIHVAHPKREAGGVDWYERSWFGYRTSVNPDGSKTHWEQLSQWEMFGHYSAALYAALWAYSGWDKAVYVSEELSKPEKQLPLAINSALSITIVSFLVANASFYVLLPWQVIATTDSVAVTAITRLMGRVSGIIAAVLICVVVAGSLLGNSFVASRMAVAASRRAWLPSIFAVIGRVGKPKSSDAASEDDTKSISDAPINAVILSALLASLYILLGNFRALLTLNGLGEYTFFFLAVLGAIILRYREPERRRPYKVFIAFPVIFIVSRKSRAKGEMEQVTTKDASTGNVVAQTHSTKRRPACVACQRRKLRCTGSFACCDRCKSRAITCVCAKKSPGPPSSGTIHKAQSVSTNESEVDPTMGFSSNLPAPGMADSLYMPAGETLPPFSMPSDPASFEAMQQIMGGVDYQSFPTPPTTAPSTTGSSSSCSCTQNVVQVLSNIEEDQFKLTRLSLDQVVQLQKWLMYQCCTALECPRCHAEKSVHTLLVLICERILLMYDCAAARMAKTAQIHTTTRSAVDATKGTDDYACSYPTDKPAQLFCGISGVPIETAHCQGGICSPEQGSQYTIEEQVCMVHALMKMHMKSFRGLLDWIGGTCEESGNLARTRKIEALGARLVKAGEQIDAFAGMIMNRFEMT

SEQ ID NO: 3834 - protein, 685 aa, Unknown
  Kingdom: Fungi, Phylum: Ascomycota
MSTMPPDHHRSTLMRTSSAAGNMAAPSAKPKPAAAAKASNNGSAKSKSQMHRRSRTGCYTCRLRRKKCDEGNPMCTACRHLGLECEYKRPMWWSNNEHRRKHKDNIKMIIKRKKLSEKSAHSISTSVNSPPGLSHSLPTSATFTDPLDRNRSASIDSHFSSAFNFNSPPTEYGPFNGQMPHEFMFGNFSPYEIDVKTERQMFVNDVPTLRESHVSTFSTFQTPPPPGTVLSQGPINAEWTEQSHHEHRRESLAEEALDVNFFDFSHGHPAEASQFKVELDENDQRLLEHFIQHVIPTIFPILESNQHGSVTSSMILPALQSNTIYLHCCLSIAGQHLKATRGDDGSNIDAEIMNHRYATILGLCEALKRDEDHQQILEVTLAVIFFQSVVGRLDDGLLDVPWHQHFQAAISLVQKLDLPRLVSNPAEPMAQTPFNMTLTSWIDILGGSIQGASPSFAHTYREKHLSKVNPYLGLRELMGCDDRVMYLISEIACLESLKKDGMDDFTLCQHVSSLGQEISNTELPEAPKLPFNANGTLSPKQLSRNITQAFRLAARVYLCSLVPGFSPSQSSPMALIEKLVGVLQYIPSGPEGFDRSLVWVYLIAGSMSLPGSSFRNFFEERVAQLGEQANCGSFGRTLTLLRETWLQNDALSSVSPPTSPGSDAPRPYVHWRDVMQSKGWDLLII

SEQ ID NO: 3835 - protein, 183 aa, Unknown
  Kingdom: Fungi, Phylum: Ascomycota
MHDNTPNSSSNTLSYHLQWNHSEPAPRVRPSTTPTSDSLHRYPITTTLTQFSLVSTKPFSSTQLTIARRTMSTAGKFEYLVIVPDKPGMLAKRLEVRPLHFDGIKPQRDSGFCKMGGALFNETPQGDDPSKWDFMGSTLVCWAESKEEIIEELKKDIYTTSGVWDMDKVQIYPFKAAFREQLN

SEQ ID NO: 3836 - protein, 560 aa, Unknown
  Kingdom: Fungi, Phylum: Ascomycota
MADAEEKARQEKIAAAKKRVEQMKKKKGKSGASKKAKEEPKEEPKEETKDETPEAAPSAEATDGTPEQPDDSKDDDVAVEEKPEGTADEPKSEDASSSEATTLAQQSKLRSTSFRAASGAGPVSPGPFSPDGDTAPDIYRKNVARIEELEKENKRLAKEATDSEKRWQKAEEELADLREADGETANGGDESLKSEIASLKRQNAQLQQQASRSGHAHRPSVSLAAPPADLSAELESKSSTIESMEIEISKLRARVDRQENGASSEKEQITALEEKLARAEAAAGKAQRELQDLKKNLERTTEKAVREGSERSSAETKVKTLEHELAEIKEAKSELDAKADALEQKAATLTTLHKDQDSRSQSLRKEKEKLEKEVKELQEKADKLESENIKLRARKSGEVSGGLDDEGMEELENEEKIRMKKQIRSLEAELHELRSGAWIDRRREMEGASPGFQDVDLGGGGMLGTPGAKKHSASHGGIGDFFTSGLNALAGGGGDDELLDDDDMDFDEDAFRKAQEEEQKRRIERIKDIKRSLKHWEGWRLDIVDIRRGGGEGIGDIFDV

SEQ ID NO: 3837 - protein, 1109 aa, Unknown
  Kingdom: Fungi, Phylum: Ascomycota
MPIRSRFTVDIPRCSVQSWILGPPSTSLPDFKAWIDPDDPSHFVTLSGARLLAKRIAIGLRLHGVQPGERVLICSGNSIYFPVLVLGIWMAGCVFTGANPGFTARELAFQLRDSQASVMIAATQNGKLALEAAQACGMDVSNVFLMEQGKIRDINPATTPGTGNDTLAMPQSWTHLIASEAQGHDFHWDEPENSEAAVCTLNYSSGTTGLPKGVEITHYNHVANSIAVERFDALDPRTDIDASSKASLCVLPMYHAYCQLFYMCNLPRARTPVYVMPHFDFPKFLNHIEKYRITSIMAVPPILNLVAKHPLAKKADLSSLKSFGCGAAPLAGQTQDTVLGMLGADAMVRQGWGMTELTSTGLVWDPRRQINTALGELIPGNQARLVDVETGREVTEANTPGELWVASPTLMRGYWRNPQATTTAISMDANGTRWFRTGDIVKVDKYGPGALFYMVDRAKELIKVKGYQVAPAELEVLLLQRNDIVDAAVIGVLVNDKECPRAYVVPAPGANMTAGAIVAWVSERVARYKWLTGGVVFVESIPKNPAGKVLRNKLRDVVQRDVELPKPLARQELQDERPIDDPDLESFDGRADISVVILDDYLYMLGGHVAHELDGKQKVGAINSTLSLSLSDDWYAADVEINTFATEDGPSFIYGNGLWPNPKDDEIVLWGGADVASNDVGARDRKIWKLKPDGSGGGSWSSEDGPNDIRRTTRAGYAACGGTGYALGGRGNGKTDKAAFEGESVAVPGLATYDFEDGTWQNHSTTDVTKDGTWARGEALCVEMPDRSSKLLVLGGAHGTNEGDTNDFVYVHYWDPEKEKWFKQETSGTRPSPRVESCSVGVPGPNGTYDIFIYSGWGGTFTDGSVLQDVWTLSIPAFRWFKGSLSNPQGRYAHACTRVGSQMIVVGGGNRRDWWKSDDTFDRGFGIMDLNSMSWKNEFQAKSQEYESPEPVREWYAKNGYDTTVWENEEVQKAFSQSSNNDGNDGNDESTTNTSPSPSSSNTEDPDSDPGSDSSSPNTAAIAGGVVGGVAGLALIGLAAWYILRRRHRQPQVRSHAPESEQGYYVPVKPPVEADGSPSTRYTSTPQMGHSQYPQELDATGRDRPVEMP

SEQ ID NO: 3838 - protein, 609 aa, Unknown
  Kingdom: Fungi, Phylum: Ascomycota
MAPHQDIELNTLNTLKLKEDSLAQGSSFSMREPDYNENGTQPPGFFDRVVDSFRRDPNSVLFPSDHLGHVESGGRVHNGTHYYDLHQASLETAHTPLARKLKGRHLQMIAIGGSIGTGLFVASGRALHTGGPASLLLAFSIVGAMLYCTCQALGELAVIFPIAGSFSSWATRFLDPSWGFAMGWNYAMQWLTILPLEIIAASLTLGYWDPDTTRAIFVTVFLVLIFAINMFGVKGYGEAEFIFSFVKVVAVIGFILLGIVLNCGGTPDRGYIGGEFWHHPGAFNNGFKGLCSVFVTAAFSFTGTELVGLAAAETANPRKSLPTAIKQVFWRITLFYVVALTLVGLLVPSDDPRLVTGDTANTDAKASPFVIAIKNAGIDVLPDIMNAVILIAVLSVGNSAVFGSSRTLAALANLNQAPKILAYIDRRGRPLTAIILAGIFGLLGYLADLDDQNNVLDWLLAISGLSSIFTWGSICLCHIRFRRAWRARGRHPSELPFQSQVGVTGSYVGLVLNLCVLAAQFWVGAFPIGWRSDTTLDIVQNFFLRWMGAPIVLSFYLIHKLYYRTSYVRIADLDVDTGRRDFNVPILKAQEQEERATWPRWKRVYKFIC

SEQ ID NO: 3839 - protein, 396 aa, Unknown
  Kingdom: Fungi, Phylum: Ascomycota
MLVRNGRCVPVGLRRRWTLLLAIAVPLMLYYQLFLRYDTRPGSDRPRLRYPGFHVGNAPSQAQNYTINLVIASRRRDDTSWTQQLTDVMPNLQVIRYISDYLPHQPLPEYHPPTPKKGREATVYHTYMHDFYHDLPDISIFVHGEEQPWHIDGVLQQSLPFALTHLDLSRLAARGGYANLRISWFESCPTWIDTTVSEKDATHKEEPFVGPAFEANFVDEDVPPGFAGPCCAQFAVTKEAIQRNPRSQYLSSRRWLLRTQFRNSIAGRTWEYMWPWLFLHNAPKEFRDHAAVNCPSEWNSYCSMYGICFTDTTSGADDITAGSEYNEKWIEKETLRRDHLEEWWNRLLHPFRAAYAAKRIRAIEQELDKALTAALENGRSQELRDRAFAGLFSDEL

SEQ ID NO: 3840 - protein, 355 aa, Unknown
  Kingdom: Fungi, Phylum: Ascomycota
MSTEEKPTLRWGIIATGLISSWFVADLMVDRPDAKANHIIQAVASSSAEKGKAFVEKHLPGQSPRVYGSYAEAYADPDVDIVYIGTPNSFHKQNCLDAIAQGKNILCEKSFTLNVKETKEVLAAAEAKGVFIMEAMWTRFFPLVQSLQDMVHKQKVIGDIQRVFCDFSLPQNIHTLGSDSRLRNPALGAGTLLDIGIYSLTWALLGLEKPLEGKAAAEKPTLLAAQTLFEGVDTATSIILKYADGRQGIATSNSSFTSQLPFCRIEGTEGKIIVGGGAAPVPSNFTVIKPNEEDKKYDFPRAGRGFYYEADAVALDIAAGKKQSTVMPWSETVRVMELLDEVRRQGGAKFPQDEE

SEQ ID NO: 3841 - protein, 455 aa, Unknown
  Kingdom: Fungi, Phylum: Ascomycota
MAFDDDDVPNAAITPSVGDDAAATGEDAMDEGMPDYKLFNSLSGKKTISSKTIRKGEKDFESHGTMAQDNTLEASRQAMEEVLSYTRIHREETWVRGWLFPDHWADVTEDEVQATFNMRERVVVIEHEKGVWTRDTGRVVTGDREKAGTGRLWLLPEEALHLVERGTLDLWWPTKGLDELLPPLASDVESTPPGPDDYDAGIPLSLEAAYSMLIGEDGDKGKISLSKYQVYTHLKRAGFSVLRAPPTPADKPAASRTSLWEWLLSLMNQGRAIQHEPAGPLVKPGLYRAYAPIYQRLEIIQRHKPTPTPTASTEPEDPFRVFYHVWKPSPTPFSKKNPPAPDFRIAVSDTLNTYVPTLDEITTLLDSQPYEPPPERMQGQGKLYQRLKHGHRNVLIAVVDCGLVNFIRFGEGAFGEEELFRRFDGQGGMRGGKKGGRGGGRGRGRGRGRGRGGRR

SEQ ID NO: 3842 - protein, 921 aa, Unknown
  Kingdom: Fungi, Phylum: Ascomycota
MASPPPSAPAPELEARGNDSASEVKLKTNGHLPTDPKTDTSAPSAAKSAEVSKPLVNGGADSAGDAAVTKIETEVVKTEAPGPSASVAAELESSESKPANPEKSGEPAHNEDADMKDASQPESSDAAPLTGNAVDKPVEAVEKSPETVIEAAKEEVMKSESSNKDDTTPTPAAPASPSKKSANDSGDVAMGGIVSEVTAMPATTENDESLLPTSEVDMGPAGMSQLAIDGTEIETSPAAPDETVAGDAPIKVAREREDDAPEEPAPKRARTEPKEDEVTGPIIAADAMDTTPGTPAESAPLESIEALPATATSDAPSLSSLKWDDAEKDKAVITPHQRREIRRSLGKAKKTKSGGHFRDSVEKLWPALWDNYVARIEKPMDLGRIDRDLKETNVYTTFGDVKADLGLMFTNTLAFNGPTHDITAAALNAVKTIWNEVKTIPAEEPTKPKPFPKAKPVRESRIAASPELNKRQSSGPAAAGPGTQAPASTKPGADARRDSLADDRPKRTVRAPKSKDIDYTSKSRKKLKPELQFCDEVLAELTSPKHWQINQFFLEPVDPVALAIPQYYSVIKKPMDLGQVSRMLHGGEINTVKEFDKTVRLIFDNCFQFNGPPDQGNAVSIFAKQLKDIYVAEMKRKDAWLAKHAKANAPASNPSDDEDDDEDEEDHETAAQIQEMTTNIRVLEAKMREESTKLTEHYAADSPDQLLIQVQQNIVSVVQQTLLDKKTKLAELRQKSDKPGKKAKGAKSKPSGSKKAAGAVPKKSGGNKKSAKKSLNAAEKDQIANAINDLEGKHLDRAIDIIKNDTGQNENPDGELELDIDQLSMTALLKLWELCKKVLPGFVKESSSSGPVDDGGKNSKNAQPKGKKNKPMSAQEQEARIAQLEALSSMYKRPGDGGDVEVTQAPTPTNESSDESSSEEE

SEQ ID NO: 3843 - protein, 448 aa, Unknown
  Kingdom: Fungi, Phylum: Ascomycota
MDTPVIPAPSDAREQAILDEFVLIRDQLLLLKQDRSKYIKSDDVIPLYNRMIEQVSQLNAIRDNAVSQEENRVDRVMDSCFQLLSLFYLTIGRNNEAPAAYSLTSTIKRLLDHLIEADLYSAKDLESIGATLERLSHSVKQAATRTDGNQHSPVVITLVTKRVELCQALLQKLQERLKRLGEPVLETHERLVTLLRSIALANTKSKFSTSEVQKLKNKLHEIGEKRIEGKFCAEDGSVPAGGEEVCDLYQRCTYWADLVLERQGVMPEPFRPTYDVLIGIRNDLEKLSLTQAWSLRETDLYDFQRKLDKIDENRGAGGNFHDEKGRPADLWVQRTMLYLIRRSYAYIYSFMISSEPVSEALLPIYNQLQTLKRCLVEVKKNGGVSSDRELYPYSLKLNSLDNLKVDGKFVVNGDIPEGQGSVSELLAECFDLNYELRTNAAEDDEQTV

SEQ ID NO: 3844 - protein, 351 aa, Unknown
  Kingdom: Fungi, Phylum: Ascomycota
MPHTLVTGANSFVGAHVISALINAGYTVTGSVRRASAGADVLTEHPEWKEKLDFVEIADYATPGVWDTVFKEREFDYIVHVASPMVGDEKNTDYERDWLLPAVNGELSLLKSAQQFAKSMKHIAITGSINAISMGDDLADRVLTNESWNRVSQDEARAANHYFVSYCSSKKESELAVWEFVNTANPSFGVTVFLPPLIFGPPIQPIRKPISQGINFSVDILHSIWNGKYEEIPATMFPSWIDARDLAEAHVKSLTAPGARNKRFLVGGFPLTNTALARSIRSQAERGDLPRSVLEKLAKEGNADRNTAVPKIEAGEATEALGLKFRTMDEMVKDTVERILELQAHEQRAKG

SEQ ID NO: 3845 - protein, 298 aa, Unknown
  Kingdom: Fungi, Phylum: Ascomycota
MKFTIATAALMASTAMAAPSPEPWCDKKGQSCWKRDVAVELDARWCDKKGQSCWKRDAAAEAFAEAIASSGEVEARSPESDFSNAPGGASYYAKRQLNELAGLVALTQRDPEAFYASLGLENRFYADTEGELAAKFKRDDASPWMKRSALPEAEPWCDKPGQPCWKVRRDADPEAEPWCDKKGQSCWKNKRAEENDKRWCDKKGQSCWKAKRAAEAVLEALAERDAEAFETKPFDPAHFSKREAEPWCDKKGQSCWKREAIAEAEADPYCMRPGAACWAAKRDVEAMASVARSIIADQ

SEQ ID NO: 3846 - protein, 268 aa, Unknown
  Kingdom: Fungi, Phylum: Ascomycota
MSWMDSWSRPGKSQAVPPPYYLTNPQTKYCHTCGRIISERKSHKAAEASATPPKYCSSRCRGLKPRGKDRKVEAAFAALLDEKTEFNEEDIPKAVLDARQKPKAKGEKRLTIPCSAVETLIYGDRSDPTKVYGRRKNRASRAIATPDDSDGEGASTRVYHVEDGNEAVPTAFAGKVRPSQHLASVNGSIGGEKGRAEREAETAEDTEKRLEGQKIADEKEAVKRAARRLCIFGVEEERGERRMCEAVMQGSIVEPSFAKGDWGVRWRE

SEQ ID NO: 3847 - protein, 642 aa, Unknown
  Kingdom: Fungi, Phylum: Ascomycota
MPMLKDPSKKYKQFKPLNLPDRQWPSKTINKAPRWLSTDLRDGNQSLVDPMNSETKFKYFQMLVELGYKEIEVSFPSASQTDFDFTRRLIETPGVIPDDVWLQTLSPCREELIRRTVEASVGAKKAIIHIYLATSACFQRVVFGVTQEESIELATKCAKLVRSLTKDDPSRQETEWAFEFSPEFFSSSDPEYVLRMCESVKEAWGPTKENPIIFNLPATVEVATPNVFADQVEYFCRNISERETVCVSLHPHNDRGCAVAAAELAQMAGADRVEGCLFGNGERTGNVDLVTLGLNLYTQGIPPGVDFSDLESVIDVVASSNKIPVHDRAPYGGSLVVCAFSGSHQDAIKKGFQAREKENLAYDDEWEVPYLPLDPQDIGRTYEAVIRVNSQSGKGGAAWVILQHLQLDLPRGLQVAFSTVVQSKADQLGRELQPKEITEMFRKTYFLDSNPRFEIVDYAIRPDRSSSPAPPEPGRTQDTKNLKRLFEGVVAIDGKEYHLKGRGTGAISSLANAIKAVGINLDVQDYKEHAIGRGRDVKAASYILCTVAADTKQSVWGVGIHEDVVQSSMLALLSAASNFVASQPPGSFVAKEPENSTGSNLSLDAPPVPAVPSAHTNGGASEPASELVNNLEAKVADMGIAS

SEQ ID NO: 3848 - protein, 560 aa, Unknown
  Kingdom: Fungi, Phylum: Ascomycota
MASIHRPQEQGVVDDKGNLLVDFVVDELPTPGGAGLLMPPRASSQHQVRRVKSSSELASESTTEPPKPKDESKWKNALGEAQYFAGGLISRPAESTRHYSIIRHSRALVWYRGPATSVSITVLADTPLPPTRTLWLQQKGFSGNMGMSLKALVGTTSGWIDVTPASKAAPEHIDPVDERGIQRDVKRFMKKASGRTQLHVPRETHVVRIPASAVDGYFRLVLCCGDEGAKKVLCGSPVFRIASTSTDPTVVRGSSLSTMPLEMGVKVASTVGQTVAKKYTGVVGAVVQSKAARALPNAAVKKAANAAYKRSGIGTTVGDSWKAGKAGRYNPLVEVSSLDGPVDVVGLDAGPEKPFPVTFEGKVVRGTGWSTGELAIPTANLREVSEEVKMRMKGVFAAWACILPKKGLEELSHDWHEAIVTIAPFRNATPGIVIKNKVAVHFIHDFESASFYDARVKVLLMAHLHPPNRDDDPDELIREHAQDLMITLASLSRENWGPMEAATRMKTLKSERSFQERLDGATGKVQKGVDRIPLHWAGVRSESGTSRDEVYGIGGLWIPR

SEQ ID NO: 3849 - protein, 212 aa, Unknown
  Kingdom: Fungi, Phylum: Ascomycota
MSVGNYSLPALPYAYDALEPSISAQIMELHHSKHHQTYVTNLNNALGSYATAVSSNDIPAQIALQPAIKFNGGGHINHSLFWANLSPASSPDADPKSAPTLIAAIEKTWGSLQDFRAAFGKTLLGLQGSGWGWLVKDGSALRIVTTKDQDPVVGGEVPVFGVDMWEHAYYLQYLNGKAAYVENIWNVINWKTAETRFTGGREDVFKVLKASI

SEQ ID NO: 3850 - protein, 426 aa, Unknown
  Kingdom: Fungi, Phylum: Ascomycota
MNYPSPRTPGHYPDNSYEYWDAGPSPTPTPPYQPMATPRRTSTAWGHVRGTSYSSPRPSKDSPRFNSQGYYATATDPRPSVSDKHFYRPSGATQHSSKRERRHSSTFVRTSTPYGESDEDEIFEAWGRTYVLPAQSKSRRSKQPFNSSHPQGYWYEDGAWFADHDYLQSTAPMYAAEFQEPLPPYPGIRSPTAAPPLSTPGRPPTVQAHRRQASGPVPYRPGTAVPRTARRPSVSTSTKQPPKRRQATEKDRAKYAIREDYSTKNWDPEEVPILLLGSVFDANSLGKWIYDWTVHKMGPTTPISDMAGDLWLLLIKLYGKVKKAEDTVIMVRTPEAEETLDYFINVGNKLQEKWLSLLKHCEKPMLAAGKKKDSNSLGFNSGVRFVETLFGRDKRLEETEKFMAKVREFILRFDNNCETIIRNPTR

SEQ ID NO: 3851 - protein, 226 aa, Unknown
  Kingdom: Fungi, Phylum: Ascomycota
MSVQGQLGTAANASNGHPQAKIIRVQPTFHPSDAPESSMVQSTLKTLDLDKHIEGGYFVLTDLSTQSIPSPYPPQALSPRTMAITAAFHDGTISPTRLLSTTIYYYLTPHRPMGSFHKNRSKIIHTLHRGRGQYVLVRESGKVETFVVGKDIEKGEKLSWVVEGDVYKASFLLEDAPGKGSEGLLISETVVPGFDYADHEFLEEQMLRKLVSGAQADALKWLVKDH

SEQ ID NO: 3852 - protein, 1100 aa, Unknown
  Kingdom: Fungi, Phylum: Ascomycota
MSNRYGVSYRNGSADGGVGAGEPPVAPRRRDREGSERSAGGYGGFGRPSNDDYDPYGDSYSGDNNSRYGTPPQASSRPPPPPTQSLRAPPSERSVGSRSRSRGETNAERQITQVLEHIKSEWPAMYDSDCVPVQLALQLLDNSSVGRAHDYRKFQQTHNYLQDSLKGIVHEHHQGFNSSIGTFHKIQSSIQVSQKRVRALKESLAGSKTSLCTTDPELKKLSKTSQSYDELLQTLNELDDLRAVPDQLEARISEKRFLSAVDVLQNALRKLRRPELDSIGALNDLRSYLANQETSLMDILVEELHEHLYLKSPYCQDRWQSLSKAHSSGLEVYSDANAITPFHTVLDSVEVDKPVTEDPMRNPEADTFYYISLLVESLNKLGRLQDAVDTLKQRFPVELYSIVNETINDVDQRHPSSLRGATAKPEGLHVYTTRETQMRADVIYDLLWSLYGKFEAISEGHRIFHESIKALIRREGAGNNSALLGTFKELWNLYQAEIRSLLHNYVTTDADLYHFDKLGSGPSLNGKDGNRENLFKFAEADNKSVDMVTEYDALENIIQATVPGLTSTSRKQAIDKKNRSAMDEGVSRKTVGSTYNSAQQPMGSYKSLVEPSVFNMSLLLPPTLVFLQRLKGIVPPGSDLATSTLTSFLDNFLVNVFQPQLDETLGKLSDTVFGETDAFLQDPNWSASARRPVFKGTTAFFEVVTAFCRMLGTIPPDQALSSLIVTQMMRYYDRCFSWYKSLVTKTQETAGAETKLRASARFALDGGELQDVMKQLWGSDTGDIELVNKEIQLLIEQTNSSRLEANDVIQDRDTISSLCLLYTSMKWLAVKIASLRSITTNEADSSRQLNKPGSRRWTLLNDPSKASSEQGPVTLPLTQDTAHIVSSLEELASTALLTLHMEIRCQIVRSLQIALSPDVAPYILDQEVREPDPQILTLNSELINFDETTVRYLRDKEASFIRTGLGLLINGFLVHNARSASPMNSKGNGRMQLNILVLQQNLKNVEQGVDLARAANYFALFDEGADAIVEKAKKDKERAENGDESEEAQTEEKFSFEELKALVELCYSEQVANPERGIASAAKRQLADKLLELSEHAWQT

SEQ ID NO: 3853 - protein, 598 aa, Unknown
  Kingdom: Fungi, Phylum: Ascomycota
MSYACKMKAKQYDLVPPQSPSTSRAPAFSIWSKLLTAFGLIFVWYQWSGPSVAFLSDLKIAPSTDLQWHRCYEDRYDCARLELPMDWKDPDSAGRVVIALARLPAKSLTDYKGSMFFNPGGPGGSGIWALQDHGDLIQEIVGDNYDIITFDPRGIGASVPRVECWANAQQRWVWEAQEAGLVDSHDGMLYDLFARASAFSQACEKNANETGILSHLSTASHARDMLEILDKLGEEKLKFWGFSYGTILGGTFAAMYPERVGRLVSDGNVDYEEWHSGTHINFLRDTDKVMDGFYSMCHQAGPKTCALYEETAEQIKARLDALLDSLRVKPVVALMTTTDGQGLPELITYSKVRKFISATLYRPVQKFGPLADAMAALEKGDGLAYQTIVNPGANALPDTCNQDPTPPTTPLEALFEGTDDAFPAIMCSDAEPLTETVFEFEEYANALQKISKVAGAVNVLFRISCAGRTIRPEWRFNGPFTGNTSTPILFIANVADNVTPLVSARNNSEGFGGSRILVQNSLGHTSLAAPSTCTARYIRSYFQNGILPPVGTVCEPDKLPFDLSPAAVGKSIAGDDSLSPTIRALSERVGGGVGQIYT

SEQ ID NO: 3854 - protein, 216 aa, Unknown
  Kingdom: Fungi, Phylum: Ascomycota
MSNPELLPTLLSTITTHILPLTTDAISSGSKVFGASILSSTTLKPYTTSTNNERLSPLLHGEVNCIQEFFTKSYPDPSSRPDPRTDCIFLATHEPCSLCLSAIAWSGFKEVYFLFTHDDSRKRFGIPHDINILEEVFRVKAEGESEEDLKERQLYNRENKFFCARPFADLAEEYKDEAEKQKWIAEIERVKNLYDGLNETYQQGKEAGTTTSSIWK

SEQ ID NO: 3855 - protein, 1163 aa, Unknown
  Kingdom: Fungi, Phylum: Ascomycota
MSPPTQKERDAKIVGTELAEVLPQTDKYWFQQPHLLRLNLLLCIPLLSSSVSGYDGSLMNGLQSLHQWREYFNHPTGETLGLINAAQSIGSVLALPFVGNLSDKFGRKPVILAGIIIICIAAAIQAASINYAMFVVARIIVGFGGMFVVQPSPMLIAELAYPTHRGKYTSAFWTLYYLGAILASWMTFGTQVYETTVSWRLPSALQAGFPLVQLIFYKWVPESPRWLVAQDRPRDAAAILQKYHDPHTVDSPLVSRELAEIIQTIHNERLAKTTGWGALISTPGNRKRTLIAVCTGAFAQWNGIGVVSYYLTLVLDSVGITDTFTQTLINGLLQIFNFAAALGAAFLVDRLGRRTLFLWSGIGMFVSYVIWTACSALNDETGNKKAGIVVVVCLFTYFFHYDIAYTPLLFGYPTEIFPYSLRSKGLALELFAIYGSLIIAAFANPIGLDNIGWKYYIVFCVLLVVFFFVTYFLFPETKGYSLEEIARVFDGEDAEQEERIKEAQQGKLAETMEPSPDVHLTEVETRLERTEAVLRQMRTLVPPHLRSWERPSTTPAPLPNPPPNESFDFSSEPQQGNGAPEAYVMVKQRTPATTTNMPQPMHSSDADNDNQRMLEGPPEDDFEWSEKDPIHHHGLSPNGPGDGNDEDSPISDGMASLTVSEREAGYLGVASGAALLRLLEPGAQSMIDAYFQKYHVSYPIIHEPTFRAQYSEVIPRPNGPCWTVLAYVVAAIGVWTSATSTTDTLDLALFSQARSMLSFNYLEVGNLTLVQALTLASNYQQKRDKPNSGYNYLGLATRMAMGLGLHKEFQGWSISPLNMEVRRRVWWTLCAFDIGASITFSRPNVWPYQGVEVAFPLNVEDRDLTAASKVVPPETTQVTPYSAVTTQARFHMITYECYDRVISKPLPTAEQLLRLEADTIEKWQASVPAYFSEETVLPPKYALAQAVMAWRCRNLRIIMYRPFVIRKALRKREETDQASIKAYERCLQDAKSTINMIAKFWGSNTHDRLAAWYGLYFLFQAALIPCICLRNDPSHEFSSDWRSQISTTLKTISAMVPFNTSSIRCHQTITELCGRFLDRQQLEEASIPAPFNPNPAVQADAEMDTTTATWTGDRPVGESPQTQINGVFGMMWANGDISMENDAGWMEFLRAGSDEAFTSFTGS

SEQ ID NO: 3856 - protein, 761 aa, Unknown
  Kingdom: Fungi, Phylum: Ascomycota
MERKRKLPARAAARAEQSKKRNVTPKQRSVTPAPPLAPEPPVEEEPPAPPPLPKSLQPGQPLPVVEDAQPEDLSAEEYQSVTESGVLAESLTRSRHKWIHEGLFEKYWTKPHKRKGVLQEDPKNPPKDSMTKVGNVTINIEPHIIEATMYIVKAPKPPPSAQPAPLTQQAQHQQSPAASHPQAAAPQTAPSRPILQYGPPNGAMPPPKAQSPAVSTPPTPVVAAAQLQAAEVKAAQSAAPTQSPQQVGQDAKIKTESPRPQPAAVAPAPMAHTTQALAAPAPGAPAPGAAPSAGQPAAPTAQAPAQPPKSGLSMPPGLSAGSSAAGRPSPAPGQPGTVARPAGVTGTTGKPAAPAPKSAASDPVIALLAQRASGDAELRDLMKRVAMGQAKPGELSHFQQIIDQLNTEYKRSGGQQGPSADRLLVDGKTVKWFAGEVRTILDIVLASNPNQKSSELKPPPRSDPLVVLLVKTALEDQRIRDIIRRIAEDKPGPNDTQTLKDTLDKLHRDARAAQLQAPPATQARPAGPNGHLNAQPKMHPHQHPNHPNPQSLRSKGPPPAPKPDIAAVVFDFGTGDRYLFPKYSILDTLTTPSGQQVVASFLIVRKGSTSEYGGDPKLDYYQPVTIRLQTQTGRQLENMTRVVAPVEEVRRYMDDVMDNMTRAEYVLLAMRLPRRSPEDEKAEGTADAGKSKPATPVIQPSIEPVTAPRPAVLWTTAAASKSASGSPAQRPIRMSDPEEETELRYQRLIQAVTAAKDVVPV

SEQ ID NO: 3857 - protein, 464 aa, Unknown
  Kingdom: Fungi, Phylum: Ascomycota
MAVAGPTPLEPMHKIGDGTMVIRQDDETNWPGLVYENMPDWCKPGLAGVMLVSTLAPEYRAQALATAFVGTSSGVTAWKACEAWHHNPDLNQMCSDMGVAVGSLASLVAAGFLTAHTYNSQGAVAADSSGQPADAPAKRGDFESLLTDDLRKRGLVFDKVNVLGFDKRGADSDSISTSYEILNMRDENGLAVDHLVHMHEDGTGVGKTTIPSPLARRGLEKRHAGPGVKVSYDFPKLWSGARPEETPIRIVGDSIGMDWEGTMNRDGGDVNTYFARAAFTDSTTMALRVTIYDTDFDDGYENVHECGKVASNNLEEKGVGLLWAESTKYEETWVAVNWQMTLPTPDTHPSFPLWRLGYTSQQVYDLFFPSNLLFLCNPRRPAVCGRFGLPSDRLWRFEFAVAKNEDDHAMAGPAKVEEVIGPYITHPGERYGFVNKSSTSTCASQVLTLNKAAFQKTSDILPIA

SEQ ID NO: 3858 - protein, 290 aa, Unknown
  Kingdom: Fungi, Phylum: Ascomycota
MASSPASAVSLPDKRSLSYSLDTTPETAPIVLLSNSLTAPFTCWDHVVNQLNQKGFRTLRYDQPGHGESSVPEPLDSNTFDSMATDIHHLLQSLSIKKLHGWIGVSMGAATGIQFVTKYPGVVERLIICDTISSSPVNAGADDLFAPRVEAARKAGNMDSLIEGTLKRWFGEAWIEANPEEADRMRKLMLRTTIDGFETCCHALRSETFDLRPLFGKIGASVDKALCVVGENDANLPETMETMRHEIEKGFQAAGKPQEVQLKLVKNAGHVCFIDGFDQFVQDVLPFLES

SEQ ID NO: 3859 - protein, 511 aa, Unknown
  Kingdom: Fungi, Phylum: Ascomycota
MKAAQIALSAGIATVQAANCSESYLTYASVPHPPYSSGKYELPYMRPAQDCRTYRVDEIEEVIEKQEKIITDPDLYQLFRNTWPNTVDTTISWHGHSADNEDEELAFIVTGDINAMWLRDSANQLQSYKPILHSSSSSRTEKNDIAALFRGGINLQARYIRQSPYCNAFQPPVESGLEPQRSEQEDVVRPEYDPDFVFECKYELDSLAAFLQLSWDYYDATGDADFFAKYSWKDTIETILDVAKSMRQGTSAEDGSVLKSPYNWLRRSDRATESVPNNGEGDPVRGDIGLIRSFFRGSDDSCTFQYLIPSNMMLSSYLDKTAGIMRSIDKDLAREMQRMAEEVHQGIEKHAVIEHPEFGRIYAYEVNGFGGANLMDDANIPSLLSAPHLGYRANPKVYANTRKFVLSRSNPYYAYGPVIKAIGGPHLGPGMGWPMAVIAQIMTSDSDKEIVAGLKQLLGSTSGLGLMHETVNSHNDTIWTRPWFSWTNGLFGQMILDLGEKRSHLLKRSYQ

SEQ ID NO: 3860 - protein, 231 aa, Unknown
  Kingdom: Fungi, Phylum: Ascomycota
MAHTNGTTGKPVLFVDIDNCLYPRSTKVQDLMAQLIDEYFAKHLELSIEDAVRLHKEYYTNYGLALEGLVRHHQIDPLEYNTQVDDALPLEGIIKPNPELRALFEDIDRSKVIVWLFTNAYVTHAKRVVKLLGIDDLFDGLTYCDYSKQPLICKPHFDMFKKGMKEAGIEEIKDCYFVDDSALNCKSATEFGWSVAHLCEEGIKPPPTKAAKFQIAHLNELRTVFPQFFKS

SEQ ID NO: 3861 - protein, 617 aa, Unknown
  Kingdom: Fungi, Phylum: Ascomycota
MADANGPAPDAAMPVFTIYNLPPSPARWDRIGIAFLTFAVAWTVLIYTCMAILLYHRNSIPALRVRSLPLSFTAIAFLHCYWVLAWLVYPIGGTMPVVLAYDVQYFFMGIWFPLGIAVFMGANLRFLRVARRQKRWVQPNGEARGVEERDGCNGAKSSWFCKLRNWGYMRRVMSFIGFGMTAQVVLTVGMWAACKKYHPTFGIPGTEIKGDTLPEQMIDLGRGWEWWPSVLWQVIWTWVVAPYLIWKAWNIRDTMGWRTQTIGCCISNLHATPMFVISSYVPAFNKLNQYYPPSQWIHLGIMMIEIFTIFIPLYQLIKHRHLARKAAILNAKWDTQSQISNAGTASTAIGSNPFIDPTSPLRSNHYQLSTSPNFGEKSSTDETLLGGGRDALQQLPLDNEPEEDQDRLLTMSALERVLHENPIPLQDFSALNDFSGENIAFLRRVMAWKRDWETRDFIDKDGERVDGRLGLYNRAVDIYTDFVSPTDAEFPLNLSSSVQSTLEKLFQPALAICPPSPTTPSAVTPFDTPSSHISSSSTRAFYTGSIPSTFTNSVFDAAVAHIKYLVLTNTWPKFVAEMQSRRRRSEETMRSSSVGTEKSGSTIVSKVSEVFYSLLRK

SEQ ID NO: 3862 - protein, 454 aa, Unknown
  Kingdom: Fungi, Phylum: Ascomycota
MSLSRNDTSSVAPQDRFPSGVLLPVIPPDDLPERAPRSNAATAASAAGVRALSAQVVAFYFRAPAKAFFRTRVDYLAYARNIHNAQTAGLFKAMAQDASGGRFSGMMRHTWLWMRSTTPGVLTSAIRHEGWGIVPHQILPPLIANIGVGAVLYTSYLSILALLHEDSGKASKRVYPPPPPSATFTAGLLAGGLQSVLAAPLDALQARYDHRDLMPSDGSGRPRSMWSFGAEKLREIGLRGIFAGWTLSLAKDSLGSAVFFSAFEYVKAQGYYRFVTWYYGGLGEEIVDLLAMKRPTERRHKEDEQTVIRPHYAIEPMFLLAAGTSASFAQQLLLHPLTHFQVKHWDHLEELDEKAAKYRASYAVDKADQPRRRFRMLRAYYHAYQESLAVCSAEAKGEGLTLTRWLYRGFWWNAIRQVPSTSAGLIIFELIRRKYGFGTEEVRITKDGYDILLN

SEQ ID NO: 3863 - protein, 529 aa, Unknown
  Kingdom: Fungi, Phylum: Ascomycota
MSEKSETTEKMTKHSPGLRDNDSVVAGRSVTTTDLTQAMNHHHHGPGLQKNFSLLSLIGIALVVSNTWAGVGGSILVAIFNGGPPGVLYEFLVVATFYCFVSASLAELASAIPSSAGVYHWATITPGKAYGRLNGFLAGWWNYLAWVCASASMAFIWSNTIVQIYRLRNPDFDPQAWHVFVIYLISTWLACLIVCFFNSAMPHLNTVGMFIGLFGFLGTVISLAVLPGRATGSGYASNSFVWKEWKADLGYPSGFVFVAGMLNGAYGVGVPDVVSHLAEEIPNPRRNVPLAMGFQMAVAIVTGFSYLVTLMYCITDYDGLFESPFPLAEIYLQGTGSTAGCIGLLLVLLSTIGLGMCGLYVTAGRTLWTLSRDHATPFHSKLSEIHGRFHMPLWSTLFTAVLVTALGCIYVGSTTAFNAFVGAYVLMSSSSYLAAILPHLLTARRNVVYGPFQMPKAVGYLVNGVACSYMLIWFVIYCFPYSLPVTAANMNYSPLIWGGMTLILGTWWLVTGSKRYQGPPEEVLALLSR

SEQ ID NO: 3864 - protein, 1181 aa, Unknown
  Kingdom: Fungi, Phylum: Ascomycota
MSTPILAALALLTILIAATIEILAQRSTAYGGLALSPSLETVPRYAMWSYLYAPNVVAVLYSLVWSWVDLDVKRMQPWFELSKEDGATAEGSLFLDYPYDFVAVAPWKALKRRHWPVVLAGTTMMLVFWTITPLQSAILGTGVVILTEQAPVYAVSRLSPVEKHADLLDPEVLNNGYAVGWLGQAMPPFMTRDYGALPVYVNQSDINASKTNWTVTTSSYSTELACWPATAAPRSTEVKWEWDFLNGKGCNATINFNAKSNNSLLYFGYWSSPFASHSLAGPDCPVSSVHNFLAVWMETANKTEMEPGIFDSDYNVTALFCEPQYFKQEVLMTVDSDTQQPIDGAVEAKSEKQLVSSDEFNMTAFEYLIGNGMPEVLGPRDLPFAQVVEQHPRLDGSGFDIPVTNMVGFALAVRNSSKDSYADPLILQEAFSSAHKYLFSLAIHQLLVNDTGPQAILSGNVTFAQTGIVVSRAYSIAVEVLLVVVSIATLVLVWLVRSSPCALAQNPSSIQRIGDLLTPETSFLSCLETVDNADESSLRDKLCFIRLSLTRPRRGTPFIIRLDGAASSEDCELDPLANRDGFYDPIRPLALRKGSGLAFTMVIALAIAFLVYLKTEEIAQRGLIRPTENFEVLQLLENYLPTIFATMTEPFWVLLTRLISMLQPFRDLWKGQAPASRTTQSTYTSIPPQIVAWRALRSRHFVLVLACSMVFMSNILTVGLGALFNEAPVTISYANTFSPIRGARFNNESVTGFDLRISKLLQATSYYQDHMYVALANITNGTPLPPWTTSDFFFQPHQLQPSQLTLGNAASYSLKTRGFGAQGNCSAFKETDVPVDLPAVPALDGQTIECPNFYDAARLMIRQSTLTRPSGLSSVELFQTFGSSNIVENCEQPLVMAFGRTTNGTDMNATMSASYGICRPVFKTAMFNVTVDPLGNVLKAVQMEELGDTLDYPEATTHQQILLDMMSRTVGWGNAQWHNDTITRDWMPYFLTVMLDSRATVDPKEPPPDVEKLRPTIEDIYRRLFAILLSLNQDLFEEPTEAVEAIDGSMSSGAESYIETRIFMDLPAFIMSMVVLALNILVASAIYFRPAAFVLPRMPSTVGSIMAFIAPSRALWKDYVRDNSTFSFGRYVGLDGRAHVGIELDPHVVPIDPASLKLEQTWLSRAVRRRRGSRKPTGPWL

SEQ ID NO: 3865 - protein, 193 aa, Unknown
  Kingdom: Fungi, Phylum: Ascomycota
MSGSPPSPSKEADQPVHSPDADNPDMDSGDPHAGLGGFDYDGVKEQDRWLPIANVARIMKNALPENAKIAKEAKECMQECVSEFISFITSEASEKCQQEKRKTVNGEDILFAMTSLGFENYSEALKVYLSKYREQQNQTNRDRVVGDNPGWQGGMMQGDKGDNAGDGVEGGAEANYMYTGAGAHNGNGNGEGY

SEQ ID NO: 3866 - protein, 646 aa, Unknown
  Kingdom: Fungi, Phylum: Ascomycota
MPERPAVVSYAAGASLAAVALIYVFGPTFALDGGQDNSSSKKKTIVGLRNQANDCFINSVLQSLAGLPDLRLYLIREIHRRRIEDPKVYTSIVPPDEGDETWQMPQWKLQGMQEGLVTQGLKEMLDALNERPIAKKSISPHPFVRVLEVAFKQRISRQQQDAQEFLQIVAERLKDEYHAGQRARAHARKLGLTASTEALPKSDATTTTSTLGIITPPEEERPDGDESASNGLAATATLPSETTLAPSNASTDKIQIPLELEEGFPMEGRYESQIECQTCRYKTKPREESFCTLTLAVPQVSSTTLSACFDGIFKTEYIDEFKCEMCRLVQTTTNMEHELSRSTSETFREATKTKIERLKAAMEIDPENPPEDIELGDIRYAPKRKIAKTTRLTVFPKVLAVHLSRSIYGGAVTQKNTARVSFPERLPMGSIADPRKYKLLGTVCHKGGHNSGHYEAFRRQNPPPPPYSHGKTFQRSDVYSRTPTPAGTPDLSALNTAGASPAVSTPDLLSASSGDSSSALSLDSTTPPLNHTNPPRSVPSPRDPETNSLRSVAASTKSAFSRLASPRSDGGHRTPRNASPAPSPSKNGAAVNGNGSAKKPKKRVSDKWWRVSDEKVKEAKTSEVLGMQKEVYLLFYELERGEKEWP

SEQ ID NO: 3867 - protein, 543 aa, Unknown
  Kingdom: Fungi, Phylum: Ascomycota
MRLIDCKAEPLRQEVFEEWTCPPFAILSHTWGADEVTYQDFANVQARQTKQGWAKVQTACSVARQHGFDYIWVDSCCIDKTNISELAESINSMFRWYNIADVCIAILDDFDATGGDWNLLQQARWFTRGWTLQELVAPQEVYFYDKDWTLFGTRSSLVSQLSSITAISSSILMPPPGVLIRDLLDDVPVARRMSWAAERQTTKKEDIAYCLLGIFGVNMPMLYGEGAQAFVRLQEEVIKDNNDLTIFAWLSQDGSPMRGILASSPAEFANTGSLEAINDSKFNPEFAMSNKGLRIQTLLYPTNNGEVIMPLFCRPPEAGVDQVGIVIKHQGASVYTRTNPHMLGRVSDNASASSSSNIFLTKRVKSVTPQKMNSSQRQVFRLNPSYRQNGSVRLVQAGPEELWDAANHEFLTSGLTEFAAFIRFHVEAANPGQFVIACGFHKSGGPWVCVDDESGLLYLTAVGGDYRHLAELGKSRCIKKDKMTSHNLMARIGGNQSYAIRFAAAKVRWSYEQMESELGVSIDLEVKKNAMPMMPYRIGASRN

SEQ ID NO: 3868 - protein, 356 aa, Unknown
  Kingdom: Fungi, Phylum: Ascomycota
MAPSKLRRTRVVCISDTHNATFKLPKGDVLIHAGDLTNQGTHSELSKTVKWLEEAPFEAKIVIAGNHDITLDEQFYSEHGLYFHNQKPQSSLVCQALFAESPSITYLCHESATVRLKLPDGPHTEFTVFGSPYSPAQGLWAFSYETPQSPTILTGLPDLWRAIPLNTDIVITHTPPRTHRDETDERRARGCEALRQSLWRVRPKLAVCGHIHDGRGAERVEWDLESRNISFAEKTVTRWTDPGEGNNKLSLVDLTGRKEPSLINDGSNSACSDAERSVTIGFSSDDDTNSSLSTAIGKGGDSSSARSDIAALLGRMGRRETCIVNAAIMKSRYPHVGGKRFYKPIVVDVDLPVWYE

SEQ ID NO: 3869 - protein, 749 aa, Unknown
  Kingdom: Fungi, Phylum: Ascomycota
MYEADTTEHHRLMDEPGIPDAFEMRERTRDEYHPGHSDDDEETVKLDDEEEEDSPYPEVRAAVRNYDEDLPCNTVRAWTIGLSLTIIGASMNTLFSLRQPSIAIGPLLAQIIAWPMGHGWAAVMPTRQFRTFGITWSLNPGPFNVKEHAIIAVMASVSFSVAYATDIILAQLVFYKQDFGVTFQLLLAITTQSLGYGIAGMMRKFLVYPASMIWPGNLVAVALMNAMYESHEHMDSSVLGGTIPRYKWFGLMTVFAFFYYFIPGFLAQCLSMFAFMTWIFPKNPIVNQLFGGLTGLSFLPITFDWAQITGYIGSPLVPPWHAIANTTIGVFLPMSDTHTYDNTGQRYDINRVLTPDFTLDEEAYKNYSPLFISTTFALAYGASFAAISSLIVYTYLHNGKTIWKQYRNSSTEKPDIHMKLMRKYKEAPTWWYMSLFSIVLVLALFTVTAYPTNLTWWAFLLAVVISFGFSLPVGIIQAVTANQIGLNVLTEFVYGYIQPGRPLALMIFKTFGYITMAQALRFVSDLKFGHYMKIPPRTMFMAQVVATTFSCFIQIFVLNLALKHIPNVCEDHQENKFTCPGGHVFFAASVIWGLIGPARMFSPGAVYYGLFTFFIVGAIVPVIIYFAIKRWPKSPVRWLMAPLIFGGCGAIPPATPLNYLSWGAVGFVFQFLIKRRYYAWWSRLNYMTSNGLDLGLALGTLFIFFAFTMQGIGAPDWWGNNIVGTTMDVQGTAVQDHVKEGARFGPSSW

SEQ ID NO: 3870 - protein, 889 aa, Unknown
  Kingdom: Fungi, Phylum: Ascomycota
MAHMGFQMPGMPPPQMHQPPQIFGMYGPDGLPQMQHLPPDLAAQMFPDAHLYADDPHDAKKRRIARACDMCRKKKIKCDGKMPSCTHCTTYKTDCVFTQVEKKRTPPKGAKYIEGLENRLGRMEHILRLSGILGEDDEDDLGEIERRLSEKQRDSAGAASNPTSPSQAPSGHATPRTEVTSPEPGAKEKEEKRKSMDPAAAEEEKQDSEEVSALSEMMSSLVTNQFGETRYIGSSSGFSIFSPKGVSWVNERTGDNSFQSMISSVSVEDHKWTNWKPEVFSDLFQRPVFRPLPPKTEALSLLKDYFENFNCMFPLFHQPTFMHLVERHYSSDPYQGSGWWASFNIALAIAHRLRVMSNLVGPDEDEKAWDYLKNAMGVFSELTMRNTDLLSVQALLGMASFMQGTPNPQPAFQLVAVAIRLAHTIGLHKRGTGFNLNPIEVEQRKRVFWIAYMLDKDLCLRAGRPPAQDDDDMNVELPDADPEDQIGNIPLADGKGKMNLFRVMCEFTVIESNVYRRLYSTKATKQSTGELLKTIGELDEQLEEWKDRIPIDFRPEHEIKASHTPLILHVVMLHFTYYNCLTTIHRMSIHRGYWTSRLSDYAIKGLNSGPVNPRIFSSAALCTAAARASISLLKYIPQGDFACVWMILYFPVSALVTLFGNILQNPLDARAKSDTKLMALVVSFLSMLGQEAEQGGVHRMLAICAEFERIAKLVIERAEKEQSSRRKRKTTDPKPAAVTGASASSTTPRQASKSMTPGAGGEARRESSQQLSPPTHGSDRGRSHSPMNPAANEASPSMASVGWPQEYSVPQGGDFDSFNGMDFTHTGLSGAPGAGGMQSAPFQPGNPLLPQDLFSLPMTLDWSWAEMSGGAYPTVENGNFDPNANQGTI

SEQ ID NO: 3871 - protein, 917 aa, Unknown
  Kingdom: Fungi, Phylum: Ascomycota
MNSIRSNNPREAAFSSRPRAASNVSGRDSLHSPTTEQTPTFSGLPAESIKKLDQIVQNFFVKIAVIVLDSRIQVKATRGANGLRKVNKWFQLETDELDDFKEELRTWKVSGSLANRPPPLIIELYLDTSSLKENQSLVIVDDDGKRWDVMERLNSSGSSAEDDSRGISSKKNCEVIIERWRVDLTPLANIPTEDFGPLLPTIYKKAIVFFRSLFAAARLLPAWKFASSGPSRNAHPALIPRCRIRTSDEAISLPDALRHPIDGRSDPVTEYMFGDLDVPVGRLSTSVTYRNDCNFRVDDSESLLSSRFMGVDENFFKPSLPQRVESTRPEIGSLRDRRARPDLTDLRQTYGSLSTFHGEGHIGTSPLSALRSVKPPGSDTESPPPSLPTHAAPEPHSLPVSSRTISTRPTPRPGDSSSRRPSVSFQPFKAGSLSQSPGPRMVEQESPSSPQSLTRPGLSALQQPRNRSSLTAGMPASLRGGPPPSTSAGDNAIVGSPRPVSISGSRYSSSFTHRRGRLSFGGASRAGDDEQGSSGRQSLASSVAQPGSGLLAETGGTSSGSLQAEDDNISEFLKALDSKKTLKSFDQPKRGESATNRTVAQLSKFHNMRESNNALTESMTSSVQLQRSSSSSSRQLTSVPGMVAPASLSASSSPGKPLSPHTPHTPAVPSRLSENSIARYGHGHQRTSAREGRTSGQVPSTSRQSTITQEGTATAIDIPLSPRLGSYQRRSSSVAQQSRNTADDEENELVFARRSTSLDTDTREPPTMSVLHDMHLQLEEESTVREDQTSSLQPAAEIQSAEASRHLRHKSSEEAPPEGFMTASPSSSPFGRRRYTGLAGRQRPTPSHSARGSFTGSITRASRDEDSVSEEPLVFDLSEMDAQGRRSIEDSRGSGSGPSGSARGSSYEQRGVTRRGW

SEQ ID NO: 3872 - protein, 776 aa, Unknown
  Kingdom: Fungi, Phylum: Ascomycota
MGAGKKNLKATKKFEKNHLKGVLDKRKAQAKVKQRYQINDKKKARKATDAEFIKGVDENGAVKKPTGAPTGKGKKVADMSVDDFFQGGFDDIIEKQPGKLGKRKRTAPKDEADENEANGSEVSGDEQPVLSDSDEDDEEEDGAMSKKTMDDLAQKDPEFYKFLKENDPDALDFDDDADLAEVDDLSADEDQEGEDDEQPKKKRKKSKAKEEEEEVSKTNILTREIIAGWRKSIAESHSLRAARQVVLAFRCAARLNEDEQEEEIPRWVINSPEVFNDILLLALNEIPKVMNHHLPVKESGAGRVYVATESKKFKTLSLLLRSHTTSIMQLLGTLSDEKTLKLTLSSLTPLLPYLLSFKKLIRALAKTVIGFWAQPASTETTRLTAFLVLRRLVHIADRSIREMTLKATYQGLIQGCRITNHNTIQGINLMKNSAAELWGVDPSVGYTTAFTFIRQLAIHLRNSIVHNKNDAFRMVYNWQYTHSLDFWSCVLAEHCSPTKEAEAGKENQLKLLIYPLVQVTLGALRLIPTAIYFPLRFHLIRSLLRVSRATGTYIPLASPLLEVLNSAEMRKPPKPSTLKAFDFAVSYKAPKSYLRTRVYQDGVGDQVIDLFGEYFLLWSTSIAFPELALPVTIQLKRWLKHSRSRSSGNKNNKFSSQLAILVQKFEANAKFIEEKRARVDFAPRDRTQVAAFLRDFEVAKTPLGAFVVAQRKLRAEKAKMMEEARKDEEVRRKEDEAADVEGMEEDDEEDEEEEEDEELDMGDEMVDEEDDDEDEE

SEQ ID NO: 3873 - protein, 283 aa, Unknown
  Kingdom: Fungi, Phylum: Ascomycota
MANDHILTLSCPDKPGIVHAVTSVFAERQHNVLDLQQFSDPASKRFFMRVHFGPIDEQDTTHLTKPFDELAAKYEMDYEIRPVMQKTRVMIMVSKIGHCLNDLLFRMKTGQLRIEVPIIVSNHPEYAALAQSYGIEFRHLPVTKDTKAQQESQILDLIAEHKIELVVLARYMQVLSPKLCTAMSGKIINIHHSFLPSFKGAKPYHQAYERGVKIIGATAHFVTADLDEGPIIEQGVARVDHAVEPKDLTEAGSNVECQVLATAVKMYAEKKVFLNGVKTVVFH

SEQ ID NO: 3874 - protein, 352 aa, Unknown
  Kingdom: Fungi, Phylum: Ascomycota
MAALPLVDIPPEQNGHSYVVDQLEGERITIPGSKGVFRILASSKQTDGGIAVFSSGAGLADAPGFHWHAEAHDVFLVTKGFLRLWNGDKCKVLGAGDFAYVPPNVIHNPETLGPHTESLGLVAPGDWVDFFRYVSETYSGVILPEHDDRDLKSLLIPKVMAAKDRFDVNFVRDYDPPAESEWDGTENTLPEPLEPYFLRANTGPRWMLGGVMSRPFIHADQCSGKFAISSIESSKVYATSPFATKKLRFNRVAHCFCVQEGVLKVRLGDDDGDAWTEAREGQTVLIAAGQAFSIDFGSRYVRAISFTNGPGIEEVVRSAGKPYVGFVLPEEIDSWDEAAFVEACTKSGATVS

SEQ ID NO: 3875 - protein, 445 aa, Unknown
  Kingdom: Fungi, Phylum: Ascomycota
MAGQRKQKPAPSPRPANTLVVDNGGNTIKAGLVRGFDIPEPSVIPNCIARDRARKTYVGSELDKCRDLGEVQFRRPVEKGSVVSWDAQRAIWDAELIGPASRLKCDPSETRLVLGEAPNSLPALQLNCDQMVFEEYGFASYFRAPAFNAYHDVQSLFRTPQDGAVVANSPAEIMLVVDSGFSHTTITPVLRGQPLQSAIRRVDIGGKMLTSYLTRLLSLRHFDMRNDSHTVNHMKEVSGFVSLDFNGDLERSWKGTRGRINPEWKTGAGIAKDYILPDFHTRTKGVIQEYDPARHVKAKQIAAGGQAEEDAVTLRNERFTVPELIFSPSDIGMQQPGLADAIRESLDGLPIGLWPGLLANIVVVGGNALFDGFIQRLQKEVVQRFPDDCVIRVARPENPITSSVVGGMHLANHVNIERVVVTKQEYEERGATWVANKFATGLQTT

SEQ ID NO: 3876 - protein, 449 aa, Unknown
  Kingdom: Fungi, Phylum: Ascomycota
MVMATAAVECYTHHVNNNVLIKKSHLVEPLQNHHHGPIDPKILIGEALQRRAEAVDHELCEPGDEDTFFVADLGEVYRQHLRWKKNLPRVKPFYAVKCNPDPRVLRLLAELGTGFDCASKGEIEQVLGQGTSPDRIIYAQPCKTNSYVRYVKAAGVKQMTFDNADELYKIAKLFPGAELFLRIMTDDTSSLCRLSMKFGAAMDTTESLLSTARELGLNVVGVSFHVGSGASDPMAFYQAVRDAHTVFQQARGYGFTMRTLDVGGGFSGDSFETMAAVLDGALDEFFPAGSGVDVIAEPGRFYVSSAFTIACNVIARRTVEDPTLDGKGYMIYVNDGVYGNFSSIMFDHQNPEAKILRAGGQNMYDTIGSASCPAGEGVEYSIWGPTCDGIDRISESTRFDRVLDVGDWLYFEEMGAYTKCSATQFNGFSNSHEVIYVCSEPGAKALLSL

SEQ ID NO: 3877 - protein, 484 aa, Unknown
  Kingdom: Fungi, Phylum: Ascomycota
MQSQPSDDLLSYFQIAGIHGKPFMDWDDSGPQQSDNWAGFCPHNEKLFLSWHRPFVLLFEQTLVSHAKQIAKEYPGRYRYTYLRAAETLRAPYWDWGFDSNVPNATAAETVVINLPDRERLVPTAVQNPLLTYHFPKAALDNKWGTFDFENRSQTYRCDEWPKSYPASADAAMADRPYKSWLYDVFTLSKDFSEFASTADGGLSLEQVHNGVHWDGGCGGQFLAAEFSAFDPLFWLHHCNVDRLWAYWQAMKPRHKIFRMPYKGGSRFATPSGRMITSDSPLKPFRDADGKFHTTKSVANIKDLGYSYYGLEYWAKTEKQMSKEAIRLINRLYGDSPSEGAKVLSQGNGRRRYLANIRLDVTEVKRPASVNVYVSGHKAGGIIVMAQPRKGTLHGAIPLDDALRAAGLQRSNVDDVVNSIQSSLTVAITKLNGDEVPISLTSSLRIDIEDVEVIAGRTKDELPILGKTQRRPALVTEHVNGQIS

SEQ ID NO: 3878 - protein, 217 aa, Unknown
  Kingdom: Fungi, Phylum: Ascomycota
MFSFLRASHPPRTNNTANNPIAYDDGRSSVTFAKPGSSYIMTHRIPPTTIAHGTSIVAPPFHYHIYQDEYFNVQSGKGNFYRGIDPKPFAVLSDEEGGQRTASVKAGRYHRFENATEDKDLVVDIHLTPESYEAEQRFFRNFFGYLDDCRKVGKAPSFFQLMVFLHDGDTPLAVPAPSELLGKVLSRLLLWGAAFWGRWMLGYKVTYPEYYEEGKSK

SEQ ID NO: 3879 - protein, 784 aa, Unknown
  Kingdom: Fungi, Phylum: Ascomycota
MGFSTVLTAGMLALRLLASPVSAMPAESSAPVAGSDQVNAAASDWWFANIERNGAVPFGSGGDGYKVFRNVADYGAKGDGSTDDTEAINAAITDGGNRCGFGCDSSTNTPALVYFPPGTYVVSSPIIPYYYTHMVGDLNDLPILKAAPSFAGMAVIDANPYDNEGNNWFTNQNNFFRQIRNFRIDLRDVPMTTGTGIHWQVAQATSLQNIIFDMVEDSSEANAQQGIFMENGSGGYMIDLVFNGGNYGAFFGSQQFTAKNLVFNNCKTGIYQIWNWVWAYHGLTFNGCGVGIDLTSGENQQTVGSITLQDSTFTNTAVGIASHYNPEQGPWTNGTVVLDNVDMSGAGVAIQNPGSGSTILEGGSLVASFVQGRDYTGNQGQAVQGTRDTINKPAILLDSEGRMVSKEKPQYPDVPASKFVSVKAAGAKGDGTTDDTAAIQAVFDNIAADEIVYFDHGAYILTDTVNIPSTVRIVGEIWPLIMAGGNSNFQDQNNPKPMLRVGEPGSTGNVEIQDLMIETKGPQPGAILMEWNVAGETKGSAGLFDVHFRVGGSAGTDLQSDKCSKTPEQTTPADPQCIGAFMLMHVTADASIIMENNWLWVSDHELDRSDFNQINIYNGRGILIESTKGAWLWGTASEHNTLYNYQIDKAEYVFLSCIQTETAYYQGNPDALVPFAPQEAWNDPTFADCDSENCARTWGMRVLDSNNVFLYGGGLYSFFNNYDQDCLDTEDCQQNMVEVNNSQATLLALATKASVSMLNVDGQVVAVHADNDNNFCATLAIFQS

SEQ ID NO: 3880 - protein, 416 aa, Unknown
  Kingdom: Fungi, Phylum: Ascomycota
MMTHSNHAIDRLTSLPTEILLDIFQGLDLQSISELSLTCKQLHDVFTRRKSTIILPVLMHDILNGQGLYVPRRIIYKRTTDIGDSGIVLATGGGSKINVKFTRVSKGGKPGQHLPPNTATTVLTEKNLDGILKHCRMVRSWEGLFPQMRWFHEPENCRMLRAHESERFRKALYRWWLYSIHFHGDSPRPRVGLPADYVEDVRTSQLRYHSTSELLELMDLMAAVKDVVFHYICPRLDPTHGDSLDESPLMVEMDRAEQLTHAWMDQSQWGRIVKTYSKLGPEQLVHYFDNICSYPRKRLIADVHVHLPNFTSDQESIVGAIWVVLNERMLLSDMPSLAEHSCGGVVDFGDERDLERLAFGADGSPDGGLPAGVRYRRETSQWSPRGDDGRYLEDHCQPQYGSGRMVPFSYWETVRQ

SEQ ID NO: 3881 - protein, 502 aa, Unknown
  Kingdom: Fungi, Phylum: Ascomycota
MSRISSSDDDLTDDINAVLLTDTERQDNPDDPESSQPNTSVSSCITYRLYISHFLSTWNSRVFEFGAVLYLATIFPGTLLPMSVYALVRGLSAIVFAPSVGQYIDSENRLKVARVSIVFQRAAVAVSCTAFYVLSLAWKPGVLAILSLLACIEKLCSIMNLVSIEKDWVVVVAGDDQDSLKTLNAQMRRIDLICKLFGPLFIALLDGFSTRLAILVNLGMNLASVVIEYFAIAHVYHAVPDLQRPKGHTSQNRSTDGSTGWLQTILSRANYLIRSTLADHLFFVRHPAFRASMAGAVLYLTVLSFSGQMVTYLLSTGYTSTQVGATRTVSTAFEVLATWAAPWLMGRIGPIRAGLWTNCWQLGMLGLGMAVFWRYEESQAVIAATGLVIGTIFSRLGLFGFDLCVQVIVQEAVEPENRGSFSSVEAAWQNAFEILSFVSTIIFRRPSDFKWPTLISMLAVACASVLYSSFVRARRGHLVHLEAFSKLCNVESWKIRGRREQL

SEQ ID NO: 3882 - protein, 87 aa, Unknown
  Kingdom: Fungi, Phylum: Ascomycota
MSFFRITLLRSSIGLPERTQGVLAALGLRRRMQTVFHPVEPQFAGMILKVKELVRVEEVPTALSKQEVKAARTPEPGFYLEKAMPRA

SEQ ID NO: 3883 - protein, 545 aa, Unknown
  Kingdom: Fungi, Phylum: Ascomycota
MAEYKLKDVTSLQLGPAVKREVEVEGIEDGKVLLLNAGGKVQAVGAKCTHYGAPLVKGVLTTNGRLTCPWHGACFNAKTGDVEDAPALDSLPIFKTVERDGAVYITGEESDIKSSKRKPKFKCNAAGGAQQDKVVVVGGGSGTMGVVEGLRENGYDGPLTVISKEGYLPIDRPKLSKGLMTDPDKLAWRDKAWFESGSVEWVDGEVNAVDFADKSVTTTNGDKYVYTKLVLATGGSPRNLPLQGFKVLDNIFTLRTVHDTKKIVGAIGDKGKKIVVVGSSFIGMEVAAATAADNTVTVIGMEKVPLERVLGEQVGGGIQKILEGKGVNFYMNAGVDKAEPSTSDPSKVGAVYLKDGTKLEADLVILGVGVSPATDFLRDNKIIRLEEDGSLKTDENFLVTGVRDVYAIGDIATFPYHGPGGEGKTTRIEHWNVAQNAGRTVARHITSPTAAPAKQFIPVFWSALGSQMRYTGNTVGGWDDVVVQGDPADAKFAAYYTKGETVVAMASMGWDPAMAQSMQLMRLDKMPGKSQLQGGLDVATMGPPE

SEQ ID NO: 3884 - protein, 437 aa, Unknown
  Kingdom: Fungi, Phylum: Ascomycota
MSANLVDWAVEHGATLHPSIEVYEDVTTGLSFRVRPSAVDGLESTRYSSHAGNSAPIVSIPATLSLSYLNALESLPTEFTRVVKPHVVGRFFLIQQFLLGKESFWYPYIQALPQPSDQESWELPPFWPEDDAELLDGTNVEVGIKKIRHDLQAEYKEARQALSRIDHSLADVRLNLYQWAYCIFSSRSFRPSLVLSDTSLPEGVAIDDFSVLLPLFDIGNHDMTSPARWVLEGQTCSLYVDKDHRPGEQVFNNYSMKSNAELLLGYGFMIPATEDLHNDYTHVRKRTDTTEASEEYFISMRPMNHLSSILGKSKQTLNAPNVISSFSHVQYDMVWDIFRTVAASAPPGSVPEGSITPQQVLSGQVSDDLRIYLQQTVAIIQHKLLQELERLDETDVEVDDDQKADLTKNQRLALDYRAQCRQVLESTLESIASDESI

SEQ ID NO: 3885 - protein, 1262 aa, Unknown
  Kingdom: Fungi, Phylum: Ascomycota
MADIHVAIDRGGTFCDVYARIDGQEALTFKLLSEDPANYPDAPTESIRRILEHVSGLKIPVGEKLDASRIGEKFAFLTTKGFKDICSIGDQSRPKIFDLNIRKAEALHTAVIEVDERIVPADYDLNPTPLDKAAALAGDDAGIVQSKSGELMRVLRRPDEAVVTAQLQELKDRGFNSIAICFMHSYLLPDHERIVADIAGNLGFEYVTISSETSPSIKLLNRSTSTCSEAYLYPVIQRYIQSFQSGFENLPQRIDFMCSDGGLKKADKFRGNEALLSGPAGGVVGIAKSCFNSEEGTPLIGFDMGGTSTDVSRYDGQFDYLSESSISGRTITIPMLNIATVAAGGGSILFARNGLLSVGPESAGAHPGPACYRKGGPLTVTDVNLFLGRLVLSSFPSIFGPNADQPLDINVVREKFQTFTADFNAQSNQQLSAEEVALGLLSVANETMSRPIRNATEARGFAPENHHLVSFGGAGGQHACDIADRLGIRKVLVHRYSSLLSAYGIAYAELQCEKLEPFASALKADVLSQIQERLVALEAQVKEDLASQGADAATITCQKSLVLRYFGTDTNLVIPTPDDGDYAAAFTAMHKREFAFVMQRDLVIESIKVRGTGRTTTALGQHSTASQLTLPEQLLSAPGPTEQQLVYVQGAWTSVGIYKLNSIPRGALIDGPALLIDETQTLFVEPSFRAIVLEAHVILERQIQRPEQLVKPDLLPTDEKIDPIILSVLAHRFMAIAEQMGNTLQRTSISTSIKERLDFSCAVFSATGLLVANAPHIPIHLGSMQFAIQAQHRLWLGKLKPGDVLLTNHPQWGGTHLPDLTVVTPVFVEGEIAFYVASRGHHTDIGGKGITSMMPESKELWEEGLNVPSMKIVSEGAFLEEEVRAAFHKAGSFPGCSVSRRLADNISDLKAQTSANQRGIILLQKLCKESSLAVVHRYMGAIQANAEAATREAIRKMASEDPVREATDYLDDGTALRLKVILDPEDGAAVFDFTGTGPQQWGNYNCPISICHSAIIYTLRCLIKMDIPLNEGCLAPVKIIAPAGSLLNSGPRAAICGSTLASQRVIDVILRALGRHGASQGCANAFGWGMGGRDPATGEVVKGWNYGESIGGGVGAGEGYDGAHSTHVHSTNTRQTDAEVIEKRTAVLVRCYEVRRGSGGTGKWKGGDGITREIEARVPLKFSVLSDRRVYRPWGMAGGSPGAKGVNFAFLHAADGSGGMEKVSLGGKAIIHLQPGEYLQVNTPGGGGYGGDEITDRHIGYT

SEQ ID NO: 3886 - protein, 509 aa, Unknown
  Kingdom: Fungi, Phylum: Ascomycota
MMTNKILLSNSIATRPQPMGYCEPVEDIRCKEYPNMDEGVYLDHSGTTVYAQSLVMDFSQAMITNLWGNPHSENLPAKLSGNMVDDIRERALRFFGADPKHFDLVFVANATAGVKLVAEAFRDLSEKTPKGRFWYGYHSEVHNSVLGIRQLCDGQYHCFVNDEEVDDWLASPKTEPLHNSTISELGLFAYPGQSNLSGRRLPKTWPGRIREQPAFRNTYTLFDAAALAMTSPLDSLFADPATAPDFTCLSLYKVFGFPDLGALIVRRASGHILSLRKYFGGGTIAQVFPLNGDSRSVKKGPGIGSEGWSIHDGVEDGTLPFHSILALGLAMDTHTRLYGSMAAISSHCTKLATILWKGLQKLRYPDGSPVVEIYADSDSGFGDSSIQGAVFAFNVLRKDGSYVSWMDVEKTANEAGVFIRAGGVCCPGGVMKALQYEEWEWSRMFSSGHACGFGETAIVNRRPTGIVRASIGAMTTNRDIEALLLFLFEAYLQPESRRIISLAAESTGI

SEQ ID NO: 3887 - protein, 111 aa, Unknown
  Kingdom: Fungi, Phylum: Ascomycota
MPSVKNPNHPSKNRLAARASKAKAQRQQREAHARNKISKPDVARGARPGLLPNSGPNAKLSGKKQRKLDKKMGYALKRKMEREGEVVMQDAVEDAPKDKKAEEEVDMDGVQ

SEQ ID NO: 3888 - protein, 642 aa, Unknown
  Kingdom: Fungi, Phylum: Ascomycota
MVSFTAMNAVHPASADAPPALAPASAPTPASPRAIAPAPANHHHSPSLSPTSAVDIPHGARADHTPQQHHLQSIESHYVHHPPPQSPTPMASSLAHTLHHSPQQQHRQTHHQLLQSAAAAAAASSASHPSSPPLRQDTSSSTSTQATAVTQASVETSNTSYSADTSPDLHQSIYPVQDGCDVSYSNIRGTSRRRTGPLSQASRERAALIRKLGACHECRKRRVACHPGHHNMTWEELHGKFRKSMSPPATQEVARPFAPPQVLGQTNGSQPFFTHDPQDMDIDSAPSDDQQHHPQHLVGLPSLSDARNRTPLPGGRLEKSLSLPGIESLKNDLQTNVSRMLSTGARTRYQTVEAVLIFWEHDDDFSVVNGAVRELADVFDQFYHYTFRTLLIPSPSESCKSSGRWLSRQLNDFVEDRDQRDVLKIVFYAGHSYLDGNRDMTLASSRDTEKASTVRWSAIQQILEEACSDVLILMDAAYYPSSKMVRSRGVLELIAASVSEEHHHVLDRCSFTRALADLLRTRATRLSPLSAAELHAAMLASYPKLVQDRHPEKETITSLPAPLHIMMSGNPRLPSIFLSPVYQGSPLRNSSLGGYDNNPQLHLSIRLNDDNVDLETWNEWLRLMPEGIKDVRVDGPYRPTYR

SEQ ID NO: 3889 - protein, 504 aa, Unknown
  Kingdom: Fungi, Phylum: Ascomycota
MPSLTVLACAAGPLAKVPGPKLFALTKWRLALEDWKGRRTQTIHDLHLQYGPAVRVGPHEVSFNNQGALRTIYGPGSRYGRTNFYRMFDVYGRQNLFTFHSSVEHGRRKKLLSFAYSKTNILNDTVANMVEAKADTFMKLIDSEPEHISDIFSTLHYYSLDNITSFLYGKYGSTSAMEGTQAHRALIGDILDPARRTLSWFAIHQPSLTRWLYTRTDLAERLVRPVLPMQKPATYTGIRAFALDAYNRFRSDMENGKFDGDESSILARLWKYSQDPKGEPMDHLDIASECADHFLAGIDTTSDTLMFLVWALSQPGSMEYQEKLRQEVLAIPDALLDQNGIPRAAETDRCTYLQAVIKETLRLYAPLPSYEPRSLDTDSEIEGYPIPANTVVGMSPFSLHRNPDIFPNPLEFNPERWMGPDAKELNRWFWAFSSGGRMCIGMHLAMAEMTTLTATIYRKYQTVIAPGFEGATPGITARFELFYDPRFPKVMEHYCPIKFNGSMS

SEQ ID NO: 3890 - protein, 373 aa, Unknown
  Kingdom: Fungi, Phylum: Ascomycota
MQRIAKRAAQAQRQAVRRAARIADENRRTEQQRARRYLKEAVSEVRSNIKEARVARREDWELGPLAPKRDLGFNGYGEIQTGRRDWSQGGQFKINTELAAKRCAWAGGVKQFCLAPGDRVVIMDGQDKGKIDRIQSIEPQNGFVLLEKLNRAIDAPPFPNMPIMSNPYPLAADAVRLVYPLKNPDTGVTRDVIVNQLKPVAPNMSSRHMTLERWEHGNKWDRVALGVNVVIPWPEVEAPEYKTFKPDTARDLVEDRTFYYNLTTAPIPSGVIDELRGPFSRFRTRHEAWYIEKKEAEAAAKRGAHKMHESMRTPLEEFHEKRKAERLAQGEPELSETMLEKIGQVMARNKQEALERAGMQEAGSTTQPPSSTA

SEQ ID NO: 3891 - protein, 116 aa, Unknown
  Kingdom: Fungi, Phylum: Ascomycota
MAPQRVTYRRRNPYNTRSNRTRVVKTPGGELRLLHIKKRGTVPKCGDCGSKLSGIPALRPREYSQISKPKKTVQRAYGGSRCGNCVRDRIVRAFLIEEQKIVKKVLKEQESGQKKK

SEQ ID NO: 3892 - protein, 1197 aa, Unknown
  Kingdom: Fungi, Phylum: Ascomycota
MNVDEQTAPAGQHYSGRNRVPNIQEFMQQLDKEKKQRDAEIDEQLKQNKKHGEVKEHKIDHQRGKEKHRTVRDPVTGKDVEIRDTKLSYEDAVENPQFSVPNENLGKETTARVDSNMSGEEYRRNQDILAPPDPVQEGATSDVPIRSEKTSILFYKTPSVSYEPMYAHLEQRANILCAGIFFGIIFIGKFFGGRLLGLIPLSICVASGVFLWAKDLIRQGRDMEWSSEQGRGETATANLIPESVEWLNTALGIVWQLINPEMFAGVADTLEDVMAASVPGVIENVRVADISQGNNPIRILNMRALPDSHVQDIKDEIHKENEKNTDPNELAAIEQAGQFYNLEVSIAYHAKPSGGDVASKARNMGMQLVFYLGIKGLFGVPLPIWVELIGLVATARVRVQLTPDPPFLKTVTFTLMGLPKVQAGCTPMIEKGVNILNLPLISNFVNWAIGAAASMYVAPKSMTLDLSKMLQGDDIKKETLALGVMFIRIHKATGLSKQDHRGSKGGGSDPYITISWSKFGKPQFCTRVIQDDLNPLFEECAGLLVTSDLIKADEQLSMELWDSDRSSADDVVGKVELSIQKLIQHPGKMFPQVSKLQGVKAESTMPGELHWEVGFFGKTQFRKALRTDGKDINLPKELADKPEFQDDKGAVESKEEDAVTHTPPDPLWPSGILSVVVHQIVGLELANIKGTSGSRKGKEFEPGRPEAGEVKEEQSKNLPSSYCTILLNDDLIYKTRTKVVSSQPIFNAGTEKFIRDWRSAVVTVAVRDSRNRQHDPIIGVVPLKISDILQTASEATRWYPLDGGVGFGRIRISLLFRSVELKLPPPQLGWDIGTFEFLDNQIVTSGYAPSSHVKLRLRTGGSSATIKKQASTKQDDGMAFDLSGQEGNDRIRLPVRHRYSSPIFFEFTSSGKRHPDAFASTWLHELVDGEEREFDLPVWKCDNSTRLSQNYITEKNFQDVPDLDMEVLGRVKFRGRFSPGTDSDHIKFVSDNDSRETIEAWEACYAEGVREQEVMVEVPPLVQKLHDESLTHGRDVLAQASEKDKQKWLAKDGTDWSGAFGEDPTTLMSGRAADNNSENYDDFDSDDSDPDLGIHDATTRDSQTEDSQSSGHRGSEDTQASSTGTMESTESGSKNPLKAYKGYKERSRDLHRKHRGLMQWRPMRNAQFAKDEAKFSMRKITKLGSLDGRKPDVETEV

SEQ ID NO: 3893 - protein, 419 aa, Unknown
  Kingdom: Fungi, Phylum: Ascomycota
MAAPASVRVSGPPNGSFLVGYPGISATLPRIEGKVEIRPGAGYSMPVPVSLVRICLQRRETIHPDADNLAKRHLGTPRRDTTDVVGKEVLLFRCSTGKDAESIVAMDLPFVLFIPFGRGGEETNRRIPPASLQLPSRTAETYYELVVTVQQGHSNQFRYSFPMPLQRYDTLSTFGMYNKPETKLVTADNVISLGINLPRWSYGPNDPITVYIKLAPNPDWVSKAKRVTIDKITLQIEEEITYNPEGDEPSKKINKLSKQVQTVKTKMPEAGYATNIGLVFPSKDLRDPDGIVKRGKPAFPLYEVTSFTTTSTLYKIDFYLNIKVCLPDHPHESIFTIHKVQLSGARDVSLRQPIVICPLDQQGCKEEMDAIEQAAKDASHVDPNNPMLPAHSIVLASDRDSLRALGLCMVGGQKKPYIE

SEQ ID NO: 3894 - protein, 1125 aa, Unknown
  Kingdom: Fungi, Phylum: Ascomycota
MTVTYCGCFIRRDHRVVFLPQVSVKTHATLFSSTSRTVLTQTFVNPLQDTTLEEVNYAFPLYDGVSVVGFSCEVAGRTIKGVVKERELAKQEYDTAKQNNKFAGLLQRSERCSDIFMTSLGNVPPGASIDVEITYLGELKHDAEVDGLRYTVPAIIAPRFGPHESFEEANNVVATDMTITVDAEMPSAIKSIQSPSHAVSVNIGTTSVEPDADPSFNRASTSLSLTSTSLKIDFVLQIIADKLGEPGAIMETHSDYPNQRALMTTLVPKFGLPTQKPEIVFLCDRSGSMSGRIKDLISALRIFLKSLPTGVMFNICSFGTSHSFLWDNSVAYTEKSLNEAIHHVEDFSANMGGTEIYRPMEKTFHHRYPDMELEVIMLTDGQISAQDRFFDLIRKEVASSKGNVRVFTLGVGSGASSSLIEGAARAGNGVAQSVSGDEKMDKKVIRTLKAALTPHITNYSLEIKYEKDDDDDFEIIETVMAKVSMDEAAEDSDPTEGSDQLETTKAAPTSLFDPNYKEDLTPPEPPSAKNKYAHLPALSTPSYLQAPCTIPPLFAFNRTTVYVLLSESSAGKKAKSVVLRGTSKQGPLELEIEIKHLEKPGQTIHQLAARKAVQDLESNDGWLSTARQISDNRLLKSAKPSKFSAMVEREAVRLGMKYQISGKWCSFVAIDDTSQDTEMGNIETIDVQEALQGWPPRFARTVLSRSAQPLSATGLKGRKLGMTSTGEFFSRDEDIHDHASAVRRCSTRGPATAPPPPAPTTGLFGKAPQPTGIQRQSFGTTMAFARMTQPQSIRSQGVIKSQSVTAESSRPIREATPLIIESGEDEATSPVRQNLAIKPNAQRRNLMPSASRPSAPEQEEEEVVLMSVPSQQRIAARSSGTMTALVDGPELPQLSSSPEAPSGSAHEIPSWGCSMKPAMHSTQGSIMLDADYMSSPAIDYEGGTPMTATGQVTPNGSPGYSVTTPDSPELDHELLAQYKAEMVCASYQPLLEEDSDDELALTPPRKAKKQKLISRPTDATVRLEDTLQALIALQSFAGNWSWSPDLEKWTGSRAQDYMSLEWPGCADNDVKGRVSATLCAIRFLMKNLAAEEEVWEMIVEKAGDYLLATTGQSVEDLEKVASQVH

SEQ ID NO: 3895 - protein, 577 aa, Unknown
  Kingdom: Fungi, Phylum: Ascomycota
  misc_feature (257)..(257): Xaa can be any naturally occurring amino acid
MPAGEGAAIASNGSAGSQANGAESANQRTAKAGVTNGTHKDGTSTNGSANGDKQTTRAAQPETSYRGHNREEVTRILIQALSDMGYQSAAESVSRDSGFNLESPAVAAFRSAVLDGSWGDAEQLLQGAAASDADSVSGNGLVLASGSDRTAMRLWLRQQKFLELLESRDTSRALAVLRTEITPICNDQTRISLLSGLVMCGSAADLMTKADWDGAAGASRQVLLSELSKCISPSVMLPESRLATLLQQVKQNQIDTXVALELPELAGEVWQVQFSPDGRRLAACGSPDQVIIWSTETFSVVQTLDNHYGGVGNISWSPDGTMLVTCSQDKHARLWKADNGSLIKKLKRFDEPVSGCVWASDSQTFVIGTLDRAHSLCTFSVNDDGAQDWGKKHRVQDLCGSPDGRYLVAMDDQLTLHVYNALTRELEYDLVLKARPTSVSICQDSEHLLVNKRDGEAQLIDLATQEPLKKFVGHTGGDWVIRSAFGGANESFVISGSEDGNILIWHKNIGACVERLQGHSPRTNAVAWSPSDAGMLASCGDDKLVKIWTNKAKAWEIRARRPRSANNWTIPEEASAT

SEQ ID NO: 3896 - protein, 346 aa, Unknown
  Kingdom: Fungi, Phylum: Ascomycota
MKQLPIELLIQIIEHVPPNREAILPAGDIATKTLVALTRVARITYQPANTVLRKQCMYIDSTSRLARVRSCLNLFVPSLDPGLSLRHITSLYLAPFRQSLREPLVAKYVDTLLCEVGETLQRLVISMPFSTLQAYDDDEGVRRLLRHGLEQLHNLEEFACIGDYPALSISAPATGEEGETGPATTTTDVWRLWPKLRKLMLFGVPLENHWLWWDIATLDSLTHVILVRPRQTERKVDIKQRYFQTLPPEDERFKRKLKVVLMHRVRDDDDSDDASHSTEDQRRWLPEGHPDYLRLDESRWRDIDPQERMEVTCYGVPRMGVMSSEELLVGLAKSWVETGTLWDARA

SEQ ID NO: 3897 - protein, 454 aa, Unknown
  Kingdom: Fungi, Phylum: Ascomycota
MKSAILSVGFVASAAAKCLSGKATVNLDKTTGPAEQLAAGFLYGIPNNGTSASNAIPDHFFTDIKFRGTRAGGSQLSDGGWSSGGKPAYDMRFNSTLSTYRSARKYDAHFILIANDLWGADGGQDGALYPGDNGNWTETEAFLDQLILDMRTNDLIEDVTIDIWNEPDYPLFWERSWEQYLDYWNHAYNYLRENIPEVKIGGPAAAYAPNQSREKWHSFCANIAANQTIPDQYSWHHIGDDSNWPDRAADQWRQFRAMYDLPERLISVDEYAWPWRQDPANTAWYISQMERNDIVAMRANWNSAEDLHDRMADLLGKTEDGEYYPNGEWWMYKYYAEMEGERAATKVAENLNFDVFATVGEDVVKILAGTRTYENDTTVGDYLLEVNGLDSALGLDPFATVSVQTYRFDFEGAFGEMGPPADLGTEDYDLSDGSLRITYRPASNETAYAFEFNY

SEQ ID NO: 3898 - protein, 338 aa, Unknown
  Kingdom: Fungi, Phylum: Ascomycota
MKLQYLQPLIGFAVQALASDDFVIRRRGAEFNISPRHDHVDAVCGNGKGSCPLGQCCSESGKCGTAKDYCTGPQCQIQYSNGRCDANEKPSGSSTLNVPRNNAGSVAYDKYIIACTEPGTVALTFDDGPYKYTDHVLDLLDEHDIKATFFIAGNNLGKKPIDDENTPWPGILRRMHKAGHQLASHTWTHQDLSAASQELREQQIIYNEMAFRNIFGWFPKYMRPPYGTCSRDSGCLDYVTKLGYHVINFNIDTKDFQNNTPEKIQTSKNTFNNGLADTSKGYIELSHDIQQQTAYNLTEYMIKTLQDKGYRAVTVAECLGDSKENWYVDASSTIGNGT

SEQ ID NO: 3899 - protein, 304 aa, Unknown
  Kingdom: Fungi, Phylum: Ascomycota
MASDDEPRPAKRHRQDEEGGRDDIDDRSDHRSKHRSHRGDDRRRSRERHDRRRSRTPDAGRDRRRRSRDRDRRSRDDDRDGHRRRRRSRDEKDDSSRRRRHRDNVSDEEPRTTHRSPLRRGAPLPSQEASFAVTNGEEPEKPKEKPNLGNTGLLAAASNSVAQADGSSITLKYHEPAEARKPPARDQWRLFIFKGEDILDTVELSLRSCWLFGREVAVVDLPAEHPSISKQHAVVQFRYTEKRNEFGDKIGKVKPYLIDLESANGTTLNGKKIGGSRYLELRDKDMIKFGDSAREYVLMLAPRE

SEQ ID NO: 3900 - protein, 929 aa, Unknown
  Kingdom: Fungi, Phylum: Ascomycota
MTGRRDFLSQPAPENYVAGLGRGATGFTTRSDLGPAKEGPSEDQMKEMLAKRAAQLGLDGKDKDKGKEDEGPDDDRYQDPDNEVGLFAGGVYDKEDEEADQIWEWVDERMDRRKRQREAREQAEREEYERNNPKIQQQFTDLKRALATVSDDDWANLPEVGDLTGKNRRSKQALRQRFYAVPDSVLAAARDAGEMSTTVTDDGGASTGAGENADGTVTNFAKIGAARDKVLKSRLEAASQNAGGESTIGGSSTSIDPQGYITNLNKMQMSEGQAQVGDINRVRELLQSVVKTNPNNALGWIAAARLEELAGKIVSARKTIDQGCMRCPKSEDAWLENIRLNHESSNAKIIARRAIEANGKSVRLWVEAMRLETIPSNKKRIIRQALDHIPESEALWKEAVNLEEDMADAKLMLAKATELIPLSVDLWLALARLETPENAQKVLNKARKACPTSHEIWIYAARLQEQLGQAQKVNVMKRAVQVLVKESAMPKREEWIAEAEKCEQQEAPLTCENIIRETLGWGLDEDDDRKDTWQEDARGSINRGCYATARAIYAYALRVFVNSKTLWTAAADLERNHGTRESVWQVLEKAVEACPRSEELWMTLAKEKWQANKIDEARVVLARAFKHNPNNEDIWLSAVKLEAENDNAEQARQLLEAAREKAPTDRVWMKSIVFERVLGNIEQALDLCLQALQLFPASPKLWMLKGQIYEDMGKTPQARDAYATGVKAVPKSVPLWLLYARLEEQSGLVVKARSVLDRARLAVPKSAELWCESVRLERRAGNLSQAKSLMAKAQQEVPKSGLLWSEQIWHLEPRTQRKPRSLEAIKKVDSDAELFVAVARIFWGDRKLDKAQSWFEKALVLDSDRGDSWAWYYKFLEQHGTSEKRGEVISTCVASEPKHGEVWQRVAKKPANARKSTEEVLQLVAAELE

SEQ ID NO: 3901 - protein, 365 aa, Unknown
  Kingdom: Fungi, Phylum: Ascomycota
MGSAGTQTWLEKLEEQLNVDVDWMDPEYIKNMPIRPHDQTSNQLWVDIQLGDASNADLLAQTCKELKDAGWLAIYTRMAVLMCKKNIDMIRGRVLLQTLPSKAYDTQFTLDHARLYDQEFARAGIGRDRYCIKIPSTGPALNAAKQLSSEGIPTLGTALFGLPQAIACSQAGMLYISPYYNETQAHDDLSLWPDVEDPATQHPNSARVFNIIETYKRLYKETGREQPLVKNASFISPKEAMAAGELGCHSATISHTVLNQLAELKYDGTKQPGEGVPKPQHVYKNPIQTPERLKKLAGIDPLASAEWDGKLASTDIDYLANSGEELRKAIEADPIAKNRLAIALELFTGGENRSKEKIEKALQSV

SEQ ID NO: 3902 - protein, 207 aa, Unknown
  Kingdom: Fungi, Phylum: Ascomycota
MGAIEATVAVGAEAAIAETGASALPFAARRYVMQIIVERLTKNINEDHLYEIFGEYGRIKDLDLPVNRAFGTNRGTAYILFEKQVDAEDAIAHMHEAQLDGAIINVSIVLPKRKLSPPPPQARRGANIDPRQPFNAPRGGGSRGGFGGGGGRGRRRPSPGGRQGFRSGGFRAASRSPSRSPGARPVLLLSLSVEISSPWSSWAQTQP

SEQ ID NO: 3903 - protein, 363 aa, Unknown
  Kingdom: Fungi, Phylum: Ascomycota
MSHHHHQLSLAERQRQILEKGLKRRPQREDRYENDSASGEDPLMGGSSAPLAGQQPQPQQQQRLSKQARVGGPGLSSSSVRPPAVPRVVPRARTPVKASPQRSVAVVLASTPKKDREEFVVVKADELRDEPMKAVNGRSTSQPGPAAQPSTEEPERMKRRGRPKGWKPGMAYTDLRPRPNKPNNTSNTTATGQKRRGRPPKPASPPPKQLYHQFEAGFFAFLCEWKGCQAELHNLATLRRHVHTVHGEEGSDQGCKWGPCATSTSTSTSTPARQEMIGRKFRKHIEEQHLIPLSWHVGDGPRHQGDGIQAPTANQVGGEEDREIEDLKTWKERRRRLKELLVRRDENLQSEEEEGGGEGQEGK

SEQ ID NO: 3904 - protein, 458 aa, Unknown
  Kingdom: Fungi, Phylum: Ascomycota
MTTRYRVEYALKTHRRDQFIGTVPIAPPLDLTKLIVTPEWIKGLLAVPFVLYSQPNGVFGDEIIKMEQDAHRRYAEIMRDVEAMIEDHIARQNQDEVFPSKLRMLVPTAGPFFTRLPLEAAFKYQDRKRNISSRRYVAPSFNDVRLVLNSAQVMAVTNGALQLATFDGDVTLYDDGQSLEPSSPVVPRLLDLMKKGIKIGIVTAAGYTTADRYYERLHGLLDAIAASTELDPSQKQNLVIMGGEANYLFQVDLSAPHLLAHVPRERWLTPEMAHWHEEDIAALLDVAEGALRDCVRTMNLPATIVRKDRAVGIISTDPDVRIARESLEETVLVVQRILELSNLGIPAARTTSNGMPTNRPRIPFCAFNGGRDVFVDIGDKSWGVTVCQQWFGGGCGEAGAATKRIGGENTLHVGDQFLSAGSNDFKARSVGTTAWIASPAETVELLDELADLMQKRLS

SEQ ID NO: 3905 - protein, 173 aa, Unknown
  Kingdom: Fungi, Phylum: Ascomycota
MSQTSPEAVESRPADSLRSPQSPLSRNVRQLGLFFSGAAFMAASIFVTRRSVVRRQIDAFPRFYTHNRYPPRFDSSDRSLLAASALGLATLNVMSFGVMLVGGISWGWDLCSVTELKERSREAVTRPGRKELDPEEEKAMKEMMEDLMSKLGMEIPEEGEKPNGEPAKDDTKP

SEQ ID NO: 3906 - protein, 613 aa, Unknown
  Kingdom: Fungi, Phylum: Ascomycota
MDRKDSITKDGMQGDVAHLEGPHSSGVQDHLAHNVNAKIVNPLGHLTREELAEQVHQFCHTHDLADKEEFFQKGALVAQSPQNFENIPELTEDDKYWIRRETTHPWRLPKHLYYTIAVCSLGAAVQGWDNTGANGANLSFPAEFGIISNEWLVGFLNASPTIFGLFSAPLADPLNNWLGRRGVIFLTGLFVVFPVLGQAFTQTWWELLICRMFMGFGMGIKITTIPIMTSETVPAVIRGGLVMSFQLWVAFGILIGFCSNLIFFRIGRLAWRFQLAAAFAPAIPILLFIWSCPESPRWLLKKERYKASYRSFQLLRNSEVIAARDMYYAYRQILEEREAFAGSTFFTRAWELFTVPRLRRATLGGFTVMTAQQFSGINIMAFYSSTIFAQAGYSVKQCLLASLGFGLVNFVFAFPAIWTIDTFGRRGLLTFTFPQMAWTLLAVGLCFLIPESYSGRVPLIAFFVYLFTAFYSPGIGPVPFVYASECFPLSHREIGVALCVTWNNTVGSILGLTFPVMLRSFTPTGAFGFYAGLNIIAFVVILFCLPETKQRTLEELDYIFGVPTRRHISYHLRTYLPWFFKRYILWQKNAKLEPLYKLENFSGGTKAEAFVGH

SEQ ID NO: 3907 - protein, 441 aa, Unknown
  Kingdom: Fungi, Phylum: Ascomycota
MSGLGGIMKGGWHPEKSRSGSSSGGGSSSRGGGSGEGKSLTGLGIRNKTNSMIPGNKDKKEAETRANHVSAPLTSLKDPSTFAPPPKRTGTGLAPAPPPSNVPRKVVAAPSTYQDPRAAVPAPPPPKISSVSQLQQEEQAPPIKRGPYTPNTTGLSTDHLPKPPARRDSPASPSSPAPPSYETATGAARPVPSLPPRLPARTNTGGSVASTTSNQAPSNNGGMLNQNAVNRLGASGISVPALGINRSANANTSSPSPPPPARSNAANAQVNALQNRFAKLGTSTSNANSPTSPQAPAEGTTWQQKQAAMQTASSFQKDPSSVSFSDARSAASTANNFRQRHGEQVASGVKSANSLNQKYGVSDKVGGFAAQHQQQQQGDGQQAQPQSPMGGAVSGLTGLTGKKKPPPPPPKKKPGLAAVSRPGNNGDDAPPPIPTATRPQF

SEQ ID NO: 3908 - protein, 99 aa, Unknown
  Kingdom: Fungi, Phylum: Ascomycota
MATLGGYLNKKVLIVTADSRILVGTLAAADNSTNLVLNDAVERLIRTTDDDEQSSEVRLGLYLVRGDNVCSVGLVDEKLDESIDWTQVKGAAIGGIKHT

SEQ ID NO: 3909 - protein, 510 aa, Unknown
  Kingdom: Fungi, Phylum: Ascomycota
MTRGVGNMSLRLHPLTRSPAPRRHLTTRVRTYDEALQKLSLIASNRRITSLFDAKSQNALPSVNLNAQAIPEMITSLRHAGYTPQDLTSMRHIHVAGTKGKGSVCAFATSLLLQQKPLLSGSGVGTYTSPHLISPRERIAVDGKPVEKDVFTEAIFEIWERFTEVGKTEMGLSAEEAEGAASKPFYFRFMTILAWHIFLKLGIRDVVMECGIGGEYDATNVIPAEAVSAAVITQLGIDHVAMLGDTVEKIAWHKAGILKPNVTGFTRKVSDQPGVMDILRSRAAEKQAQLLEVDDTDVEAWGGVDGTLKGDFQRYNQALAVLAVKKHLGLESEPSTTLQHISPEEVRGLQQARLRGRCEIVSQRNVTWYLDGAHTMESLEQVALWFNASTPPNTKSILVFNQQERDASHLLAHLLTTFNRPDAFSHAIFTRNDQTKGQGDEAQDVSVQQKAAMKMAEMAPNTKTVIFDNIEKSVAEARRLAQAEGGRVLVTGSLHLVGGVLQALEPGAVS

SEQ ID NO: 3910 - protein, 1350 aa, Unknown
  Kingdom: Fungi, Phylum: Ascomycota
MADRPSSQSQADSTKDEAQLTSTSTGDAPQPPPTASYDHAASTPHEMPVVMASSSASATPSPGKDTPVGSDAALATTTVDTNSKGKEPLGRVSIDLTDPDPIPANNFAFTPTQLHKLQSERTLEVLDAFGGIRGLAIGLRTDPVAGLNADEGNLDGGVSFDEAVAAGREDRTPIRRELSALPETHQSHGLRILERDDDKGFIDRIRIFGKNKLPKRQQKSFLKLMWIAFNDKLLILLTISATISLVIGIYQSLDAEEGTSNIEWVDGVTVVVAILVIVFASAATDWQKTHKFEKLNERKEQRDVLVVRSGCDRMISVYDVMVGDVMHLEAGDVVAVDGVLIQGSNLQVDESSLSGESELVHKVPADRLIHHKDLDANPFILSGTTVSRGVGRYLVTAVGASSQYGRMLMSLRTDVEETPLQAKLGRFGKQLITFGGIAGTIFFIILLIRWLVQMDHSASRTPSETAEQFFEILILAVTVVVITVPEGLALNVTIALAFATKRMLKDNNLVRLIRSCEIMGNATTICSDKTGTLTQNKMTVVAGRIGLEGHFDDIDVPEDDRTRPFANPLSTKIHTSGRLIASLSQEVRDLVRDSTALNSTAFESDDNNNEFVGMSTETALLKFAREHLGMGKLREERANTPIVSMLPFDSSRKWMGALIKLPNGKYRLFIKGAAEIVFEYCAYAISDPTYKLQTDHMSESMRDDYRQSIQEYAKKMLRPVVLGFKDFEASEVFSDPDEEPDNVNLEWLASGMILVGVFGIRDPLRPEVVDSVRQCQEAGVMLRMVTGDNYETAKAIAVECGIFTAGGIAMDGKTFRKLSKDQLDAVIPRLQVLARSSPEDKLLLVTHLKGMGETVAVTGDGTNDALALKAADVGFAMGVQGTEVAKEAASIILLDDNFSSIVSALSWGRTVNDAVRKFIQFQFTINIAAGTLTIITELAGSAIFTVVQLLWLNLIQDIFASLGLATDKPSKDFLLRKPDPRNSSIVTITMWKMILLQAVYQLAVVFTLHYGDFQVFNPDRSAAYLRTLTFNTFIFMQTFNQHNCRRVDNNIGIWYQGVLRNPWFIGVQCITIAGQFIIIFKGGEAFDTVPLSGQGWGWTMLFGGLTIPLGALIRQVPDIWVQHFFHMCYGIIMFVTWPLRKLFGPCFRRLQLHRTRRRERKKKDSETASQETQETSDREEHEMSQMETMMMQAGRTLIQPMIIHPAHLQVGDDGEDLDISPAQRRALEKAARDQALREAEEAERIVDLPGLIAAARAGQDIGDHCIEVHPATMKKDPILMGQRTNTRLPPSQDPDILYFLTRLDEDSMGAREAADLRARRIKAAAKAPTMGKTKERNGLSWEAMVRSKRR

SEQ ID NO: 3911 - protein, 296 aa, Unknown
  Kingdom: Fungi, Phylum: Ascomycota
MASRVGPRSVKDATRFTSTIPHATSKAAAGASIAPAPSPAAKAAAKSASQRTARLPGETPEQRVRRLRQAHLAAQKAQVSTSDRLIDGSRRALNVVHRFTVTGVVIFTVVAGIVSIYSVWDMIRYNRARRTEWLAAQKALEDDALASARMAYMQGKATPEQALLVEEANRDAEAHGTKLPPLLAPPERRTHFEETIQPKLESQGKGVFGVVAGLFGGASNAAEKAEDAAATAGAEAVSGTTNAVKSVEEKAASAWESELENQRRGGSLDQLGLDAAGSASASSGKKGSWVRGGQFS

SEQ ID NO: 3912 - protein, 553 aa, Unknown
  Kingdom: Fungi, Phylum: Ascomycota
MANFLRQIVAGPRARHPEVDLDLCYVTDHIIATSGPSQTYPQRAYRNPLDRVVTFLDERHQDNWAIWEFRAEGTGYPDHLVYDRVRHYPWPDHHPPPFRLIPMIMASMRNWLHGEELNNDGEGGPVSSGKRRLSLKSEEKRRQETKDKRVVVVHCKAGKGRSGTVSCSYLISEEGWTPEDALARFTSRRMRPRFGAGVSIPSQLRTISYVDRWTKGGKKYFDRPIEIMEIHVWGLRDGVKVDIAGFADEGKRIEVLHTFSREERHVVEGDAPDGGGLSDMVWQMAGYSANPKREAPPAAPLADSANLEEKEDPKKTHSLKERGTKLIHKASSSTSLRGKDKDANTSGSDEKEPGGKAVILRPTRPVRIANSDVQVSVERRNKTSKSMGFTMVSAVAHVWFNTFFEGNGPEQNGQADDNGVFSIEWDALDGIKGSSRKGARALDRMSVVWRTVKGDDSGEIDEPREGEPVPQLKPADWQGGEGAYHEKELGLRVQSPASADVSKASSLVEDSKGSGNGGAAADDIDEWEGMRTSGPTGEELVAIEKANEKVAKQ

SEQ ID NO: 3913 - protein, 402 aa, Unknown
  Kingdom: Fungi, Phylum: Ascomycota
MLHVMASQKSQLPGLPGFDPDNIQPWTVTVVVSMTVFALVSVGLRLLSRHLKSQKLWWDDWMILFSMGWNLVVVGFIFAMHSCGMGIHADLLNPKDIVMMAKWLVVAEILYAFNLGWTKLSLLLMYYRIFHVPYFKKMAWIVGAFVMAWVVCITFLFIFICVPVEKLWYPELPGRCINQVATWIANAASTILTDLIILLMPLPQLWKLRLKKREKIGLTFAFSLGFFVVFASAYRTSVLFTYTATDPSYSLAPTVGWTAIEMSAGIVSTNLPTLLPALNVLLRLLGVRTANGTLGSSPSKGFRSTEDKMKSTPSAPGLVSETGKPRDAFYRLSDDEDGSETSANLYARSQTPMENKLRPDTMGFKYTVESYSREEREEESGDDIPLHAIRVKTDFEKKIDRQ

SEQ ID NO: 3914 - protein, 799 aa, Unknown
  Kingdom: Fungi, Phylum: Ascomycota
MSLAQLPPLDFDSGGLRISLFPRSDSPPLIAHDPHSGEPTVTDRKSSIEPKIPLPERKRPQVSTQVHDNAVDHGDSQHRSPSITYVNRQPETDRSKPNGVPKGQHVENPFQAEHDEDDPFDDQASDFVAISEPEESTEQSKGRQTIPKHPIPSMQDAFAESLHEVTMGGAASKPKLRAMDAKARRERLLEQDKDAEPFDQLWRYRPGQKQHEVLKLLAQISFGVYLLLNGMANSNSQVVTILQGHIDEVDEFLEVALEDLTQATIDLNGRIDYLKLPMSNMQVFEELLEDRNFRVEILEGNEKIEHILSRTNLALKQWDDDVEAGLRCSAAFTKWLREQEDASWKTDRPEVMDIFDAMNGNAEGWQNAFDEMNTRAQEMNNLIIKLMTIVAEMEKKAGEISRKTWAKIPPFTVPSKSGDKSSISSPQSHRSDPRSQGSLRSGSFTTLPVSKSDHHLMDAESILEYPLPGAAPLLPPPRISARVAARPSSSSSSARRQNGVTFAIPGSPPRSMDRVEIASQDSKSMADEEPLYILQPRTYTPQPSEPASPQRVQQHSPRSQESSRLGSIATEQQGLQKQTSLRQRVSQKGKAPVSIQIPPRNFAEGTAVHRHSPSSATPRTGASMAHDSAYGSDGDPHPQYRQIPRMTSHSDLSAPVRPPLMPSPRSDHQYYRPVQASPHSPLQQRPHTSGTGAAASHRHQSSSFSRSHVRNQPSRLGGMSMLSNVTNAQDDARTIATQRTARGTERTLKKKKSAFGWLKKAFSMDDEERAAYEARKAMQDAPQYYDDRSPKFLDGKRIR

SEQ ID NO: 3915 - protein, 185 aa, Unknown
  Kingdom: Fungi, Phylum: Ascomycota
MSRPTEGVDDESLTTRCCSQWTQPVEVGGDQLWTYDGKSTFFKGPFLGPLLFVNESSDARDHCANERTFLSYLRLSVYMAVVSVAITLSFHLKSQPSKIERKMAKPLGAVFWVLSVATLVVGLGNYIRTINKYSKREAIVQSGWKTQLVLGILASCIVGTCVILLSISKMSDDSGFRRLRTQFVY

SEQ ID NO: 3916 - protein, 642 aa, Unknown
  Kingdom: Fungi, Phylum: Ascomycota
MSREPKLAPHSAASSSMTNLDPSRDVELADLPTNHLANSTVKSFSWSSLSVTVKSRATKQPLRILDDVAGIVQAGEMLAIMGPSGSGKTTLLNALAHRVAAAGAVTTGDVTVNGTTATRQVIRDLSTYVEQEDALIGSLTVRETMTFAARLALPRNVGRKEARRRVTDLITSFGLQEQADTIVGTPIKKGLSGGQKKRLGVASRLITNPKILFLDEPTSGLDSALSLEVISFIKDIARRNNLIVVASIHQPSSSTFQQFDKLCLLSQGKLCFFGPVADAPTYFSRNGYEMPRETNAAEFYLDLINTDLDKDGEVHERTADITHKWTNSEEQTNVKTAIELTTHHAARDILHQDGAKPTFASISLVLLHRAWIKSYRDVVAYGIRIIMYLGLAILMGTVFLRLKTEQNYIQPFINAIFFGGAFMSFMAVAYVPAFLEDLHTFYQERNNGLVGPASFMIANFIIGLPFLFLISLLFSIVTYWLSNFRPSADAFFRWVLWLFLDLVAAESLVVLVSSIFPIFVVALAVTAFANGLWMCVDGFLVPMSILNPFWKYVFHYIDYQAYVFQGMMVNEFGHRDYDCAQTKDGYQCMYPSDLNSEGKIRGTAVLSNFSISTGQEGTWIGIIIGIIAGYRLLAYLALVLRK

SEQ ID NO: 3917 - protein, 486 aa, Unknown
  Kingdom: Fungi, Phylum: Ascomycota
MDSTRTVPGPLVDQKETHIQDQEPLDDSSLEQQTEAKRPLKKRILAVLWDSLDKDPEERKFIAKIDWWILSYCCIAYFVKYLDQTNVNNAYVSGMKEDLDMAGNDLNYLNTFWTVGYILGQLPSQIIITKVRPSIWLPTAEFLWSIIVIGMAGAKDVKTMCGLRFMVGLLEASAYPGIMTLLGSWYTPLELGKRACIFQASSSAAQMFSGYLQAALYSGMNGTAGLAAWQWLFIFDGIIGIPVCIYGYFAIPDSPTSSKAAWLKPRDREIAIARMEKLGRAPMKKLDWPIIRRIISTWHVYLFCSIFIAHVLGIKIYSYFNLWLKADGRWSTEEVNIIPSAGYGLQILCTLTYAWTSDAIQSRWQLIIIACMVSMTGTIILSVWPEHNLAAMMTGWLLTFCETGAGALIITWINELLSYSAEHRALVIGVVETAAFTFQAWVPLFVYNTGDAPHFPIGYEMATMFFGIEIFLALAILYLSKRFPIG

SEQ ID NO: 3918 - protein, 399 aa, Unknown
  Kingdom: Fungi, Phylum: Ascomycota
MSAPIPLPPLTPEEAAETNLPRIMGITATFHVLALLFVGFRMYTRFIIVKAPKIDDAFMILAAVGAFGSGMVIFIMQSPNGLGRHRQTTSDEDFLKFRRYGWVYSVVCAVFSFSMLKISIALSLLRMSKARWFTWSLYGLLAFIISYTIVALCSFLFHCRPIEGSFNGAIESKCYSRDLFIAFSIMNTCKQLTFLMLMYAPPNSFAAFNMFSDIVCATLPIPIIWTLNMKLRTRLYLVGVLSLGYITVGMGGIKAYYQLGARRDPDSQFEQSIQFYGFLQFNLGIIVACAPTLRPLLGRALKLSSHDKYSNNYYGQRSGTAGAYGNGRSVRQRTGGAFEDDYEMEDGVTFDRVGQVKTTIHGGTTTVYEKNSNASGSEEMILQGTEPIGIMKTTQINVS

SEQ ID NO: 3919 - protein, 1135 aa, Unknown
  Kingdom: Fungi, Phylum: Ascomycota
MAKRATHDADGAAAFRKRQKITHEVPVGEDVVDSTQLRQLLSFDQDMRKARHGLQSFKGLLDAIRSDDETRHAKSAILRAYLEEVKPRNAEDDSVYLSDIMEMWSFAVQVHNDDVTSSVVVVLALLLQIISNSLELLPHGLGVCRTLLQDQQLKSLSKNLSAPKNSGFIISPTLRLLTEAVCIDGGAFAKRIFRARDSTFTSLGRNLELGHIGEGQEDAKRASIRTTAVRFLLSCLRYLHAAARKELLSQREWISHLTYTIKNDPPYLALEILDSLMTYVLMDEKIDRASKLRAFNTKTLMRVLALYGNNATAIGDDAQISVGEKAHDFLLYIGTTQTGGILYPATSLYPKTAEEDQPSLTRGTTAANSSDLWVGTLDEGVPVYNFVLSEVAQKLRPWSNPKHAELLVAMFTAAPELISDYFYNNRSFTFEPKLTMTWIGYAAFLFNTMMIPIPPSFGDRVLYAAVPPPVPILLDNIIPTPITQKVLSRCFNPESHLTSFFATRIVVVALEKLTSTLELLEEGFRSTSSLWKDTSRQLVDAFCRRVPEMVELVRSYKAIPSDHYLHRTLSSRLLRLYYEVVPRLALAANFDVSPFLAEMLQKIDKRSADPDATSFGMIELENLVSIASYSPGMRWFTRPGKPTDTTALSPFTALLRLLCQSDSEESSTRLRKVLDTVAVENQVVSQEIKLKDLHRALQAMRKAGGQDLAAIWQYLDNSLTRCASTPIKYVELFETKIAAAGSDKERQSFCLLVVALREQLSFALASASKSDKALLGNFLSLYLNAANLSDGKKPVLRHVHQEVKDALKEASVKIPKLGSSEDVDLLKAISVDEPAPEEQSNGTEKKRTATVDASVLEETLHVQQHPVEDNTVLIKWANQSVEDLLEDDWAARLVHLLLSPHTHIRKEALTNLLKLAAKVKESSYEEKDQIWLLLSELAESSTTLVSDGPVPSQFVAFTTHAIDVLRNPLHVLYPKINTFLTRGPVWASDRLPLAPDVLHGEPSEDDRYYTEVAWLLTYLLDSLLTPADLAVFHRRRWFEKILALAANPYVRSNLRQKILRIVYRATEIEGGSTTLATRFGVFSWLAAQRAVCDVVEEAGVYDALVRRVWETCDQDRVGTWSQGGVQKLVERLTRA

SEQ ID NO: 3920 - protein, 137 aa, Unknown
  Kingdom: Fungi, Phylum: Ascomycota
MTVLGLRTVAKAQNGVGSFILQCKKLDFHYCDWAGSSKGMNGFIKSLLPKFAAANPQVEFSVSPRPGKHPVIVGHYINGRHKPICVRNLTPFEIMQKVELLRDASGEKLRKTNKPVLSTKQSVRGVWSPYHGKGVSF

SEQ ID NO: 3921 - protein, 269 aa, Unknown
  Kingdom: Fungi, Phylum: Ascomycota
MSTMSFPPLLRGITPANLTYTTALAIASAAVSSALFLIAYRDYRAYVALGPHGLPDTFWGWYMQLKLSRKARKDIIAPAPYDIDTVKVTMGPNAMRSYLPRTEKEASFAPRDGPRPHIPGFTAPQRQTTAQATLDTKAQMTSFLSQLVQENSTILQFENSELEGPVPAVQLRKSVGRRPEYLAQTKGEMAHVHPIDGSTHLVLSLKDSEEVIQRGWGQRHRLSGTVVGWSYTLVYAPRDEEELEVWKSIIVAAVRYCCGEIAAVKVPAQ

SEQ ID NO: 3922 - protein, 125 aa, Unknown
  Kingdom: Fungi, Phylum: Ascomycota
MSLKDDKFPSSWAFDTISSALQGEQERKDAIKQGKAIFGFTLKNPEGETASWHIDLKNTGTVGKGLSDKPTVTLILSDNDFGELVAGKANAQKMFMSGRMKIKGDVMKATKLEPILKKAQTKSKL

SEQ ID NO: 3923 - protein, 507 aa, Unknown
  Kingdom: Fungi, Phylum: Ascomycota
MGRPSFISPEASGYSYFCALWVAIGSLLWGYDSGIFSTAQAQDYFMDTFHPDPPMLGGIISIYTAGGAIGSLMSGFVGDRFGRRGTIQIGAIVAAIGTAMQTAAHETVLLLVGRLIAGLAIGLIYFAIPMFQSEIAPASHRGMFVGLHSQFIGFGYMTSNWVGYGIYFARGEVTYRFPVGLQVLWALLVLVGSYWLPESPRWLISKDRHEEAEKVLKKLRKSTIDPAIVNKELVQMQDQISWEKNNEESSLIAIWRKPSYRKRLIIGCLTHIGQQICGISAINYYQTVMYRSLGISGSTVLLLAGVWGLTGPLANIFCLMFIIDRFNRRTVLLWGSAALAVDIAIVQALVAVYGGTDNTVANSFGIFFLLLFGVIFSLSWNSGCPVYATEIFPTQIRATGGALATFWSFVIQVILAQASPVALENVGWRYYFFFIIMNVATGIVVYFFFPETKGKTLEEISEVFGDPFVTIHMDEDLKRPLDEEEPAERKIDTAPTPASAQTIPETK

SEQ ID NO: 3924 - protein, 727 aa, Unknown
  Kingdom: Fungi, Phylum: Ascomycota
MAPRGFDDEELTISLSSSHLRRQQQQEEARRSRDEASSQAPLPTIADGVVMDAPPATERVKAKTEQRIDAYKVIRTLGEGSFGKVKLAVHSSTGQQVALKIIARKKLISRDMAGRVEREIEYLQLLRHPHIIKLYTVIKTNTDIIMVLEYAGGELFDYIVANGRMKEAEARRFFQQMICAVEYCHRHKIVHRDLKPENLLLDENLNVKIADFGLSNIMTDGNFLKTSCGSPNYAAPEVIGGKLYAGPEVDVWSCGVILYVLLVGRLPFDDEHIPSLFAKIARGTYSIPSWMPAGAVNLIKKMLVVNPVQRATIDDIRQDPWFMTELPAYLQPPVEEFFNTGMDPSKAIEKSDIAPNASEVVQERLHNEVTDKISKTMGYGKGDVEEALKAEEPSAIKDAYLIVRENKLMQVSQNPDALIADEPDAAGSSPLMSLSSARSGMSQVPGSARPYVSKVGILPSSIPTYHKDYFERLKAGPHESELGAENPDEEPSPARTDAEKEESVRRLKPHSRSQIRIEEAAKPQSMTPVTPKKNKPVRWQFGIRSRNAPWEALLTIHKALHKLGATYLPDEDFEVAHSKETEGSRSGEGSFVSEHEGGPVGGGSTGSLGPSKGYKLPADPWHIQVRWDSSTIRKISQSPRQGVDEKYGTPESFHVYSPDDASRKSPFVAMHLDIQIYEMEHGVYLVDFKCSGYETSQGLLLEEKDVTSPFPFLDLAAKLIMQLAEAD

SEQ ID NO: 3925 - protein, 416 aa, Unknown
  Kingdom: Fungi, Phylum: Ascomycota
MQANTPILPSINLPGGHSVTFYKSTFFTRIENARLPTPSEVLSRAASGCVAYDTVHLSQQPALFEELGLIVKYGRGPKVTVAEGQCLWALRRYLPQVPVPEIYGWVTEGDKVFLYMELIDGVGLDLKWDQLSTKDRQGVCEHLRAMLIDLRQLRPDSNDVFLGQINHQPYNDVMFTNGVRPRAGPFVSVKGFHDWLSLISKQPAIYQFPDKTIEELPDPYRQLLSDNAEIVFTHADLHPSNIIVTKTEPYRVLAIIDWGQSGWFPDYWEFCQAEYTVLFESEWRTKYIPRFLQEPDERCIEGFESYAHAYDSTIPIFSSGAKHTPDAKNVTGECPPNMVHGCVTQGSDTTDQWESVDHVTVSIGEKYLNVGVTMDDSSSGDGVCEAMSAASAGIGLANAAAGFASGVLAIGCGLVE

SEQ ID NO: 3926 - protein, 169 aa, Unknown
  Kingdom: Fungi, Phylum: Ascomycota
MSDNVGLSTPRGSGTSGYVQKNLAHMRPRDRIAPYPKDLDSMRHKQRQPDKGILDHERKREVEVKVFDLRDKLEEEEVDEDEIDKQCDELRAKLLADLERGKGGAGPKRTFKQGQVHEMADAKIKESERLRKALKISSSYEEGSHWKKQEERLRGALESEGDAVKKERD

SEQ ID NO: 3927 - protein, 164 aa, Unknown
  Kingdom: Fungi, Phylum: Ascomycota
MATPPIPFTRLKQIATDVCNSAIGSAEFYDHAKAEQWNSTIINSMLKAVIGESKDESDQNKMYKFACNSTIVQHLVPTSSLNKSRGGSESKSEEPHVSTSTDGSATATDGKPHVGRRGMHSATGAFWDEKQDGMWTFKYDGGEGKGMDVVIMMMWIAVPKMVLA

SEQ ID NO: 3928 - protein, 655 aa, Unknown
  Kingdom: Fungi, Phylum: Ascomycota
MSAPKHRPSVLVTDARERRNPRGNLQRQSTSSGSPGGRMPMRFMTVDNVLQYNSQIPSGQPRAPPTPARPNTSSGLPAVGRRSLSGGLLNTQSRTGKPMPSRTTKVSEKLVLLPETDDKDDEAEDEIESETVLARRLQEDEGRPLKDEEIDVLRKRGGVRGKSYAERLPKVQRTEKVSRVTAYCTAQAYKIKPTAEFLRKKHEAKTKLYDDCLYVIYALPLLNGTEGYRVRSRPILKTPGTGKTVLDLEIERSERRDHHEGYFDDDAYTSAESPEPADQRRGRDMPVTFNDPSPDDPYPSNPFQHVDDRTSQMNRLAPEAKKFAEMFVFSYGVVVFWNFTEGQEKDILADLTFADAEDDPSLLTRPLEEDDFETEEFHFEYSADVKRPRVFNDMITLLPRSDHMIKLTISHAIAQSTKLCFFEERMGETMSDAQHVPKTLALTGELNMTRTEIVKILGRLFKSRVDINLSSNILDVPNFFWDSEPTLHPLYAAIREYLEIDPRIKVLNERCRVFLDLAEILSDSVADSKMSAITWIIIILIIVSILVTVTEVTLRFAMLEKSKNDEKKWRDGHPADAAVASIKWSHKKSGNDDAVIFAPPPSSVVPGQQLSDLEILARELGLMQGASLEDVRQGIWNLKQVESDRTDSACSSELR

SEQ ID NO: 3929 - protein, 332 aa, Unknown
  Kingdom: Fungi, Phylum: Ascomycota
MSPSAYNGDGPSIDANGSHQKRTLAPGIYVPTLAFFDPETDELDTKTVTKHAVRLAKSGVTGLAVQGSNGEAVHLTFEERARVTSATRSALDGAGFDDMPLIVGCGAQSTFEAISLCKQAASNGGDYALVLPPSYYSGLFDNETVVSYFNEVADKSPVPIIIYNYPGATPGLDLNSDTLITLSKHTNIIGCKFTCGNTGKLSRVASATKSSGTNFLCFSGSFDFTLPSIAAGASGVIGGLGNVTPRAGVRLWDLAMDAKRSEEARELQRVVAEGDWMMIQTGVVGVKAALRDGYGYGGWARRPLPRLGEEKVAWIRDGMKALVDIEKELERS

SEQ ID NO: 3930 - protein, 673 aa, Unknown
  Kingdom: Fungi, Phylum: Ascomycota
MTSPHRHGSSSLEESDSSSTQSNNPNNSAARARYNSGPTRASAAAAAAAASHFYTHPSRVSLLNPSHPHSIDSPTSQFRDPENAADMEDDGDGNAWRNGSGTPSFSRAFDMFTGPDDVDEASHLEEDRFFVPSYLAGSTYVHQLEEAHLSKVQVRRDAQRISSNGASSKLGQASASLPQGSHLGMAHTVIERPPPFTEDTGLASLPTRWNKDDMWGGIEVQPDGLSIKYVAQKSSHERDHEASAVRADHYMPPQCGLYYFEVQIISAKRNDTTIAVGFCTKSAQMSRPIGWEPESWGYHGDDGQCLTAHSVGKYFGQPFNAGDVVGCGVNFRDNTAFFTKNGARLHKLDPFANVTKGKLYPAISLKKAGEHVRANFGQTPFVYDIEGFMEEQQASVQQSIQSTSSSNLEPNMNETDLVQSLVLQFLQHDGYVETARAFAEDIRTQKEALNMDPNTVVNGINIKDDEDANNRQKIRRAILEGDIDRALKFTDLYYPNVLLENEQVHFRLRCRRFIEMVRQTAVLNMKHDSRSDIAEMDLDFDHSSPKDAEVQAELLELERGMLAYGQALQAEYATDPRREVSKALDEIWSLVAYRNPLKEPQVSHLLDRKGRVAVAEELNSAILLSLGKSSRAALEKLFAQTTALLEDLRQDGGDGAFVSVKDIIESVPKSTEI

SEQ ID NO: 3931 - protein, 104 aa, Unknown
  Kingdom: Fungi, Phylum: Ascomycota
MPALLNLNLAGSDQDYSDLLTPSPTSHRLANMAGPHSTYYDRKYRQGPALIRARRPYLVPNAITGVCLLAISLGIYTYTLRAVGQDDFDDVKVPDQPRKPSGAN

SEQ ID NO: 3932 - protein, 306 aa, Unknown
  Kingdom: Fungi, Phylum: Ascomycota
MAAWYAPAPVLTAELLATLPTTFRTLGTSDHSRNQKRGRLLDSFLEGPVVRGDTLYLADIPYGRILTFNLTSKEWTLVLQYDGEPNGLAWSEKHRRLLIADFKLGILSLDPDAAGGKQICTLMDRFNGERLKGPNDLIVLENGTIIFTDQGMTGLQDPSGRVYRISPDGRIDVLLRNCPSPNGLVLDGSRTSLFVAMTRDNSVWLAPLYPDGSVQRTGRFSSYFGVGGPDGMAMDEECNLFVAHSTLGCIFVHNKDGTPRARISVEASGRGSTNLTWGGPELKTLYIVESEAGSILTLEWHCKGVL

SEQ ID NO: 3933 - protein, 894 aa, Unknown
  Kingdom: Fungi, Phylum: Ascomycota
MSATTTSAPPASTGAPPQGGIIEGLNPVAYNPKDPITLFIVQAVIIIVFCRLLHYPLSKIGQPRVIAEVIGGVLLGPSVMGRIPNFSATIFDPDSMPVLSNAANLGLLIYLFVIGLEVDTRMFSHNWRVAAAVGFAGMVLPFGLGVAIAVGLYDEFRHEAAKPDMAFGTFALFIGTALSITAFPVLCRILSELQLLNTPVGITVLAAGIGNDVTGWVLLALSVALVNNADGLTALYVFLTAVAWVLFLVFAVRPVFIWILRRNGSIQNGPSPGIIALTLIMVLISSWFTAAIGVHAIFGAFLIGVICPHQGGFAIKLTEKIEDLISVLLLPLYFALSGLRTNISLLNNGITWGYVFGIIIIAFFGKIVGGLLAARASRLLWRESFAIGVLMSCKGLVELIVLNIGLQAGILSERTFTMFVVMALVTTIATTPLCKRFYPQSYQKKVEKWKRGEIDWEGNPLITEAQATEERMAKALDRAQASRVAMHLRLDSLGSLFNIVSLLGDSKKVNEDEPTKPNGSESNESSPNDAAHPMTMPPSRPLEVHGIRLLELTDRTSSVMQSAELDELANQDAVFSAFQTFSHLNGVAVAGHVAVVPTSRYADVLVEHAKEARSDLMFVPWSRHGSLAEDATLTLPEHVSLIDRFLSKTHIDFVQMALNAADCTTGIYISPTPEDPGSSKKPSQLRRVATGISVQSGRDALAVRPKAGKSQNVFLPFIGGSDDQAALLFVLQLANNPQVTVTIAHMKFLTEDTVVEVPSTSGTQQPVTEKGSAVKEATIEPSASDLELLSTARRSIANTPLEQRVNFIDDESASAPDVPARVLELSTLTFAATSHQRLDNIIIVGRSHASFTPLWTRESGLERDFQRTVGVLGDKIARSGTKAGLLVMSAKEEK

SEQ ID NO: 3934 - protein, 158 aa, Unknown
  Kingdom: Fungi, Phylum: Ascomycota
MAKKNAREPAPSSAATTQISAPVPVPVTTATTTSSAPKSTLSKAAGVASWDKVLQNIYDYYMKETPQRTKLIDVFLAFIAVVGALQFVYCILAGNYPFNAFLAGFGSTVGQFVLTISLRIQTTEANKSEFPSVSPERAFADYVVCSLILHFFCVNFIN

SEQ ID NO: 3935 - protein, 157 aa, Unknown
  Kingdom: Fungi, Phylum: Ascomycota
MSSRFFSATSAALARKAPVKPVKGNVPVRKSRQPQRSDAYRRIAILKQNLFSPAPPPLRMARLRYLRHWTIHRAWMLFRRQQKEAIDAERSRMHAGMYNACEELRKTKGPAGRGEGYLYRVAMEKKGVWRMGAVPIEYGRMQTDTPPKEAWDHNWKR

SEQ ID NO: 3936 - protein, 820 aa, Unknown
  Kingdom: Fungi, Phylum: Ascomycota
MAPTPVAISSLLRQTIHYHLDNFAYENALFFSERLAAQDPRSSEAVYLHALSHLRLRDYRSAYDVSKTTAYRGIHLGCSWIFAQACLQLERFKDGITALEKCRNSWSQEHNLGKHSAQTRAATPDAAAVSCLLGKLHRGYGDKKRAISCFEEALKSSPLMWDAFTALCDMGINVRVPNIFRAGEDLLASLDSASIQTQAKENGLTEAQPKKSSSRPAVTDLGADPFNVISSDANGPAIDMFVEPAETDFMSKIQAARLRLASSTNSQTAHDGMETPTGSSTADLMPARQTNSQEPPQAPPRRVRPATLETGTEGPPRMNYRLGAKRTGRTQERANEEPIGHVAEAANLPPPAQPTRSAIPGVERKRTVSGHPVTRPAANADEHATRRSARLNMFKPSVKANSGAATIGASAGRELKKARPQISRIMRPGSSGTSVGRVVSGNRKPLEDQNGADVDHGETARVREAHTQSVQSKSAEPDSVKLEEALRWTLDLLKKLGSGFYHLSRFQCSEAIQAFSSLPTAHQNTPWVLAQFGRAHYEQAAYADAEKYFRKMRVQAPSRLQDMEVYSTVLWHLKRETDLSFLAHELVDSAWHSPQAWCAVGNAWSLARDPDQALKCFKRATQLDPKFAYAFTLQGHEHVASEEYDKALTAYRAAIAADRRHYNAYYGIGRVQERLGSYDKAHTHFQAAQSINPNNPVLICCIGTVLEKLKQIMPALQAYTRAAELAPKAPQTRYKKARGLLAVGQVEAAQKELMILKDLAPDDGMVHFLLGTLYRSMNEKQLAVRHFTIALALDPKAGPKIKEAIESFEDDVPMDDSMMT

SEQ ID NO: 3937 - protein, 268 aa, Unknown
  Kingdom: Fungi, Phylum: Ascomycota
MLIQILSDLHLEAPKAYDVFEITPKAPYLALVGDIGTIVAHKAECLAFLKRQAAQFRAVLFVPGNHEAYHSTWAETLQTLREFEEEVRGNASLGDFILLDRGSFRVPGCNTIVLGCSLFSHVLPDSHDSVSFGVNDFYHTKEWDVAAHNAAYARDLAWLNNEVAALEETDKDTQIVIMTHWSPSKDSRASDPQHRQSPIASAFSTDLSGERCFASPRTKTWVFGHTHFNCDFEVEREGARPLRLVTNQRGYYFSQAAGFNPEMVLKMD

SEQ ID NO: 3938 - protein, 310 aa, Unknown
  Kingdom: Fungi, Phylum: Ascomycota
MTSKRNSRVFDDDQPKRDRGHSSAMASSDASRRTSRTSSCEDMHSAMVGVQIEHANQTTNPYEMGTMPRPNDLDSTREKAMIETLMMAERNHSTASSTTASSGSSSTHAPDPGCMANFGEVIPGVYRSSYPLSEHFDFCQTLGLRTVVTLVNKDDERSVNLGGFVQRNGIRHVVFNMQGTKKEEIPHHTMQAILGVVLDKSCYPLLIHCNHGKHRTGCVVAATRKIAGWPVDTVVEEYRTFAEPKVRDCDVAYITALEVASFQGIPTQAVSAISTTTYRSMRQRTFVRLLAFTFTAMLIFMCSSWQWDLP

SEQ ID NO: 3939 - protein, 563 aa, Unknown
  Kingdom: Fungi, Phylum: Ascomycota
MEESKVAPPSPPTSGNGEHEKKQLANPHTDLTVNGHLGDNSDDLHRRLNNRQIQLIAIGGSIGTALFVSIGNGLIAGGPGSLFLAYTLYSLILGMVNNSIAEMTVYMPVAGGFVRLAGHWVDDALGFMVGWNFFLYEALLIPFEISALNLVMSYWSDKITEPGPTAAICIGCIIAYAAINVIAVRGFGEAEFWLSGGKVILIFILFFYTFITMVGGNPRGDAYGFRYWNSPGAFVGAAPKARFEGFLAALWNASFAIVGPEYISMVAAEAKRPRIYIKTAFKTVYYRFFIFFFGSALAVGIVVASNDPKLASRAGAGNASASPYVVAMENLGITVLPDIVNALMLTSIFSAGNTYTYCATRSLYGLALEGRAPRFLRKCTANGVPIYCFAVVMLFPLLSFLQVGNGSAEVITWFVELITAGALIDFMVMNITFLFYYRACKAQGVDRKKMPYFGRFQPWCAIIALVVQFIVTLCYGYKAFAPWSVEKFFRNYTMQILAPILFFGWKIIKKTRVVKPHECDLVWDAPVIDRYENSFTHPPVGFWTEMGRMVGINRKKKAHQMDA

SEQ ID NO: 3940 - protein, 660 aa, Unknown
  Kingdom: Fungi, Phylum: Ascomycota
MVTISSFDSTDEEGLSKMADIMGEQHNPKHEDAQSPSPQTATKREGSRTRRRASTFMRHVLSWAPEAVWCLVALALLVALVVLLSQYNNQPLPDWPLGLTLNTAVALIATALRAVTVIVISEAISQLKWNRFASQTRRLSDLHVFDQASRGPWGSLLMVARGRGGVLSMAAALVFVTGLATSTITQSAISYSTRLVASVDSRASILIRTTYGEKGHVNEPEQSISNTPNGIENVAFQAVYQPADQSWPMTEPTCSSGDCRWKTFDSLALCYDMQNVTDKLTITTRDGASVSVEQNATLTLPIQGDFYLADVWSITSGIQQYNILNFTSPWPNLGNSATFMETDLNSFPRFRESIAHANDSDVLRATTSQWFAIYNNANADKNDGDHKYRAVELLWHFCVKTYNVSVERGTPKSNVVATSTEVRDGQGYGFDRPLNEDTDLRNFTLVSENGQSKFSVFDTFDYRRLDVHLRSAFEGGYSTMWTDEAPFNEFSRGISQKMFDGINVNTTVEDADKQVWDNLKNLAAAVSDATTDFMRKKGTTEEGETLIPETFVQVRWAWLSFVAIQVGLSVLFLVSIVWHTASLGVDVVKSSNMSELFALRHDTSYSQLPSEAMGIRPLVDPSIVAKLEKSDGTWSLEVSRQPVGAHKDHELRSHIRDPWA

SEQ ID NO: 3941 - protein, 555 aa, Unknown
  Kingdom: Fungi, Phylum: Ascomycota
MSDGLASAPVLSTPDDHILDLPSATDVPPTTSTLSDHDLRTTYEIPRTVTEIRLGGYSRVALQFPDHMLVDAPRVVESLATDLAISTDDTGTHTADGTTTTSGAPRIYVLADTSYSSCCVDEIAAEHADAQVVVHYGRTCLSPTSRIPAIYVYTSHALDHTQVAEQFQKEFTDKDTKVVIMADLTYQSHVASITTTLQAEGFTHLVPTDVVRDPSAVIPNRSVVGAAIDEESLKEYAIFHVSDPPTALLLALQARCASLHVLSTSSATALKLDNPTRQTAGLLRRRFASVLSLASAGVIGILVNTLSVSNYMTSIDLLRRRIAAAGKKSYTVVVGKLNPAKLANFAEIEGWVIVGCWESGLIEDDAGYWRPVVTPFEMEIALLSEEERTWGGEWWGGIERLRLEDGEKKTVDPDQEQAPDGDQVPREAHDDDVEGEESEAPEFDLRTGKLVSHSRPMRLPSRPAATPPAPLEASQEPSTEHKSPDSAAALIKRTVGELASINGVTSPGAEFLRSQRTWQGLGSDFDQSQETSTVVEEGRSGVARGYHVGEAAERH

SEQ ID NO: 3942 - protein, 456 aa, Unknown
  Kingdom: Fungi, Phylum: Ascomycota
MSEKAALPLYHHNTSTRGGGGTMGPNSMTHSRPPPPRIHARKLTPSSEKGTVDCTSEDALIHLKSYKYSSVDKSPISKYVLGPWWNAFVNFLPLWLAPNMVTLLGFFFILGNIGLLVIFMPDLIGPGPSWLYFSFAFGLFMYQTMDNVDGKQARRTGTSSGLGELFDHGIDSLNCTLASLLETAAMGLGTTHAGVFTALCPCLPMFFSTWETYHTHTLYLGYVNGPTEGLLVACAVMALSGVYGPEIWTQPLIHFFGDSFPGLKEMLGQTTFRDIWISLIVGSLIVGHIPFCVLNVVRARRKNGLPVAPVFLEWTPMIVYTLAIGAWAFSPYSTLMRDNHLVLFCLTLSLVFGRMTTKMILAHLTRQPFPYWTVMLTPLVGGAVLGNLPRFGLPQISANLELQYLWAYFFFSVVVYFRWAYVVITAICDFLGINALTIPKEKQIANKQARAAEKIH

SEQ ID NO: 3943 - protein, 286 aa, Unknown
  Kingdom: Fungi, Phylum: Ascomycota
MARLSNQTPDSKPDLSAPNPNLGRRKFADFDLSGRAFVVTGGAQGLGIAIAEGLVEAGGKVYCLDRAEEPSEYWHEARSRVVPEWGGSLEYRQVNVTDTANLNGAISDIARENQGLQGLVAAAGIQQVTPAVDYKVGDVRKMLDVNYTGVFMAATAAAREMIKYKTPGSICAVGSISGLMANRGLITPVYNSSKAAVIQLCRNLAMEWSEYGIRVNCLSPGPLMTPMVKKNFEQDPQLKETFEGDIMMKRLGDPSEFKGAALYLLSNASSFVTGTNLVVDGGRSAW

SEQ ID NO: 3944 - protein, 665 aa, Unknown
  Kingdom: Fungi, Phylum: Ascomycota
MRQYSLLSLTVGLLTRTAAAQEYEGYAFSYFVGDSLEGENIFFAASNGNNALSWTELNGGQPAITSQYGTKGLRDPFVIRSHDGGRFFLLATDLSIGSGTDWGDSQRFGSRYIEIWESEDLINWSEQRHTLVSPETAGMTWAPEAYYDDELGTYLVFWASALYEESDTEHTGSSYNRMLYATTDDFVTFSEPVVWQDSQASRIDTTVLKEGDTYYRFTKDEGRVTGCADIIQEHSSSLSAQLDAWTIDASCIGANAGTQAVEGPTIFKSNPNDVHGEKFYLFVDEYVNRGYIPLETDDIANPDWKVSAQYDLPASPRHGTVIPITKTELDNLTAALGTSSANKKKLAVRAEENDGPALPGFYADPNIAAFGCDYYLYVTSDGYPGWGGQEFYVWKSRDLVDWTRADEPFLTLDGENGNVPWAVGNAWAPTIIEKDDKYYFYFSGHNPVYGHKTIGVAIADNPEGPFTAEPEAMIANTEDVNSGQAIDPAAFQDPVSGKYYFYWGNGEPVMAELNDDMVSINWDTAQRIDGLNDFREGLFMNYRQGIYHLTYSIDDTGSPNYRVGYATAASPEGPFTYRGVILEKDESQGILGTGHNSVLNVPGTDDWYIAYHRFAIPEGGGTKRETKLDQLFFDQDTGFMLPVKPTLLDVQPNIQQGCSAASRHR

SEQ ID NO: 3945 - protein, 190 aa, Unknown
  Kingdom: Fungi, Phylum: Ascomycota
MLSNIMTIALMATSAFALPSSDYSSSKPTCMDAGTKVTSWTVENFDYHADYMSLSPGKLTSVKSYVNFDLVNPVLSYKAKCSAVSESQPEPFASKTSYKCKIDNKKYPSDSASFKFNLKTGKLDIKQHWNCAKEGGWIEADGFVTVKNPKCTDLTTTNNLWKHDGVYSTREVRCPKIKVKAPVKNISAVL

SEQ ID NO: 3946 - protein, 709 aa, Unknown
  Kingdom: Fungi, Phylum: Ascomycota
MIPRLIPRSSLLCPRCSFTKVQARPSRLPQRPLTPYRSLCTSNLLRRQVTTDTLKAQPKDPKPTTPESAVTTAEKAGNPKPKNNDPLATPDKSASEQRKADWAIMKEMSRYLWPKDNMGTKLRVSLAVALLIGAKVLNVQVPFYFKSIVDSMNVDFAAVGGTATTIAGSMILAYGATRIGSVLFQELRNAVFASVAQKAIRKVACNVFDHLLRLDLNFHLTKQTGGLTRAIDRGTKGISFLLTSMVFHILPTALEISMVCGILTWQYGFKFAAITATTMVAYTAFTIWTTAWRTKFRRQANAADNKASTVAVDSLINYDAVKYFNNEPFEVSRYDKALLQYEKSSIKVATSLAFLNSGQNMIFSSALTAMMYFAADGVAKGSLTVGDLVMVNQLVFQLSVPLNFLGSVYRELRQSLLDMETLFNLQKVNVSIQEKPDAKTLALTRGGEIKFENVTFGYHPDRPILNNLSVIIPAGKKVAIVGPSGCGKSTLLRLLFRSYDVQTGRILIDDQDVRDVTLDSLRKSIGVVPQDTPLFNDTVEHNIRYGKIDATHDAVIAAAKRARIHDTIMTFPDGYETKVGERGLMISGGEKQRLAMSRLLLKDPPLLFFDEATSALDTHTEQALMQNINGILREKGRTSVFVAHRLRTIFDSDLIIVLKGGQVVEMGTHRELVDRDGVYSELWSAQETLFNDDGSEKDDIKEGEDELKR

SEQ ID NO: 3947 - protein, 156 aa, Unknown
  Kingdom: Fungi, Phylum: Ascomycota
MVKKRKNKYDFLLPLSSLDKRSSGRNKKGRGHVKPIRCSNCSRCTPKDKAIKRFTIRNMVESAAIRDISDASVFSEYTVPKMYLKLQYCVSCAIHGKIVRRALVAALDALPSCCCSLVSRELHSVRSRVGRRNRAPPPRVRYNKDGKKIVPNTPKA

SEQ ID NO: 3948 - protein, 282 aa, Unknown
  Kingdom: Fungi, Phylum: Ascomycota
MFSYIIGLFAVLLFFSSHISQYLYPQSSPIHRNLSKRPQLNESLLAINHPNETTPECPPDAYIAHILSSAPLVVYLENFLSKDERQHLLDISNPLFEPSTISNDGHATLHDPSIRDSSVALIPRTNPTLCIEQRALSLQGYRRDIWLERLRTQRYGPGGHYSHHFDWTRNSGGWGRVSSFMAWVAADEGLVGGGTEFPMLRGRSDLKGEICKFVECPADGVEVDEESGEERGTVFKVIPGNAVYWENFAADGRGYDETWHAALPVEKGVKVGLNIWTFGRIE

SEQ ID NO: 3949 - protein, 317 aa, Unknown
  Kingdom: Fungi, Phylum: Ascomycota
MYEGVVVTIYSSEIGALRDCMPYGSVRWSAAIAASLVLGDRADELHGEERNDIMPVVDYFLAPSPDGTGQSWFLVTPVMSAGHLGHLAKQLRQSEQKHNGQDLDSIFRPSFEHILTTIHDMHTINGLCHDDIKPGNIFVATEAAAPNISTPWLLSGLSSVREADHPYHKSSIWTRSQLRDCQANDVVQLVKTYMKFLSDAVENNAEFNDQFLTGETAWSRLFWSTWYDMRQKQPITASRLLARSQSLDFVADSPSRPSSFGLWPVELRDPVYWSLMGREKTLARAVKNKLSFGASEKSARLWGLTSILGMPETSCQK

SEQ ID NO: 3950 - protein, 1438 aa, Unknown
  Kingdom: Fungi, Phylum: Ascomycota
MPNAKRLRSSGASKAQPKSAPAPGTSQDEGRPTPAEVEEEEHQFVQVARKNWLKPGKKPAKVKVKNDILKQSIWDQLEREGFAYKSLLLLESLQTLESYLWPGYTEEASNYHVLIIALIANVKRREHLETWSLFEDKSIDFSSLFRRVLSMSLDRTLATTIRTQLLCFLIHAFQSLDCTIVRKECAPLVAIGIWHNLSTDKMRDAHLDQAPHLRKAWRGAQRRYDAADDATKARLRFERSWLYTLLLDFLNIVYEVKSKPESALYCERFLEFISDLQSQLPTRRYVNALIHDLNFLAAIKLSPMYHDEDNSLLRDLHALLTHYSFFAIDDQTGAQLNRTEAFDKHCAALGKLQRVSLKHFKEQLTVLALSNYGAIDKREELQTLIEPLSDEQLTQLVNLLDIRTTYPENLSLSVDRRFLMEVILSKFERRKTFQEAAENMALTPTEGSLFDSGFQRADSYDGSHPLALPKLNLQYLSVGDFLWRALILYRAEAFYGIRKDIETALRRLKPQSRKSGETQFSGFSKMALPIAKPSILEVIPALVGDDKPSLVRAEVVVDVRGLGDGVRREWDSLRPDDVVFLLAAEPVDSSTNGEVSQAKSSGVSVVRTAEIIQITDDRGRHVRDGASHLDSKRRIQLKLDARTYQQDADRAESGKTDVYEGINLLLRRGRRENNFKPVLESIRSLVLSEVPLPSWLHEVFLGYGDPAGASYKNLPNRLQKLDYRDTFLSWQHLVESLPGKTVEPGFEVSGSFGPPYVLESAESTERPQEPKPSKKRRRDAEPPLSAGVETLKVSTYQPPNTGPYPQDALRQNSIRFTPSQTDAVMSGSQPGLTVVVGPPGTGKTDVATQVINNIYHNFPKQKTLLLAHSNQALNQLFAKIVALDIDQRHLLRLGHGEEDLGTDGNFSKYGRVESFLENRDRFLLEVRKLAATLRAPGAHDNSAETAGYFHKVYVEPAWAKFMQLANSDDCETADIVAAFPFHGYFADAPQPLFPDDSTRAQVLDVAHGCYHHISKIFSELADVVPFEILRREKDKANYLLTNEARIVAMTTTHAAIRRGEIAALGFHYDNVVMEEAAQITEIETFLPLAMQKPIDGEMRLQRVVLCGDHFQNSPVIQSLAFRHYANLEQSLFSRLVRLGVPIITLDQQGRARPSIASLYSWRYPKLESLASVQTKPEFVRANAGFKFDYQFINVPNYKGKGEAEPTPHFIQNLGEAEYAVAMYQYMRLLGYPAEKISILTTYAGQRALVRDVLNHRCARNPVFGMPKVVATVDKYQGEQNDYIILSLTRTSRVGYLRDVRRMTVAVSRARLGLYVLGRREVFEACPELRPAFDILLSRPDKLMLVTGEMWPTERPVLEDETGAVEGEVAMESVEHLGKYVYEMTATRVKQLENENAMPMGGEVIPEEQQDEDEVVEELEDDEEVPLEPDILEVREGES

SEQ ID NO: 3951 - protein, 681 aa, Unknown
  Kingdom: Fungi, Phylum: Ascomycota
MSWKLTKSMCLSCNFLSLLQLPLLARLLAIDLDAGFWTITTDNLTELKETHLGTLSPFARSPSTSTITEKDKDKEEKGQPSTEATTPTTESAIAASEAMSQAPVVKPPKPGILIVTLHEAQGFSLPEQHRNAFASQHQGSLSSGGVLNSVAGSVRPSSSQRVAGSFMNGSNRPHSSAGGFNGIPTNHGRISGKYMPYALLDFDKVQVFVNSVDGNPENPLWAGGNTQYKFDVSRVTELVIHLYMRNPTAAPGSGRSQDIFLGVARINPRFEERQPFVEDPKASKKDREKAAADHAQRTSGEGHRGAQWVDVQYGTGKIKVGVEYVETRAGKLKIEDFELLKVVGKGSFGKVMQVRKKDTNRIYALKTIRKAHIISRSEVAHTLAERSVLAQINNSFIVPLKFSFQSPEKLYFVLAFVNGGELFHHLQKEHRFDVNRSRFYTAELLCALECLHGFNVIYRDLKPENILLDYQGHIALCDFGLCKLDMKDEDRTNTFCGTPEYLAPELLMGKGYNKTVDWWTLGVLLYEMLTGLPPFYDENTNEMYRKILSEPLHFSDVVPPAAKDLLTKLLNRNPDERLGANGSAEIKAHPFFHAIDWRKLLQRKYEPTFKPSVVDALDTANFDPEFTSEAPQDSYVEGQPLSQTTQNLFHGFSYNRPIAGLGDAGGSVKDPSFVGSIQDNR

SEQ ID NO: 3952 - protein, 331 aa, Unknown
  Kingdom: Fungi, Phylum: Ascomycota
MSVSSSQSAPFTKRALVDEVSNAASQDAQTDLANLLPASYRTAEDDLTAPSPISEAVDAELDLSRLTAVHDYLWLAGRPMPPRPLHQQLLLNRQIAVTEKLDLHLVWGHGRIFIKPLPRFLLEPRFWNEHLQCRPPAGARQTCVCGGRRERALGFLFSYAALIANESDFHIAKDSRLLPPEVAWQAWRTVVGQVLTIVDVYQFIDPRFCYGELRLSRLNKIYYFWKTPLRGYVSRWNQYGSFFQDNITWLASSTVYMAVVLTAMQVGLATELQANTAFRLASSGFAVFSILVPLIVLAMVICALCYLVVYNWIATRRYLRQRLVRITGSKL

SEQ ID NO: 3953 - protein, 334 aa, Unknown
  Kingdom: Fungi, Phylum: Ascomycota
MPTFTVFKGSKDGLATEATTTRPDELTGDEVLVKITASGLCGTDLHYKTQDMVLGHEGVGVVERTGPNVRNLKKGDRVGWGYNTNGCGLCARCLEGDDVFCPDRGLYGSVNLDQGSLGYQAIWREAFLHTLPDALSDEDAAPLQCAGATVFTTLLGVTPNETVAIMGVGGLGHLAIQFAAKLGCKVIVLSGSESKKDESLRMGAHDFVAMNSLSKDGTNLPHHGAIDRLLVTTSAQPDWALILPMMATKSSIYPLSVDMRNFEIPYLPLILNGISIKGSLVATRAKHRQMLEFAAQHGIKPVIETFPMTEAGVREAIEKLESGKLHFRAVLKCE

SEQ ID NO: 3954 - protein, 1095 aa, Unknown
  Kingdom: Fungi, Phylum: Ascomycota
MDVSVGIVNTANGTSLDGYEPDDDMHNDMQGAPREDYPGLTETPSSEIPTDPMLMADQDGMLPEEYYEEQPEVTPSQVAQDDEAEEPMGEIPIDPAMIDPALMAGTASQRVSEPRSTSEEPTGTIEVLDPSAQVSEDTLMQDVEQTDFAPLVDSTTIKSEDGAGQEDNGYSEPVLNGSAGESSDPQPESGNISISKLSDEVQTTSSTQNSISSPAHSKSASQGNRSSPPETRAKSAELKSETKLSESVSSPAANNRTEDQEKEQELVLKTPKPVTSSEITTRSSAYKGSSSPEMTRTTRRSKAAQEQAELAAHVRQKLSAKSISSTPSKKEQVEKATPESDKQFFKSQPRPVGRWAHLTPYVDGEFTIYPEKKVRSDDETNGDDQSPDDKDDKETNDMEPMVEDNDDPQATEAPTPALNTPRRGSPAPDSGAITAFGSPAPAVADDGEDDVSDNDEPQRARHFRYRKLRDAEDYITALENYEDMSTADLYAVLEAVNISMVQWQTEWTGLGKKVDDYENALRRRAADTKYESRTRNLHQHNFNYEEPDFAVKGYKAKEKEIMSETRYLQGQDRIMAATYGFEYDPHPSKIGRQNPELQQEGMVTRGRMLRNHPRQTVKASEGDEPTGKRTRKAVQLFDPATQDVSRSSTPVPTRGRRRKNAAADADEVQPAPPSSANGNAASDDETGVRKTRRRRGRAKAEPDPEEPPPAVNTVTSSQEEPTRSVRRGRGRPGPRYDDMFASPSGGDKTSPPEEKEEPRRLLTLKIPRGKHFDDAASAMTDNGDSRPSTADSESSSHTVESSYSFRPKRQKRFRDEPEESPTAVSQQPPKKRRNRTSGAAVFVSKEHLGTPTTNNSEGYSMEGSVAAMPSTDPFVAENPANAGKKPQKIKVVRAAPQNDSSRYGTPTTLMSFNSEDGDEPPKDYKSMTKSEKMSASMKSRWANGNMAGAVEKRKATLAAKKAAQAAAEARVGAIAPKPQPKRAKKDPMEQQRQQQQQPHHPPQHQHPHLQPQLHHHHHHQQHPHMQHMQPIQPHHHQPLQPHPPPPHHHQQQQQPQPPPPPPPHHEGQGRFQGFPSRFHAFIANPWGPPGPPPQM

SEQ ID NO: 3955 - protein, 618 aa, Unknown
  Kingdom: Fungi, Phylum: Ascomycota
MGEGARYKSRWFTTTAATTLPPPVSTHPNLLTSLRLCDLTLNNTIIPSSTFSPSTRTPIKPVSSKLVLISWTLITHYHHHHHYSPPAVRTFRTLTQGLSKLTNPITSSLVMSPVVRGSTFSVSLVQSNSLLRPCLLGVQHSLPRGHSTRQASSTSNASVMSKINAPARRLIHSSERRTSTIAPVLEDAEPSMGEPFTAHRAPLSVLPLSMILRSLATNTVSASPTLLSPSLAIMGVLAHSTNPLLNPDRNPILRWFLKNTFYAQFCAGENAVEVRETVARLKRIGFTGVLLCYAREVVMSDKQAEKLASGDLGQETQELIQSEIIPWAEGTLETVRIAEPGDFVSVKFTGAGSLALYRLQKRLPATPYLAKSIDAICALAHERGVRLLFDAEQDRLQDGIDDWTMHYAEKYNKDSDQAVINGTYQTYKKCVPEVLTRHLVAAREGNFTLGVKLVRGAYLGSDPRECFWDTKEQTDDCFNGIASAVLTQQWSSMLPGEGAFPNASLMLATHNAESVRRARAICDAGAAKSEISFAQLQGMADEVSCELVEANSSPDRQAGAHEAMPTYKYLTWGTTGECMKYLLRRAHENKDAVQRTRDGRDAMWAELVRRCKAVVGLA

SEQ ID NO: 3956 - protein, 635 aa, Unknown
  Kingdom: Fungi, Phylum: Ascomycota
MPVPLAVAAPAAVGAFAYLNAKTQLWYDKLLVTCDAKGKGRLLWGTMRDRLNLFYLLESRANSWSTANKVFFWFEGQEWTYAQTYDTVLRYGTWMRKELGVKPNDIVAVDFQNSNQFVFIWLGLWSIGARPAFINYNLTGAALVHCLKTASVKVCLVDPNVAASVTEDVRTQSPGVTFINFDPSLEARVLATIPERADDSTRAGAEFQHMSSLVFTSGTTGMPKPAIVSWGKCYIGGTYASTLMGRGSDIMYTSMPLYHSSALILSFTATLFAGSTQAIGRKFSTKLFWKEVRESKATNIQYVGETLRYLLAAPPQYDPVTGECLDRKHNVKQAFGNGLRPDVWDEFKERFGVDTVVEFYAATEGPFGTWNVSSNDFTKGAMGRHGLLWNKLTSLSTRVIALDEITQEPVRDPATGFCKKVNPGEPGEGIYKLPPAEIEKRFQGYHGNPKATESKLLRDVFTKGDVWFRSGDIVRWDSEGRVYFHDRIGDTFRWKSENVSTAEVSEVLGLHEAIQEANVYGVQLPHHDGRAGCAAVFLNREPNESTMRNVAKHVRKSLPRYAQPLFLRIVSGIGEDNKHATGTNKQQKHALREAGVQPDVARDEELGSIFWLNGDSYVPFKDPDWNELEGGRVKL

SEQ ID NO: 3957 - protein, 689 aa, Unknown
  Kingdom: Fungi, Phylum: Ascomycota
MAADTLNLVEASIRDIQHALSTGALTSVELVSRYLRRVATYDCQGLALNAIPILNQDVFAEAAASDARRAAGHPARPLEGIVFTVKDSYKVKGMTAASGSPAFKDLIANDDAFTVAAIKAAGGILLGRTNMPPVAYGGMQRGVYGRAENPYNPDYLAAAWASGSSNGSAVSTAASMATFGMGEETVSSGRSPASNNALVAYTPSRGWVSIRGNWPLYPTCDVVVPHARTMDDLLKLLEVISVEDAVTNGDFWRRQPFVKLEQSWGGLPRNEVFVKAGSCQSLKGLRVAIPSMYAGGVCPEGATPIYTHPEVQKLLENARAQLEELGAEVVMVPDFPPVTGYENPDILPPGCPRLPEDWNWYERGPLVAHGWDNFLRENADPNLPNLALVDEMQIWPHDMRTEAELKYFPPKNAIHWGKLAGYAQETSFFEIPHLEYALQTLETMRSKLCDDYLTQFNCDCFAFPAQGDVASQDSDVNPESAAHAWKNGVWYSNGNRALRHLGMPSATVPMGLIGSKEVPMGLTFAGRAYDDVNLLRCANAFEKKTMKRTTPRHTPALATDEISLGNSITKRAQPPKLSVQTCKASPGNSGVLWVNIEGTLTIDETRDVNIEPQLEIAVNGQDILQAQITLTKAEDKECFTFTATTETAAPAVRSDRERTMVPVARDQTMVVLLARSAPGGMPAGHLDML

SEQ ID NO: 3958 - protein, 253 aa, Unknown
  Kingdom: Fungi, Phylum: Ascomycota
MTIYVTQITEKDIDGAVRAVQDAFVGDPYNVWVYDHSKVHLSPATPHRLHPIFGPIGANIRPQFNKKRNHASLALRMRWGMRNGIFHVAKEEGNDRVLGVAMWLPPRKADQPETWTDWIEGWRLWAGQVGMNMYYGRGGLNVKRYYIWKDAQAKAQEELWTDPRGYYFLNIMVVLPEAQGKGVGAKMMKMVTDQADAEGMKCYLESSRDVPNMAIYGRMGFRFEKEMICDDDGDAIRLFTMTREPNAKPGDGK

SEQ ID NO: 3959 - protein, 548 aa, Unknown
  Kingdom: Fungi, Phylum: Ascomycota
MAHIFDVAPLVNTGYVDGKKSDNRVKYPESAAFTGFNKPCRLEGDIFDLEVDGEIPPEINGTFYRVQPDHRFPPIFEDDIHFNGDGNITAIRIENGHADYKQRYVRTDRFLAETKARKSLFGKYRNPFTDSELVKAVIRTAANTNITFWRGMLLASKEDGPPYAMDPVTLETIGRYDFEGQVLSPTFTAHPKFDPETGEMICFAYETGGNGQDASRQIAVWTINKDGVKTEEAHYEAPFCGMIHDCGISKNYVVLPMTPLKCSLDRMKKGGNHWAWDPKEDQWYGIVPRRGGKPEDIVWLRSTNAFHGHVAGCFEDDDGKIVFDLTVADGNVFFFFPSEDAPPSTVAKRNRLKSPTQRWIFDPKATSGTWVEPSVVWDTSGEFSRIDDRYVTKKYNHFWQAKIDPTREYDAAKCGSPAGGLFNCLGHYTWDERVEDVYWAGPRATFQEPSFIPKENGGEGEGWLIALLNHLDVLRNDIVIFDALELARGPVATIHLPMKLRLGLHGNFVDQREIEDWQKRRSVDGDVGPVKAAEKPLPWQIELMNGGS

SEQ ID NO: 3960 - protein, 601 aa, Unknown
  Kingdom: Fungi, Phylum: Ascomycota
MGSITWSRENGWCDDKVWWKEATFYQVYPASFKDSNNDGWGDLPGLISKVDYLQDLGVDVVWVSPIFDSPQKDMGYDVSDYQAIYAPYGSVEDVDHLLEECHRRHMKVILDLVVNHTSSEHPWFKASRSSKDNSKRDWFIWKPARYDSDGVRHPPTNWRGYFAGSTWTWDEATQEYYLHLYAADQPDLNWDNADCREAIYEDTMRFWLERGVDGFRIDTVNKYSKRRDFVDVPITDTKSAHQPAPEMWCNGPRIHEFIHEMNRKVLAPYNAVSVGELSLTPHPSQVVPYISSSAQELDMVFEFSLIRLGNGDGFGSKYIYQPFPLSKLKKMTETWQTFVEGTDAWATVFCENHDNGRAVSRFGDTSSPELWRRSAKAIALWQTTLTGTLFLYQGQEIGMTNVPKSWDVSEYKDVESRNFYAEALESGDEERVQATMHGLQILARDHSRIPFQWDSSHHAGFTGKDAVPWMRVHDDSASINVANQEQDPDSVLSFYKKALKMRKSLRDIFVYGRFELLLPEDEDLFVFVKHSTRPQTRQQKAVVVLNMCAESRPMPDVSKAGLALESADLHMSNLAIGKNDQQSDPEVLMPWEGRLYITSAA

SEQ ID NO: 3961 - protein, 534 aa, Unknown
  Kingdom: Fungi, Phylum: Ascomycota
MRLSLALSALGVVAVAAEDAPRVKNIAIIGAGAAGSSAAYHLSQFASTSSLPLNITIFEKSPVIGGRTLTIPVLGDPRQQVEVGASIFVSANHILVNATRDFGLSTSRLGDVSSTGLEDDDVTAIWDGQSFVFESKRGETWWWEAAKMVWRYGTSPYYAMKLMQKTVATFLQLYEEPMFPFRSLTQSAMDLGLNQATGVTGDQFLAAHKIDKAFSRHIIQAATRVNYASNLAFIHGLETMVSFATDGAMAVEGGNWQIFDGMVARSGAFVHLNTTVTSIDLLDGDDKETSSPQYTIRTKDTASASEDDEHPTAFDSVIIASPWQYSDIKAPSSVVREVIDPIPYTRLHVTLFTSPHRLRPGFFGLQPTDRSPTSVYTTLREDETPRVGKDGVGDTGFYSISTLQVVVNPKTGAEEYLYKIFSVEAVTPTFLSDILGADVPESFTSGDAITWHHAHVFNAYPIELPRVTFQDPVVGDNVYYTSGIESFISCMETSALMGKNVARLAVDDLLAKEDEDWVMVDKEALAGEALPDEL

SEQ ID NO: 3962 - protein, 126 aa, Unknown
  Kingdom: Fungi, Phylum: Ascomycota
MGKNDKKGGSGAKGKGGGGGTEKDAPSKAKGAQLINVRHILCEKHAKKEEALEKLKEGVKFDEVARTYSEDKARTGGALGWKPKGSLDPAFEEIAFALEASTTSSPKYAEVKTGHGYHIIMVEGRK

SEQ ID NO: 3963 - protein, 557 aa, Unknown
  Kingdom: Fungi, Phylum: Ascomycota
MGILSLTTSLLALGSAVSAASLSERTKSYGSSAKLSSNAQSLFDYSMSVTDSRYDSSYNYVWYQDNGQWSVRFTSWYLPGLLHRGKPADVKAAIAAIENVLANQMNEDFNSPWYGTFKLSPDEPYPTADGPLYPPSIYGSYDPNWREFVGSQLVQVVEEFEHLLPKSLVTRIENALVAAAVGGMRRNGTFPEDDNLILGYSNPGIMRALTTGWIGERKNIKNLTDFATEQGKELYKLFKRDENALAEYNAPNYYGIDIWALAANIAYGPKDAPMTKNAKTMLAALWDDIAAHYNPYLGNMVGPYDRAYSRDATTHSQILSMIVWGMYGRDFFGQPPLGEADLLYDVAQGAALALVMDVISPEVSKKAKSIITAKGKWKGTRFIEKTIYEDLKSDNARVVTSWLSSELMIGGQTVNETKNRGNQYVPAIVQWAADPNHTPYPYMGFFSLFPSASTMDAVASANRLTVSYPNKTQEGANIFTFALTGIPPSWTLGGKHTVTGLENLPCLNVKVNAPGLKKQDVVYGATLRDHWIYNISYVVPETFSGTPKVTLDMKYTC

SEQ ID NO: 3964 - protein, 181 aa, Unknown
  Kingdom: Fungi, Phylum: Ascomycota
MIDMDMGSTTMAMAMPTSTSDSMSSMDMPMSTMKMQFFTSTTTPLWSSSFTPETTGQYAGVCIFLIAFATIFRLLVAIRINLFAILSGIARRQQGAALLAAYNVEATKDGAGDNHHREVERPWRTSDAMMSAFLDVVIAGVSYLLMLAVMTMNVGYFMSVLAGVFLGSILCGHWTGGLIAH

SEQ ID NO: 3965 - protein, 1183 aa, Unknown
  Kingdom: Fungi, Phylum: Ascomycota
MERSRGVPDQEMFLSNPAPAGEDGGDSPTVEPLRIFKPQSPANAGVASGHRYPTPPSAFKQSFPLPPGASSSAAPLPFPDDDEVHRPTPPAQYGASYNTAMSPRLDTATGERKPGLAERRGAAPKPIHSPTSPDGDAGLFARPLQDHSRPGSNPAYHDYQQKPYYPPPGGASHSASSSNTSLHAPGAGEPEGGSGVNRFASTASVSTTRASRGSPPPPETPIVEPGQAPGAGAGAGGIEARYAASGISGTATLNSLQAHQVQSAAASQRLAQYNNARPPQRPWTPTESPGQAPSGPPTVYQGANPVSSPPPTRTTFSPPPQAPVQTPNGTGEQVSALEQDMQGLSTNDPPPAYSSVNPGGKSSYPNEKNRPQQAGASTSTTPANNASPAPAKPAAAPVPVAAAAQQHPGHPAFANEGQSSDQGSQSSQVTPTPSIPSLQTPAIASPPPLPEGWIAHLDQNSGQYYYIHLATQATQWEFPKGPNPIAHEQAPLSPTASTYGNPLASPMFGGKQPMASPMFAPHTPGYAESIMSVAASQAPSTSGFTGPPPSAGVDMYRIQPTNGVYFGPYLRYVNMDMEKGLWLGSILIVTDAPQPPTIHCHLSNDLSPNPRQLQPHVIYTHQRWSFHKYDMDLPMSEAGTERWTYAVTSHMGCTRYEFAIAGRHETSWRFIAHSGNDFASSTSQNERARLGGVGFMWKDVLQKNVDCGGFHVQLGLGDQIYGDRLWKEVPLLKQWLAMSGRENKKNVQWTARHEEDVAHAYFHYYTSHFDQPFLREAFAQIPHILQIDDHDIFDGYGSYPEYMQSSPMFKNIGRIATEMYLLFQHHTTVEILRNVSTDHDIFTVTGTGWHFVKHLGPAMVVVGPDCRSERTQARVMAGPTYQGIFPKIATLPPSVQHCLWMVSVPIIYPRLEAVESIANTVAAGKKAVNTTYNILGKVTSSVAGVVGGKEVVAQGFTQVKKAVGKTGLMGNVLNQFGELDIQEVLKDMWTHDTKDLERTYLIRTLQGIAQQKGLRMTFLSGDVNASGAGLFHDPTHPGDHKTMYQVISSPIVSSPQSNHMLKMLHNQKTLYVPQNGHKSNHEPSDTKEDMMEIFHTDASGAARELKKLMGRRTYAAFVSYDPDAAAQNQPPFSPNPSISSGGQGQQGLSKLSLAVDFVVQGDGPYMSTTKYGPVIIPHLEFGR

SEQ ID NO: 3966 - protein, 172 aa, Unknown
  Kingdom: Fungi, Phylum: Ascomycota
MASEPRIATLDASQINICYPTIAERLPPHCAALFEAKQTKGLSFEAIANHLERSEVACAALFYGQTTATQEDIEKLSKLLDLPQQVLTSAMSGFPDRGRAGPMPPVEPLIYRLYEIVQNYGYAYKAILNEKFGDGIMSAICFSTKVEKEIDEAGSPWVVITLKGKWLPFTRF

SEQ ID NO: 3967 - protein, 434 aa, Unknown
  Kingdom: Fungi, Phylum: Ascomycota
MATVVLLLLLLIIYKRNAEDQWWLLAQRDRYDKPMPGRYDFNNVHLDTQQCEATFPDLTIQVDNEVARGSLNVMFAKGVVLLAKIENDELFIIRSPHPNDLSKTMRHRQLATLHQIHRSILTSPGHLPNTTLTLSAHDVSSASTIAFARPAYSPSQKRIMPMPHFSFWSWPLPFIGSIPSAARRIAAIEDELSWEKKEKRAIWRGTSWYNNGAGSNRRGRQELLTKTKGQDWADVEALQWENNSEDASNAIRIEDFCRRKYIIHTEGFGYSGRLQFHQLCASVIISPPLEWMQHTSHLIRPVFSPTLLRAPSQGWTEEPMTKWEQTARKGWPKVFSAQEANMIFVRPDWEDLEEVVTWLENHPEVAKGIAERQRETFEGKGYLSPAAEACYWRALIRGWAEISRPVGEGWNARGVPYEQFVTGKQDGRDTVAGQ

SEQ ID NO: 3968 - protein, 330 aa, Unknown
  Kingdom: Fungi, Phylum: Ascomycota
MKLQLLSSALAASTLASAAALPSKSDATKLCDSPSKRIEWRQLDPEHQQSYLDAVLCLKTKPSRRGLNSTLYDDFGHVHFELNSYIHGGAPFLPWHRYFGMVYEDALRSCGYDGPGTYWDWTLDTEGLRLSPVMADEFGFGGNGNPDATEPSPDPDARALQCVTSGPFKDIRPEYLAVSPVKMVPGGHCLYRDLPEVSEPEAFATMAKLLSPSSISDLLTSGNWTHFAWALEGGPHGMIHASLGGEMNPTTSPNEPLFFLHHAQVDRLWWMWQQQNDTRLEEYNGEVLHFGEDGAREVSMDDVLSMGGVGEDVTVRDVMDTRSEKLCFTY

SEQ ID NO: 3969 - protein, 1189 aa, Unknown
  Kingdom: Fungi, Phylum: Ascomycota
MSGTMRGTPSRQGRGNIPFTNSPVNSAIPRPVLDSQPSEASSSVSASRQKQSKRDEAIRKRIESDLNKKKHVTNRARHTRKAPPGTVLALKPSQALQIKPNTTVSEAAQLMAAKREDCVLVTDDDDRIAGIFTAKDLAFRVVGAGLKAANVTIADIMTKNPLCARTDTSATDALDLMVRKGFRHLPVMDENQDISGILDITKCFYDAMEKLERAYSSSRKLYDALEGVQSELGASQPQQIIQYVEALRSKMSGPTLETVLTGVPPTTVSVRTSVKEAAALMKENHTTAVLVQDQDAITGIFTSKDVVLRVIAPGLDPATCSVVRVMTPHPDFAPMDMTIQAALRKMHDGHYLNLPVMNDGGEIVGMVDVLKLTYATLEQINTMSTGDGEGPAWNKFWLSIGDGETESMVSGDGSHHHTHMSSRIMSPDANRDRLNESVAPGDSASHVGASSPPRSIAPEEPEVAAPAEVPFPFKFKAPSGRVHRLQVVAADGIETFVSAVSGKMGGPEVGSIGGIPVVEDGKLSGAGFALSYMDDEGDSVSITTDNDLLEAILLARQGRRDKVELFVHDPDKPPVAPAPVVETPAVPTPPASSAVGLRERRRAYDDDSDYDEDEDDESTVRRSRRSRNNHAQEQVIAGVPNELLLPGAIVTLAVVIHKSIDLEAAGVCFSESRGQAAGEYADPLKLVARNLGDSSLISTCIAVAIQTATAMILRNVTARHGRCHLAPIARASLRQLTTAVETPTTRDGSPSLDTEAAEEVIRRRSKKGSVRVLGANSSTEHGGSRWAATRPMTEGGPVLTPAQQFAEFKRIQNNTKMVGSGLAKRYVPTELIHDPPGPEDVTLELLMASQTHLGHNTSLWNPANSRYIYGARHGVHIISLETTAAHLRRAARVVEEVSYNGGLILYVGTRKNQMEVVARAATLAGACHLFTRWTPGTITNRDKILATKPTKMINQNDQRLEDFGKFTSSERPLVPDLVVCLNPLENYTMLYECGLASVPTIGIIDTDADPSWVTYTIPANDDSLRSVAVIGGVLGRAGQNGRRRRLADAEKGQVTWSTSDDVKVFMRQEMTDAMLRRKEVMGRMQEQLAGFTEEESELLNSRLPSKPAKVGHDEMLGLMSEATQGELEAAISKVAEESVAEVEVKSDSQDEASVIVDEVAAHVNEAAAKTQDMVAKFMAAKGKFQSPTE

SEQ ID NO: 3970 - protein, 678 aa, Unknown
  Kingdom: Fungi, Phylum: Ascomycota
MLDTFEVITTSGVVLWSRTYAPINPSLINNFIADTFIEEKSGSTAFKDDQSAATNTPYRSEQHTLKWTLVKELGVIFVAVYRSLLHLTWVDKLVDNIKTIFVSLYGDQLKKPHTTLIECHNFDNYFEQQVRELDSSGASARHAPAITTHGDMPLEEETISNDLGDDPPLPPGMTYRGRHVSGGNAAAATISNDSTPIQTPTTSRPSTPGSNLVTAKGGPMAKMSRRARKAQNAHSTSVPASSGDESASGARNKAVKAVKKGRKWDADGYADEDDGVQLDYSKANVTSDSDADGSPVVARSSAIDPIDAASWGNTTKGKFVLKDLGDEVHSMLANAEAQKAAASAEAAESKQSGLLGTGVSAISGLFRNVVGGRTLTKEDLDKAMKGMEEHLLKKNVAREAAVRLCEGVEKELLGVKTGNFESIQTRIQSAMEASLTKMLTPTSSLDLLREIDAITSPPVTSLRSARPYVMSIVGVNGVGKSTNLSKICFFLLQNKYRVLIAAGDTFRSGAVEQLAVHVRNLKELTAREGGRVELYQKGYGKDAATVAKDAVAHAAQEGFDVVLIDTAGRRHNDQRLMSSLEKFAKFAQPDKILMVGEALVGTDSVAQARNFNAAFGSVRTLDGFIISKCDTVGDMVGTLVSLVHATNVPVLFVGVGQHYSDLRNFSVKWAVEKLLSNA

SEQ ID NO: 3971 - protein, 651 aa, Unknown
  Kingdom: Fungi, Phylum: Ascomycota
MRFSSILPAAAGFVGLASATLGHLPIVSDLVKGSDKVVKPVFDLAHHWEDDVLFKGDVSADVSLDLRLIQAAISGQVGLDCSAKFLERPALRLSLAGVKAFVQLDLSASASIYESVELFATPELSVDLLELLQIDLKALIALDLTIGCSAAIDVAAGVYVSFNEDAYIDIDLLKRDVLDINLANPVIEALPLAIGASVDLAAAVDLEIGLRLRTYVSLEADVEIIGIDLLEAGAEVAIFVNLFDYTTTLIDGSGDCVVSASKDIALTLGLAVRLDVSILDLIDVSLTPNVFLTLATVAELDICLPDRGTFPDGSELIEDGDNEDGSDDGSDNGSDNGNGNGSDDGEDGNGSDNGSDNGNGSDDGSDGSDDSEDGEDSDESSETPNPIIVDPIASVTASNTPSVSVTGAPAITAAPTVSSPAHGSNGTASTSTESITTTYTITKCEIDVVNCPADKKTVIVHSTVYKCPATKTKVPSLPEITKTSTLTPCPTPETVTVCPPEKPTATPGVPGGDKPGKPEKPEGEKPGKPEQPEHETPEKPEHETPEKPEQPEEPICPGSPECPEETPEEPETPSKPEEPEHETPETPSQPEEPVCPGSPDCPEEPVVVPPPAQTPSIPPPVSTPPPAEAGAGSLTVGMVSVFFGAVVAVML

SEQ ID NO: 3972 - protein, 2370 aa, Unknown
  Kingdom: Fungi, Phylum: Ascomycota
MSQPPPPPPGWGPAPPPPPPPSASSLPPPPSTPAPPPPGYRPETDPQIAKFAQKKKEWLRQQRARFGEKRKGGFVQTQKADMPPEHLRKIVKDIGDVSQRKYTNDKRSYLGALKFMPHAVMKLLENMPMPWESAREVKVLYHVNGCLTLVNEIPRVIEPVFFAQWAMMWTFMRKEKADRRLFKRMRFPPFDDEEPPLSWSENIEDVEPLEPIQMDLNEEEDEAIIEWFYEHRPLLDTPHVNGPSYKSWNLTLPQMASLFRLSRPLLSDVIDKNYFYLFELKSLLTAKALNVALPGGPRFEPLYKDIDPNDEDFGEFNAIDRIITRNAIRTEVRVAYPYLYNSLPRSVKLSWHSDPQIVFNRAEEADLPAFHFDRRINPISSRTVASKNVDVSLEDELFGHGNNEEPEDEIFELPKNLEPFLSDEELENEDTASAVELWWAPYPFDRRSGRMVRAQDVPLIKQWYLEHAPSDKPPVKIRVSYQKLLKNFVLNELHKKKPKAQNNQNLLRSLKQTKFFQQTTIDWVEAGLQVCRQGFNMLNLLIHRKNLTYLHLDYNFNLKPVKTLTTKERKKSRFGNAFHLMREILRLTKLIVDAQVQFRLGNIDAFQLADGILYAFNHVGQLTGMYRYKYKLMHQIRTCKDLKHLIYYRFNSGPVGKGPGCGFWAPAWRVWLFFMRGIIPLLERWLGNLLSRQFEGRHSKGVAKTVTKQRVESHFDLELRASVMADLMDMMPEGIKQNKVNTVLQHLSEAWRCWKSNIPWKVPGLPAPIENIILRYVKSKADWWISVAHYNRERIRRGATVDKTVAKKNVGRLTRLWLKAEQERQHNHMKDGPYVSSEEAVAIYTTTVHWLESRKFSPIPFPSVSYKHDTKILILALERLREAYSVKGRLNQSQREELALIEQAYDSPGTTLERIKRFLLTQRAFKEVNIDMNDNYSTINPVYDIEPIEKISDAYLDQYLWYQADQRHLFPAWIKPSDSEVPPLLTYKWAQGINNLDKVWVTEDGECNVMLETELSKVYEKMELTLLNSLLRLIMDHNLADYITAKNNVQLTYKDMNHVNSYGMIRGLQFSAFVFQYYGLVLDLLLLGPQRASEIAGPPQSPNEFLQFRDRETETRHPIRLYSRYIDKIWVFLRFTAEESRDLIQRFLTEQPDPNFENVIGYKSKKCWPRDSRMRLMRHDVNLGRAVFWDLKNRLPRSVTTIDWDDSFVSVYSRDNPNLLFSMSGFEVRILPKIRNKNDEFPVKDSVWSLVDNTTKERTAHAFLQVTEVDIQKFNNRIRQILMSSGSTTFTKIANKWNTALIALFTYYREAAVSTVELLDTIVKCETKIQTRVKIGLNSKMPSRFPPAVFYTPKELGGLGMISGSHILIPASDKRMFKQTDTGVTHFRAGMTHDEETLIPNIFRYIIPWESEFIDSQRVWTEYSQKRLEANQQNRRLTLEDLEDSWDRGLPRINTLFQKDRSTLSFDKGYRARAEFKIYQLMKSNPFWWTSQRHDGKLWNLNAYRTDVIQALGGVETILEHTLFKATGFPSWEGLFWEKASGFEESMKFKKLTNAQRSGLNQIPNRRFTLWWSPTINRANVYVGFQVQLDLTGIFLHGKIPTLKISLIQIFRAHLWQKIHESVVMDLCQVLDQELESLGIETVQKETIHPRKSYKMNSSCADILLFASHKWNVTRPSVLFDTKDVIEPTTTNKFWIDVQLRYGDYDSHDIERYTRAKYLDYTTDSASIYPSATGLMVGIDLAYNLYSAYGMYFPGLKVLVQQAMAKIMKANPALYVLRERIRKGLQLYASESNQEFLNSQNYSELFSQQTQLFIDDTNVYRVTIHKTFEGNLTTKPINGAIFIFNPRTGQLFLKIIHTSVWAGQKRLGQLAKWKTAEEVAALIRSLPVEEQPKQLIVTRKGLLDPLEVHLLDFPNISIRASELQLPFQAAMKVEKLGDMILRATEPQMVLFNLYDEWLKSISSYTAFSRLVLILRALHVNPDKTKLILRPDKTVITHEHHIWPSLADEDWIKVETQLRDLILNDYGKKNNVNVSGLTTSEVRDIILGMEISAPSMQRQQAAEIEKQQEEQQQLTAVTTKTQNVHGEDIIVTTTSQHEQQTFASKTEWRTRAIATSNLRTRAKNIYVSSVDNDLDDVTYVMPNNILKKFITIADLRVQVAGYLYGSSAPDNDQVKEIKCIVMIPQIGGLRNVQLPQQLPQSEYLDGMEALGVLHTASGNELPYMSAADVTEHAKLLDAHSSFDRGSSVTVSVSFTPGSVSLSAWGLTPEGYKWGAENKDVQSDQPQGFTTTMGEKRKLLLSPRFRGFFLVPDDGKWNYSFMGSAFAGMEKKPVRVKLDTPLPFYSDQHRPVHFHSFAELEDIWVDRSDNFA

SEQ ID NO: 3973 - protein, 113 aa, Unknown
  Kingdom: Fungi, Phylum: Ascomycota
MVVKIRLARFGKRNSPFYNIVVAQARTARNSKPLEVIGTYDPIPKPDPYDNSGKLHKDIQLDSARAKYWIGVGAQPTETAWRLLSMLGILPKKEYSKTEREVKEIPAEGARLR

SEQ ID NO: 3974 - protein, 331 aa, Unknown
  Kingdom: Fungi, Phylum: Ascomycota
MPRYPKRFNSPDTPPSLSSDTHTPPRQSADDPLPSSPLASPTPSLNSSYFGSMFTGLIRRFSTEDSQLGSQIDSFFMGPPNDQHKQQPQQQQSDDGINVLHADRVSSGGLLLTHGIAEEIRAMIPERLRITEDWKIVYSLEEDGASLATLYQKCRHFEGKRVGFVLVVKDQDGATFGAYLSDYPHPAPSYFGNGECFLWRASLLNSLPPPPSADTTFMTRNTQLAPPPRSSPSTSSNSLMPDAAAPPSRSPTPSESIRFKAFPYSGLNDFCINCETGFLSVGSGGGHYGLWLDDSLDVGHSSRCETFGNEPLSDEGEKFGVIGVELWVVGS

SEQ ID NO: 3975 - protein, 392 aa, Unknown
  Kingdom: Fungi, Phylum: Ascomycota
MKISSATLIAFAAGAIGAPADTVKPRQAPGGCSSAVKLDAKTNVWTSYTLHPNAFYRAEVEAAAAQLSGTDAQKALKVADIGTFLWADTIANIDRVEPALQDVPCNHIFGLVVYDLPGRDCAAKASNGELPVGALSRYKSEYIDKLATLIKKYPNTAFALLIEPDSLPNLVTNSDLTTCQQSASGYRDGVAYALKTLNLPNVVQYIDAGHGGWLGWNDNLAPGAKELAAAYKAAGSPSQFRGFATNVAGWNQWDAEPGEFAGASDAQWNKAQNEKKYVELFGAALQSAGMPNHAIVDTGRNGKPGGRLEWGDWCNVVDAGFGIRPSSNTGSTLTDAFVWVKPGGESDGTSDTSATRYDSFCGKSDAYKPSPEAGQWNQAYFEMLLKNAKPAF

SEQ ID NO: 3976 - protein, 306 aa, Unknown
  Kingdom: Fungi, Phylum: Ascomycota
MGATETEFEQPSGGGLQTAKDLFSGAVGGIAQVLIGQPFDIVKVRLQTTTQYSSALNAATTIYKNEGALAFYKGTLTPLIGIGACVSIQFGAYHQARRYLESRNAESHPTSPDLSYPQFFAAGAFAGVANSVLSGPIEHVRIRLQSQPHGAGKLYNGPLDCVRKLGAQAGGVLPGIYRGEAVTIWREAFAYGAWFTSFEYMMNSDARRNNIDRKEIPPWKIAFYGGLAGEVLWLSSYPFDVVKSKMQTDGFGEKQKYKSMRDCFGKTFRAEGMGGFFKGIGPTLLRAMPVSAGTFATVELVMRAIN

SEQ ID NO: 3977 - protein, 207 aa, Unknown
  Kingdom: Fungi, Phylum: Ascomycota
MCPWCYIGYRKLQAAQTMWLQKYPNDTFSIRWKPFLLRPDLPRGVSRDKMVAYTEKFGADRIPMLLGRVAEAGEQVGIKFKFGGRIGATRDSHRVIHLAGKLGGEALETKTVEGLFAAYFENEKDLTDLDLLKDVAIKAGIPEAEFQKSIVDSDDGGAEVDRAVMEAQYGSVSGVPDFTIQDKFNFSGAQDPAVFLGVLEKVKALEG

SEQ ID NO: 3978 - protein, 642 aa, Unknown
  Kingdom: Fungi, Phylum: Ascomycota
MQPSSHAAARKTITRSRAGCAVCKSKRLKCDEARPACSRCRRLGIQCPGYPKQLKWVKAESTPSIAETGQTSPPQPVMNSMVPPPMFDFNETLDPAYTDFANINPFDAFNAPIETPATLEDFASHSSEIQFQEDLVIQSPPSQANQQVATRAGGGWAEQDKPNSWLDSMLRNANADNTQLIEHRRTSSRRSPGRGEVEQLPTALQDHSSILIEYYFKEVCGMMSCYDSQMNPYRTAISNAWASSPALYYVVQSMAAACLSDVCHEFSAVGRRLLDQSIRLVSEDMKPGQQLTTPTLMALVMLGFSMSWHDASSLGQGEFELLSKAILSIETQQDGSLWPEKQKQVFFYNSLVYGRMLLSFVTDTESTLPITCKLLPQPEVAKDEAHLPPHPQTGIGIEVQELVAQVGKLVRRERKRIRSRQSASRIDIEQAKAAIQIAEHLNEQLCAVKLPSEAAVLNSGDDMTPTSHLLQVAEAYRLAGLLQLYRNFPDLLISQLPPSPEVEAIADSWLTRLAMHINDMVQDIPITSRSKSIQPLLLVSICSELSIHRKHYPLDGVVPFTGPVASITASPRFLTTPSVTDVLQSRRTSMARLSFFKNMLAARPIKQMMTLVQETWSYMDRNGQEIYWMDVMLEKGYETLMG

SEQ ID NO: 3979 - protein, 2075 aa, Unknown
  Kingdom: Fungi, Phylum: Ascomycota
MPSFITTQALVAAFAFGVIVNAATASLFLFTKDHGWHSFRDGPRLVLIVFLAGAALWALTDFIAMTVDGNAMPGCQVATSFISGFDQIARVALIQFLVWGTQNGTKTTGQKFIFQGLVLLRFLIGGIIVGMMRPQINSMYCVGTALVKPLSMAGIVFDCFMAFMLLVKVFIQGSFKAVPEGGHSIVRRKVLIFGIISFAIWSALSGPMLLGYDSLILITRTLLPAIGVGLIIAILAFNHTHLSFAPQRAASAEQGGPFSGGARHARDPASQDSGYNSDTYAPPSRYEEIKGETVVRIDAFGQNTRSNRGFNHAKAPSVGQIGRPHLQQGPAGVGFDHQSTFAPSRQAPAPVQAPRALSKKGGKIQISAPVLLAHAETGQNPLTRIATIDLATAARNEKERREMPAQPLASNYLAPGQGGKAPLSPNSLMKNPGSVKRKQIAKSTDQSVPSEPLLDPAEMVTATSSRLSPGVEELRRRSPRHAPEGTLSPSGVTSPQVPTKSIRRSQHALSALTASDLKTRPSSTLPLTPPPKSPKRAQPPLSPFGRTTSLEAQAPALPGQRGSVKVVIKPTPNAEKLASPAVPPKDFTVASVQPMNGLPRNPRTAAAKPITAQQKTPKPQTVMLLKNIEYDDPAAVREIVNGAGKQPTTKRVVSVVHRPRPIPRQSAMDRQIFPAEGSPSPKHSHKRSLSGGSGISRKSILQSVPTSPSKLPPLPPVPQTAGQPGRPLPNDTRSMTFDEKMDIFYSNTGDQPAKEMRRRSSSVPELPELPAAFRERSRSRSQSGDALRDSTHHTDKSSRSSIRTASLLDFPEVPVQRTKVAPVSKFSVDTTVGEGMMWATTTKARLEGIKRQSSPVLPIEALKSPSNGSELKSHDDDTTTLWGSIHSPVKSTMIQKASAIEVPPVPKIGKCPEADTTGLDEIFKVKPANAKTDESHMMMTVVLDTSDQASPVANQGVSADLNRVLEADSRPVSWHRRIGDECPMFSGRQDSIKRRKNPPPAPLPLTRTADRRPRLVQAPEASPLEAPEKALEAIQEQLRKFEDPNRESTGSQQLQRMTLLANLEAEMGMHENQWQQMQSRLDRDSFSTTAGSPRKRESRPDSLAVSIVAQADDRSQRPERRTSRSSKSLSQNKMTFSDASSYSTYSVENEHEWDEDLAEAQAEYLKHRFQLVSHLSEETTSMLVFSPKETAHVTQPARQTSQRNDEVALMAVGHASSPKLWQHSNGATATLPNSTPSLWSGSGSAAVVDMTFHPEGQPEPLRRNLSRVIKPLTIESNRLWMKKQKRGSFGPQKGLWASTRIARPMSTTSIPDSNPQTPSTPSKTLARKPSRRSKRVTLLPDILENPEPMPDKRGTLAIYQFPWGEKSDSASIRPRPQIFMAMPGTMTSGRSSQQAQQAVPQLTNPFAFDAENYSASFFDDEDEGDNFPESQALSDEEDRYDDDDEDSDDFDETTLWEIASLLKSNQVPSRESLLPEDWRHTDEPGQIDYSEPVKVSHDDRSRSLSSQDMTPASAVTDSSESAQSSLWSSQQPPVSSQDIVSMANPDEHIWENYEAAMPAAVRAPTRAAQPDSVESDSLWMAEPKVAIAVDATSLWQPKKAEPVVGGLWAQQPRAQQLSKGLADPTEDTWASYQVGSAGGVRASTRSSQPATIESTSLWQPMESGAMMTGLWAHQVPVSTLPKGLANPSQDVWTSYNVGLIGATRAPTRPSQASTIESTAMWKVGPTIEEPATSGLWATKSSKSSTQLWSAPPSNDSTPTAGLAQPSTPSWMNYTTTSLSPVRAKPRLENVAGPVAGLSSSALWDNDHPSPVRDDWITLSTVRARSPSTSSVESAASDASSVKSNTTKASTVASIFSSFWRRKRGVSDAKSDDSVPEVPEVPSLPAVAEKQEAAPVAPKDVSLPIQTAPTVPLRRQYRPNIAFRVDWDAALQEAIDASKPRPSKRQRPTATPVEWAAALAAAIPRPSTVIKPSEPSVTQLWTSTPLKSPLPTTTSLWASHLTRAPRAAFPADCSMLPNPSRRGRSGSVLQQDGSSATMDTELQVPQGLTKQSLWRRSVAMEKAEVRTRDWLATESN

SEQ ID NO: 3980 - protein, 599 aa, Unknown
  Kingdom: Fungi, Phylum: Ascomycota
MARSRRPQRIVDSDDESQHSPKDDSPASSSSENGDEDSESDDDEPQNGLVDLEAADDDDAESSEGSDDSSLDGSDSTFHQFTQLPPELRNKVWEFFCPELTAPIRLLRIGLEFAYDVLDNEAKGYFFDGPYLDSMTETFRCLSSIHRESRQRALKLAPDELPLRGHAEDAVLRINSAKDIICLQHCHQLPVSQGSLHSYMPLGQQQCGGFVHNIAMETANFEKLNAILLLFPEVKVVYNISDEIRLNDRWLRWCVSDYAHKYFHERVEDIDPVPEVLPMLLCFPDIVKYKDFATYNLASLGHAGFDHMTREDVAAAEIEVQPMVSFAYASGLDRFEELEKLKAVPLPQLPQDEEPSDAEEEAMALDRDIEDEYESEGINDETILDDEYSSEDELIPRPISPGSGAESPITVDSGSEDEAAIANFSSIEPSEDEEQEEAPTTGKRKRRVVSDSDDEEEDAAAVQNPRTSATGPAKRRRVARTLQSDSETEDGDMRPSTAAQAVIEVSDDEDSSSDSSSAESEEVPSKPLSLAQRLRQQQPGRPISVDVSNSEDGSDRSEESSSDDESEDDRPRRGGAFFMDEASEDEDDDGDEDDESGME

SEQ ID NO: 3981 - protein, 852 aa, Unknown
  Kingdom: Fungi, Phylum: Ascomycota
MDLTSAPPSPPATLTPNGDHGNKPASAHNHASSARTDNDLSLSNSSHQPSQLSNFDQSLVSPSSVTNPQPYSTSPDRRPKKSSSTCTTCRARKVRCNGARDVCSNCQRLGFPCSYDDSDSAAWNVALPRRRVKQACQSCHSRKARCSGHEPTCDRCRAQGLECIYRPTKRARVSRSGASVGGGSQRESPESHDEHMEDIQNDSDPGLTDPGSTVTPTNYQQDVYVPKIQRLQRSTDISFSPGPHGSFDALIGSTFEKFFRHVHHIPMYSFLHRASLMEQYHAGKVDRPLLLALIGITSCLTDMGPGMREYGDRCIDEAERLVFADYARPSTIKIQALVFMIKHRILSHRFPSAFFLLSLASRYAASLRLNYESPNLCFLAQESRRRLMWSLFCIDAGVAGGFPDFALWNEESIHVSLPCNERNFEFDLPQPAEKLIPDTQSSPHAEDIGSLALHIRIQHIRKKVSEFTKGVLRTKDMHAARMQTRVLTLHQELDDFASQLPASFQFSEASLRLRAYSPRLCVYVMIHLWWRQCHLDLYRIGLAGLREALPRQVLENLPESFLEHCQRQCVDHATAITNIFSSTQKLHAKMAADLDLALCAYQAARILTYAYHTNAEKFDLSADTVLDRTGVCLQAIREYCTGKASHGIKSDLEKLVAQGIGSRGSSSSRGGSPAVQNGKIAGHARGNSTKNLLRSARGSNGHGANGQLGIASLPPSIVADPWSSDNQFSQPDPLQPIQDIQVHRGNGPSKAGPRNSSVPPPVAVPAAATDFPPTAPEQTQQSAASTMSQAPQGTLGPVGGQVTEFNNAYEGALEGLGLDNGLEYAMGVDMNMWVPGNGDWMTPEFVNGGASL

SEQ ID NO: 3982 - protein, 334 aa, Unknown
  Kingdom: Fungi, Phylum: Ascomycota
MADTVDAGAGGSLLETTKANAAAAYNSVTSGPVAQNVQDHAQKTGDEFSNLAASRRTPTNPAATGQPLTHYHSFFSELLSWKNPRASGIAYAGVVTLIFAVRYLDILRWGFKLASWTLFAAVVAEAAGKFVLNTGLTSQIRPRQYYTVSREALNSAIGDVHELINFFVIEAQRIVFVENVWASAAACVTAFLAYHLIKIVPYWGLTLIATTMAFFIPLVYTSNQELIDQHLKSASDVINAQTAQVQGVVQKQAEHVSSITKQYAGDYTGKVQEMLRGKGSNPAPTTETIGKQPEYVPKDTAFPTAPVDEPAADKLPEKIPEIPVVPEEEPLIAT

SEQ ID NO: 3983 - protein, 335 aa, Unknown
  Kingdom: Fungi, Phylum: Ascomycota
MERFRNLLGGGGMGLGGAAPGSDNTSLVDNSETVYISSLALLKMLRHGRAGVPMEVMGLMLGEFVDDFTIKVSDVFAMPQSGTGVSVEAVDPVFQTKMMDMLRQTGRPESVVGWYHSHPGFGCWLSSVDINTQQSFEQLNPRAVAVVVDPIQSVKGKVVIDAFRLINPQLLMMGQEPRQSTSNLGHLNKPSIQALIHGLNRHYYSIGIDYRKTALEENMLMNLHKHVWTEALEMDDFRNEGVKNKDRLEQLVNLADGYEKRVIEETELTKDQLKTRYVGKVDPKKHLEDVGQQIIEDNIVSVSRQMIDKEATVMTKKEQSNGQSKGEQMDVEEEL

SEQ ID NO: 3984 - protein, 369 aa, Unknown
  Kingdom: Fungi, Phylum: Ascomycota
MSFTEIPLLDLSLADDPATKPEFLKQLRHALLEVGFLYLKNVGVPDELFQKVIKEGIAFFDLPMEEKLKIEMKNAPSFLGYSQLSAEITAGAVDHREQIDLSTEHPIPKPSDPISHNLLAPNQWPSESALPGFRAAYTDYMTLMGAVSLRFTSLIAEAIELPAKAFEKYFDEDQQHKLKIIKYPDRGQLTGEGTSQGVGPHKDSMLTSYLLQASPHKGLQVQNVKGEWIDCPPIPGTLVVAIGQGMEALTQGVCVSTTHRVLSPAAGAGPRFSIPFFQGVKLDAEFDDLESVGVGTVPEEVKEQRRKVVERTGGRLDDVEFTFRAAGASKTLGEATLRNRVKSHPDVGERWYPDILRSIREEQQRVAAR

SEQ ID NO: 3985 - protein, 103 aa, Unknown
  Kingdom: Fungi, Phylum: Ascomycota
MSEAQIAGGHKANLNNPNSSEEAKQHSREVLENEFNSGDGMISLQIYVHSGSSLMRSTVPSAQDIKDKNPNNVAGGLKATVNNTNVSEEAKQSAKERLQQMES

SEQ ID NO: 3986 - protein, 1108 aa, Unknown
  Kingdom: Fungi, Phylum: Ascomycota
MGNTPSQEAPRATSRKLSKPRVTGRDRPRDRVNASAPASELTVHHVKAAQFSNSYLVGTVPIPASQRTSIDVASPGPAQAVFHDHFSDPARTDLSSGLSDPKSPRQGSFKDSLRAERTERRRSAGPGHGLTNVAPSQTPYRQERNSVPGIARTSSVHTTKTQPDSRNVPSITEEPMPRSQSLVERRASIHSRSNSRGGESQDAACNLRRNSTTPQPEMPPPHRTQSETSLYPPHRRRSLVMTPGVATRAEVPKKLRRKASFRRSLEPTPSVSRENSVDSKASRHLSLPVLPSDLQNRAPTPSEADFKQLGGMMFGTLRITNGAPAPSPGQETDESALYTSKTVVMDDTVPSEQTSSQTMLRDEPGLHLKTRRAQPHLVLQSPPQRSPRSMTGYSSAVTQASPRSPHSPSLRQLPVTVRPPTPELQTTSKHAAVDDHLFEEEEEEEDGSPRAESMEPVTQVVEVARELDVGMKSPTRPSLVHVTRKDSGYVSNTSKSSRKTLSTVDSGYSSNVSVRSIQQKRAMAEGSGDYLTSASHSSDSTDSSPLGDASSNGTRSLRSEDIPSPPEEGLQPSVSSKDDASVSTPRTSTSSTAHSIIRLPSLRSGKSREQKPLRHSPSQDRPRSAGNLLQSFSSPSRVSSPSVPRMSGLRRLLSGGSRKGLATSYAVHEIDGSVPSVPLAAEQKLQGHNDRFPTAPKRLALRVEQSHDSLGTIISMDDTSEAGVGEKETTSHLPPQAAPEPQRQTEPSQSAQPERRKSARLSISSVSGSITAATSMLSPKSSANPRNVIRRRSTMDDQIPTRSNSRRTLRGPDVDPDSDDEVIFDGSVIDHRDFMLPSMRRSIGNSTFDQARLGLGDQGRYPTPDNNNWMNQPYVDPRATRRQPQLRNRKSCPDVRATMAGHLSPVFERDSVMASKTPPPISLQTRGSKKRRGGSNRRKSSTAGVPHYPRPASRDPYDSGSSAQSSAEDLGHHGGIAPMSASGPYPRAAPLTQPGPYPSQQRAAPQPQMKRPLFGQRFSYDGHGYQPPSMQHQKSSLAPMPSREQSKDHWMPNRHLKERDPSPGSRGSYDQSQDPRPSSSRTSGEGNPPFRVLHSYNSPAYKGIPIWG

SEQ ID NO: 3987 - protein, 290 aa, Unknown
  Kingdom: Fungi, Phylum: Ascomycota
MLEPIATKNALIQGHRIAYGIFGPDDGQPLILIHGTPSSSLIFRNVLPHLTSHNFKVYLYDLLGFGVSERPFSSDVDTSMTGQVPILTTLMDEVWGLKSAHIVAHDIGGGIAQRLAAFEPQRIRTLTLIDCVAYDSYPSPRTREQMKNGLENLIKTDDETHRSHFHEWLRDAVHHKDRFESSSLPTFLSYISGPIGQPSLFNHQVRHYDPKHTLEIVDKLGEIGRSMPVRIIWGKEDRWQVEAWGRKLADAIDGAELTMLEECGHFSPEDQPQKIGELVIEFIERRGPQS

SEQ ID NO: 3988 - protein, 753 aa, Unknown
  Kingdom: Fungi, Phylum: Ascomycota
MAVGNFSKNNPGALGELQQNQQEAAPRSPRKTKGEIAAHERGRSQSPIKSSRFPLPSDVKSKAKSRDNSPIKQKKSGGGLAGLLSRPKSLRNLYKLSTEEVQQVKDKENKEPQSAGPPPPIYAQFASDQSWQQRVPDRSSVEAVRSPEMAPPLTRPGFKERPKSFQVPMMSNNSSATSLSPSKTSSEQQSRKNSSEKATSKSQRGRMMNALGNFTQKKTKSEAPSPVTTPVEQSLDPKDIDKHLEAMLDRRNIPENQRYKMRNLNDTIKMEFIRQDWAEMQAAKAERPGTNDSFKSVDDMAVGSDAEDDKDKPKRTRGRSFTFSRGKKENSSTKKSKGEGTLGRHFRSRSTDSVGSERPTSSGGSSSTNGILSKIKLQQGPAEYVGYLRKVQKPELVEVGKLHKLRLLLRNETVAWIEDFIQQGGMREIVGLLERIMEVEWREEHEDALLHENLLCLKALSTTARGMQYLDTIQGTLFPKLLGMLFDPERKGPSEFTTRNIITSILFAYIQSAPISDRTTRAQRVLTYLRDPEPKDDERPLPWLMEMRQERPYRVWSKEIVSVTKEVFWIFLHNLNVVALPSDKGYTANATGSALDTNNTQTNYMVQNFPNERPPVPAAPYVGGVEWDATNYLASHLDLLNAILACTSSQDQRNRLRGEFRISGIERCMGGSLRLCKEKFYGSVHDGLRTWVAAAAADEWPIKDVRYGPPPEARSPKKMGGGAQKKVENAPKIEIPKLDLGLDKGQPTRDAWL

SEQ ID NO: 3989 - protein, 2533 aa, Unknown
  Kingdom: Fungi, Phylum: Ascomycota
MIQLTVPPGVASGAPISAKQLIATEMSKRAGCTERQIHICGQSLSSFFRNDWHQVNVGITVWKKSAGLSIAASVVYSLIHSRRQHGHQVHSIPPPSCIINPAFLTQRTLHATDNVGTTAFIAASYRIEALNIVPQPTSDGFHPQSPSPTTARLICRYYELDWILMIAPDLPAKTSSPRSTASLPPAADAQDGSRDSRPRSRTPSSPAFSTASTADGQEDVGSSPALPPLPAPALPDRVRGLLRTPPPSGGGDEHRYGTASWGSPYPRTDRNLRRLSFSSEASDESPIHQLEIDTPYLRAAPEVEETDAGPGLSSSLTGAAAVLANRVRRQTTGLTEDWIRTHTSSDLNESKHWFSSGSESEHSSLSGSESAWHEESNTQTPRAGHQLKSASRRKTRYPRGGSSVETLKPEESSSHHPVTQSNMASPERGAMLPDGASEHSQITPSEELPPVPQSPMMVPSDAPQVPSTPTRGSQKPLPKEPAMTPRLKKKVPWRGKNIQILLPRDDERGQPGQPKRPLRQEEIDRMFASWQELGYGVDGFDLLVEGYQPQGTDDSQSRDTWPNMDDITRERAQRTYKVTLPDLNAWKNYVNELQEAKLRALGVFTAEDDPEPEPEPEQLVSPPLSGPSRGVSAQYPPLPFSPPIPTSSAASNGGMPGYPFPQQFMSGSSAAQSPGIPGGASPSPFGPPGKYNPRQSISFPASHSPFQANPDWINQNAFMPGLNRGDSPSLLNMSGLMSPQSPFGIDGLQQAGSPGINMHQRHQSLQYPMLQHQFQHQPAARASPRLQEVREDEEDTADAKSPSKTPEPQQRNPDSLQAEIDDAEYHLEEQLRTQLEHSDYNPQAQSENNGENQAAPVNHERESSATTFPAPEHFANKPSEPLVLHHPRPHSRGHSLTQNMYKESQETGEADTNGKPFTALNDIPETQKGDEAYEIDTNPSNLGTPVQSFDFAQALGHQKNMSTTSNPWNDAAPSASNGGSRRPSHGSKPSLSKLNVKAPEFKFNPANTFTPGQQFTFGGNSFQPAIFQASAEAQPEIPPVANNVMQFGSTPKYSGEAPAFSPGQSDFSFSTSGPKFRPDAPAFTPFQSLSGSVTSPTVSGSESVGNRSSIFGNIDIKANDIVKPVKKSKAIPIIRPSSRSSAKSIKINTTDDEVQDDVGGRVTIDESRVKRARSSAPDGDEVPAFAEQPPLDDKAMPENLDLEDGEINEDGEDELENLPVDTSLSSIVTSDQHADTKETTAAPSETSPAGNTAKRWAPFEFDNKLEASNFNQSRQFDDDIFKPTHKKSLSATAPAFTPTSSIFSPNAATFVPRQSLETNELKEEQDEEAKEEPVEVSPLSPEGPPLSEPIRQVSPPAPQPRVVSKGLGASRFASPPPKPKGLAASRFASEPSPPAKQDSASPPPAQADESVNFDEFLVEDSKLDAQPDDMLPSVEHDLDEAQIHSPTFEEIDDIMLHLGTDPSRGVNKTKEEPPKWVQPEPEAEPSLTAVASTEPYKLDPPQHEPVPSRDTASSTPRPESIFPELAPQPATALEDPFVDPPLSPPSLEAGDLVDEVASPPVSDWEQAFSEDEQEKLQNRAQFFDHRVNEIVGNLLTSRLEPLEKTLLDISSGLALRPARASSTRRDMRSVSGEPQHSDADDEDEEPVLRRSMSPRRDRRMDQIRVAVMEGLAAQQRSTPVAAAATISEDPVAESAVLKALAEMKDHLGENLRLDFRGEDLKNIVEDAVERRMPESPKPDIEMAEKVNELSAKLIDMEERLQLEREKVEKEVTERRAAEDVSAELNRKLQAAETRVEVEIINRSVFDQRVTDLEERLRNQEAKTEQELESRRIAEDRLSEIQRLLRIATEEENRLREVVEEREIKIKTLEHASGENSAQMALLEASQANAMQSQSEMTNTINALETDLRVIRQDNHHWRSEAERADDNARRGAAELAQVVDENRHMQKSLSTLTTQLEENERLRETWRSKFMSLQDDMANAAREIAEETASRIKKDQAMLARQEVLDARLQAEAKTRERLEVEMERLQMNERSGMRAVNECKRLEGLLGEMKSENHRLSETAAQHRRDYEEARESGASEVKRVRMALQVEIDSANHQVNVIREELEEQNNKLRAELDNFKLEADTARAKNDMLLEDAQTSKATELEELKEKHQNELENLQARLEHQLGTAVDEGQKTESHLLERLSFSASKMEHLQDRIVHLEEKLEVAKEAAAAAAQAAKSAGVEPGHAATIAAKPRANSQKLDVPEKISPQALRESIMVLQEQLQAREQRIEELESNISRLDPEAPTKISKRDDEISWLRELLAVRHGDLQDIIAALSSDHFNRERVKDAAIRLKANLQMEEQERERALNGGSALNLPSLVQSATPRVAQAVGPLAAAWGSWRKGSSGSFSSLSAALNSPAPGRNATPSKSSPVMRNGSLGGLMTPPASGLRQSPLADDQPQPTAFASTGRRFPSGSSRSRLDSNSSRARVDSHGSTRRAEKMPAQDVTPPRHQQHDEVDEAGPVTPPMMRQSGYDSDAQPGDFDDHDFFED

SEQ ID NO: 3990 - protein, 540 aa, Unknown
  Kingdom: Fungi, Phylum: Ascomycota
MSSIESLYVCEAIPGKGRGLVAATNILAGTRIFAESPLIKLPRGTNNKDLSRKKIITQLSALPQGQQQAYLSLSNVHGKEDGKELGIARTNAFPLGSNAREGAVFLEASRINHACKPNAQNTWNESIQKLTIYAARDIQQGEEITVQYLAQVSKRSVRLSKLRETFRFACRCDLCSVDEEKRIISDRQLEEIQRLEDRIGDGVAILHQPLSVLHDVKKLLALIKDEGCSSASEASAYYDGFQVAVMHSDLARARELAKRSSIARAVVEGHDSPQVKRLDGLVVDPSKHASYGLTRNWKTAVESSPKGVSEEEFENWLWRMSTDQPRQLADFRNDGKFPSFDYLPWDNDIDLEFYSAANGLQYIPNKHWCFLAEITDMDNFTRLNLALKDRAGQTTRLMFYTDSRGQEVPPSLLRKGYTIAVLYAEQHGFLDSSVGIRHEDPRFLKIFPISLEKLLKLSDRVQLHTSTGESGITCHTCGQKPNNLRKCARCSLFWYCNKDCQTTGWVGKGHKEDCKLLKDSDLQGLFRLDWGNFHDHHIFN

SEQ ID NO: 3991 - protein, 864 aa, Unknown
  Kingdom: Fungi, Phylum: Ascomycota
MATENDPKKLSDALLSFALEGQFPEDIASLPAVSETDLEPAIQALEQAKQDLEAEIHIINEETKDDVGSWVRNAKSLQEDIIRSKTIANDIVREAEAPDVSGEALEDAEAKAEFLNREVQYSSQLHAVLKRIQHANNLLNEVETACSEARILDSLHLLEQSWEALDRVEVDKSTRVLKVLNSRSFALKSRIHETFDRAWKEMLVFDVEAGQAIIRGSIPNVQMGLADAAIGLKAYKEVDERMEQLWRNLDAAIILPRMGGDRDTIPSIQVEGDSLRLAGQASDGIKPLLSDLGLALEMIAERLPESLLEPLSRWMLPDLVQRLIQEWLDPAVPSSLNNMEGFQEMIEDVGTFCSKLVNLGYTKTDALEQWVKNAPMVWLGKCRETALDNIRTSLAKGIGESRPVEKIEKQMVSVAEGNELATTGAGASADTNDWGAEWGAEWDDNEDAMDTKMDDDDTPAKRETSKGADEDDGADAWGWGDEDDSRATDKFSNDREGEANAAEEDGSAAAWGWGDEDQTMQEPQAKKSPAKLRRNTAPSAPEQTRELVLKETYHISSMPDPVMELISRIFEDGATLTRGEDRYSHVTNTAPGLFSLPTFSLALFRAISPHYYPVDEGGSMYLYNDAVYLADSLASFSEKWKQREDLTDRAKSLLRMDTDIKSLRSFANRSYSNGMNLQKTVLRDFLGGAQSLMQHDESGAAIESAIARIRSVAATWEPILARSVWSQAIGSLAEVLATKLITDVLEMSSIGQDEAYSVASLISTATSLDDLFLPSRLSGISATEGEDEVPATAQYAPSWLRLKYLSEVLQSNLNEVKFLWVESELSLYFTVGEVVDLIEASFELNPRTREVIREIRSKPKPMET

SEQ ID NO: 3992 - protein, 768 aa, Unknown
  Kingdom: Fungi, Phylum: Ascomycota
MVPATAFGAGLVAVALQLYLTTVRAAPETTLNVTAFTDTVESDWTAVYYSESNPLLIGNDGGAENGGLHVYDFDTKTPLPEVKSIPIGRTKVVTVAHNVGGKDLAITIAAPDSIIRVYELPEFKKVDEEFTLLGDWSAMCSWKSKSRNQYFYILGKGKAVQFLIRPDGDGVEILEIQTIELPFEPAGCAVSEAESLMFLHAEDTTEMHVFTLEESTVTPELSVAGEVLHDLTGVAVYHSSKGSKDLLVAAQTDTLAIYEASVDIDGALQGTIRLSGHDNIEVFGLSILQSSIDGFSEGALTFGMETDEREGYGIASLGGVFDDLSIESNTKYNPGAKQGCTKRSPICDACGNNGYCLKDKKASCNCFAGFAGPSCKQYTCRNDCNGNGKCIGANVCECDKGWGGIYCSFLVVEPSYETEANGGDGDDPAIWISEDKPEELSRVITTVKSEVGAGLGVFDLKGKLVQHLDAPQPNNVDMIYDFDMGDRKVDLAFAACRKDNTLCLFEMLPNGTLAEIPGGSQPTVDDYTVYGSCVYRSPMSGKQYLFVNEKSARYLQYELTAKDGSLETTLVRDFQGGNGGQVEGCVVDDENGWLFLGEEPSALWRYGAEPESDDAERVLVAEVGDGTLYGDVEGVTLVNGYTAKEGFIIVSCQGVSAYNIYRRAYPHDFVTTFTITESADGQIDAVTNTDGITAVGTALGPDYPYGILAVHDDTNQLPDGTTSPDASFKLVALDKILGADPLKKLGLLHEVNPDWDPRALIRSRRRDL

SEQ ID NO: 3993 - protein, 1307 aa, Unknown
  Kingdom: Fungi, Phylum: Ascomycota
MPRRKRSTPQRRQRGQNTVPIIPDEPDDLWHDINGILAERRRRGRTEYLVDWEPNAVTGQTYDPSWQVEVTSDALDEWKAKKTGDNFRSPFPSSDAPEAEPESQESQPPRPANWRNLKRSAAAQPSKRKRDSAADKSVATPQKRRRLDRAASPFDGPAPSITTASSAVSPSASPQPSQQTYALDEPVRPVAVVLEKHADFDPSDFHSVAGTNSQSAGFSSQSLSQLESQDAQIILSGTQQDSRQTVPDSQDLLESSVSQTRLSTAPLATQQPSLQVIADSQSDSQPLISGRPPSSAGRFETSAEPASQIPSGQGSLQHSGSNFNQLSTSTEPSRSATHVAEYQSQPPFTPFPDYLTTSGHLATETPSQIHLGESRPGQQTPINSQLSQAAQVTRASSESPASNGNYSSQSSQEARRSSPLGAGPPASAPRQSRGVPVSGALVSDPALAQRISSGNMDSSARPSKTSPRRSAEEELSKIFDLDAAGTPSGRPSVQAELDKVFTFDMDSADSVPDLTKTLGEDDLLEHPVAQGIVHPLSQSEVTIQSQPRIGAASSSLLDDQLSDLVAQPLIDPSDISGTLRADLPTEGLLPGTISPADILRAAEESGIVALTSLDDDPFQSAVEFDSSRQPPPMGQSGPGVDEATPTDSLVAKESRDELITLPFQASARDEYMSRLISCRSAIQQYSRHFDEDDTDEPAESLVGQIDDLFKALQNICDFPPDLIGTALEDLDDKGKTKYARDANGKFSFIFELLQGINVDTSALIVARSTELIRLLFSVTKALEINCVSEALEVRESAFQASTAVVRLALPSEQLSPDDFDIIIGFDNSLASSASLSTLGTPSSRVPLVLRLVTTHGIDHIDYKVARDIIPLERRQAILYAIVGGRNLVSDPERGQPEPHEIARAFCDYLNGDVSDPDWVPVPLPDALLMSYVGSQGQPTIPAATESELEKGTKRKLDAEDEEEAKRQKTAVELDLSTSNPDPPIPEEVLNMLDAINPGDEALAARPTTVAIHIVMLQLLAEQIVELERQQKSKDLDEATKAVIESQAKQLKSYERSYNKIYSKYRLALSDRQLFEKQTKEAQQKLQDTEKRAEKNAEKLEQRIATIEADKARLLGSEGGAEGQESPLAANEKLLKEAQEKVKVLEKRLVNAREESEYIRDQYRSAQSAAGETGQLRAQLKKAEEEAGRNKLRIHEINVSNSTRGYLSRISELETQLKERDAELDRAREELRASKNGRRETRQSSVPRSPRMGVLSPRAPARSYPSSTSRGGSPVPVGMDIGNVAGGSVHPGMQLLPQTPANGRWNQL

SEQ ID NO: 3994 - protein, 255 aa, Unknown
  Kingdom: Fungi, Phylum: Ascomycota
MAILPEIPGLEVCVKVEGEIVPDFEKEAENNDNTPVCEHPSGHFYVEAKSGARYRIFLELTPPFFDFIDEYLEDASLASIQCEAVVARQLGSIDVLFELGHARKSQSGRLPRSSTRALNDASNLEIPEEALKRLDVTHSTKLHSTAKVKKTKHDHFDPMVVLGRFIFAYRSREILESLSVIPQQALDRPRFADMSHDELVALAEKQWSASQDAEKDEALTKTPAVVKKENQPRVPAHETTSRRKRKRVEIDLTED

SEQ ID NO: 3995 - protein, 719 aa, Unknown
  Kingdom: Fungi, Phylum: Ascomycota
MATSQITAGAMAMGPVPIDGGTGGNAAETPIEPLQNRAKESKSPFIASAANSAVAWQLLDNATVERARRENKLLFLHIGYLACHHCYLMASDSFGHQACAPILNESFIPVLIDREQRPDIDNLYMNYVQGVSGAGGWPLNIFVTAEMEPVFGGTYFPGPGSSQPSNDDNEESVTDFQTVLKKVRDAWLDQESRCRKEASESLAQLQDFAAEGTLGTRSITGAQSLGAVSAAPSTVLPPTTENKEKLAISSELDLDQLEEAYRNIAGTFDPLFGGFGLAPKFPTPPKLKFLLSLKSSPSDVQDVVGEAECQHAQHIALDTLRKIRDGAMRDHIGGNGFARFSVTPDWSIPNFERLLADNALLLSIYLDAWTAGGAESSGEFYQVVVELAQYLTSAPIALSDGGFAASEAADSLEKRGDRTSREGAYYTWTRREFESVFSSSDNQASEAVAAYFGILEDGNVDQDHDPNDDFINQNILRIAKPADDVSKQYNVPLEKLNESIATARKLMQEKIVKDRPRPQLDDKVVTGWNGLAISALARTASALKTVNGVLSTACGDAASKAASFLKANLWDSEKKSLYRIWRGDKETEAFGDDYAYLVQGLLDLYELNKDQSTLDFASELQKTQTSLFYDTDRGAFFSTTPAHQFSPLRLKDGMDTSLPSINAVSVSNLFRLSNLKNAEEQDRLAHETINAFEPEMLQYPWLYPGLLGGVVRARLGPSK

SEQ ID NO: 3996 - protein, 1052 aa, Unknown
  Kingdom: Fungi, Phylum: Ascomycota
MASTVDERKVPNRADSSSPIATNTPDVPHTNPDKSPESQNLSSLKPIVSDEPAYPKSNATPADPNALATRALEFLSTATPTTLSAVAVGFATVTYAVLGKLGLVLIGAFGGVVGFISWQARNPHVAKIVQGEKGLDVVERLLHNLGEKNKQCKTDAEDDESTLKTFDDFRPETKDALAGLVDATIRDYVKWWYSPIVPSDHSFPLACRKVLTTFLIGISNHLYRKRPADAFLDLLTNSSSMMIVFMSELASAFADLPPDSKMTAADAVYNYLAANPNSNLANLLNQKQQGAKFKMISEDMLGFLEQSSYNCSPARIFLREILANSVFEMMLQKCSKADYINAWIVYLLEDGEPDISQAIDVGMQTGRDAGSNVFADIDGNVGNVGLARPPQRSAHKKQLSRAEEEMDEAMEEMKRMNALIVKEQEARRKREASISEENRPLRISGESDAAEQGKTRTPGDESPTSGRSFDKSSARGNSNDGFSMSAKSEAVPTPATPLSTSEYPSPVASPLEKHHSHFTNFDQIVPQSQPNEEEEQKEEKAVAKKAPLTLHNASFTLHDDISGDTAKIRMKPTWDYLIQVEPSSTDHSGWMIVRRYSDFETLHEILRRIAQISGATAFTELHKELPLWKIHTRESLRGELERYLRDACWYQSLAESEGMRRFLEKSQGHTHTNSKSFGWDTVSKNMLEGLTTAPKGLMEGSKTLVGGVTGVFGNFPGLVKRPSLQSSESAPNVSRLSISTPPRMDSMRSPARSERASMDSQRSSVISTQPGKMAPMERRPSYQSQGEDMGEPRMGRHDRMESASVSGSARQSREHSRAPSGAPLRSPSTLSLLDQLRLPPQPDEVGDDFEWSADGAEIHPKPLEKPIPSPAPSASAMKLPPKPARQHSQFTEPETRVAVELMFAVINEMYTLSSAWNIRRTLLTAAKSFLLRPGNPSLLNVQNLIQDSIIDGNTSDAAIAAQLRKLRENTMPTEQERAAWPAEATDEEKEKLRVKARALIIRSGVPAALMGVMGQAATGEALGRVFDCLQIEEVARGLFFGLMLQAVRIVTH

SEQ ID NO: 3997 - protein, 151 aa, Unknown
  Kingdom: Fungi, Phylum: Ascomycota
MASLVPPFTAETAQKKVKLAQDLWNTKDPEKIKNAYTTDSIWRNRDMFVTGHDEIVQLLGNKWTKEEHYRLRKELFCFTDNKIAVQFWYEYRHWQTKQWRRCYGLEDWTFDQDGKMRKRQMSGNEISISEEERWFKDGVDVNSVEIGEAHW

SEQ ID NO: 3998 - protein, 790 aa, Unknown
  Kingdom: Fungi, Phylum: Ascomycota
MKFNIDELPVLFPYPKIYPEQYAYMCDLKKTLDAGGHCVLEMPSGTGKTVSLLSLIVAYQQYMPVKRKLIYCSRTMSEIEKALVELQALMKYRAEELGYEEDFRGLGLTSRKNLCLHPSVKREKSGSVVDARCRSLTAGFVKEKKERGENVDLCVYHDNLDLLEPHNLIPNGVWSFESLLRYGEEHKQCPYFTARRMMQYCNVVIFSYHYLLDPKIAERVTKDFSKDCIIVFDEAHNIDNVCIESLSTDITEESLRKATRGAQNLERKISEMRDTDQEQLQNEYQKLVQGLRDADDARQEDAFMSNPALPEDLLKEAVPGNIRRAEHFVAFLKRFIEYLKTRMKVRQVISETPPSFLSHLKEHTFIEKKPLRFCAERLTSLVRTLELTNIEDYQPLQEVATFATLVATYEKGFLLILEPYESDTAEVPNPVLHFTCLDAAIAIRPVFERFYSVIITSGTISPLEIYPKMLDFSTVIQESYSMTLARKSFLPMIVTRGSDQSSISSGFQVRNEPSVVRNYGNLLTEFAKITPDGLVVFFPSYLYMESIISMWQGMGILDEVWKYKLILVETPDAQETSLALETYRTACCNGRGAILLCVARGKVSEGIDFDHQYGRAVLCIGVPFQYTESRILKARLEFLRETYRIKENDFLSFDAMRHAAQCLGRVLRGKDDYGIMVLADRRFQKKRTQLPKWINQALLDADTNLSTDMAVSSARRFLRTMAQPFRDKDQEGISTWGYDDLLQHKEKVDMERIRELEEEGANMAQARKKGYEDDEFEDENIDQDMMDMGY

SEQ ID NO: 3999 - protein, 439 aa, Unknown
  Kingdom: Fungi, Phylum: Ascomycota
MPPAQVEELDPDVAMTQGEEDDQTERLINEEYKTWKKNSPFLYDMILGTALTWPTLTVQWFPDVKEPEGKNYKVHRLLLGTHTSDESTNFLQIADVQIPKSVAPNPDNYDEDRGEIGGYGDSGEVAAIRCDIVHKIEHPGEVNKARYQPQNPDIIATFCVDGKLLIFDRTKHGLQPSSLGKVNAQIELVGHKAEGFGLAWNPHEEGCLASGSEDKTMRLWDLKTLESELRVLKPSRTYTHHTQIVNDVQYHNMSKNFIGSVSDDQTLQIVDVRQSDLDKAAVKAVGGHLDAINALAFNPTSEVLVATASADKTIGIWDLRNVKEKVHTLEGHNDAVTSLSWHPTEAGILGSASYDRRIIFWDMSRIGEEQLPDDQDDGPPELLFMHGGHTNHLADFSWNPNEPWLVASAAEDNLLQIWKVADSIVGKDDGDLPVDELDR

SEQ ID NO: 4000 - protein, 129 aa, Unknown
  Kingdom: Fungi, Phylum: Ascomycota
MTYLLLWLSAFLFFLVTALFVTRAHWLHLLPSTSSLPGADFVYSRLPSTFAGDIEAGLSSNTFDLSGNVEDGDSRAGLDDASKKAILKIMKKRRMNFDQARKKYMEERFSANGIGADGMPRDPKFVSFS

SEQ ID NO: 4001 - protein, 513 aa, Unknown
  Kingdom: Fungi, Phylum: Ascomycota
MASNRLAWLKGWMRPSPSLVLFIGFIPVIAFFRNNVADLAAVNGESMYPFLNDNKDQSLKRDWFLNWKWGVEKNLERGMVVTFRSPYNPDGWAVKRIIGLEGDIIRTKKGYPFAEERVPQGHIWSCAQSAGDKEHPVGEEVRYAGGGLEGLLERFHRGRISDHTMSSDDVESEGRPSIVHAMLAGGMGGSTGDLLMHSLDTVKTRQQGDPHIPSKYTSLGQSYNTIWKQEGFRRGLYGGWVPALGGSFPGTMLFFGTYEWSKRVLIDHGVQQHISYLAAGLLGDFAASIVYVPSEVLKTRMQLQGRYNNPHFKSGYNYRGTADAFRTIIQTEGTAALFHGYKATLYRDLPFSALQFMFWEQFHAWARVYKNSREIGSPLELLTGGAAGGLAGVITCPLDVVKTRLQTQVNVPVSEFAAAAASHAKDPNPQKRQISTSSPSTHRPKPGAIALETSSVITGLKVIYRTEGIAGWFRGVGPRGLWTFVQSGCMLFLYQQLLRQLEVRMPTKAREEL

SEQ ID NO: 4002 - protein, 768 aa, Unknown
  Kingdom: Fungi, Phylum: Ascomycota
MYEDGWYSLIPDQQPRSVSNNSQSRGHRRKESLLQQPNGISHAADVVEPLENVYEDVEQDTGPPEPELLRRAASYSDFYHVVRAQLHKDNRRRRRISKKDRTWDALLLNDKADEARFATQKATAHTQISQVELLDASQQEYMLYRDQLALTERHLDGLIDDANSTLHLLTSLADSFKAVEAQTSSFQSQCENLLAEQRRLEQLANDVGTDLQYYEYLDNATRRLNAPGASRMVDDESFGDMIDNIDACIVFMNDHEHYRDRDTYLARFNALLTKALHLLDHGFTTKLNKISSDIGRQVSVNHSESARHALAYGRFEELMMNSYHLIPNIHKTVRRAFDQYGRPVEKPSDTTPTYAISASNIFHAWFTTRDRDLKPMTQKDVEDFQKEVKSLSVETACRNFIKQSFERLYNEDGLFMKIFSIEPLWSQDPETVYQKLKAINTTMAHPGNISPLATNLQTTLQPSDLTTICAVVGWLASEYSMPDNDDDESPFQAKSREYAARLLVEHLWPFTDTAFEAEITKSISRAVAQDGDLKIGPVEGGVSSSNAFPLVKRAMELLVMFDQSMPKDRSSQNSSVVFSIVRETIQVLQRAETRLKAIKTETDPNLFMIKNLLIVKNELVSLEIGDIRSQAASMQHFSQIWDTLSPQNWVGFIGNIIGGSLWSRVGGSQPPAVTAKTLTVEDMNEQLDELLRQSIYAFTKHWGTLITDSRARKTGVKPIAKVEAQLESILETAFSNQQEVKAKLKEAIEMNAQAQADAQDGKQGAKRY

SEQ ID NO: 4003 - protein, 274 aa, Unknown
  Kingdom: Fungi, Phylum: Ascomycota
MAAQTHSHEGGASHSHAFNAQEHGHSHEILDGPGSFLGREMPIVEGRDWSERAFTIGIGGPVGSGKTALMLALCLELRSRFSLAAVTNDIFTREDAEFLTRNLALPPSRIKAIETGGCPHAAVREDISQNLAALEDLHTKFSTDLLLIESGGDNLAANYSRELADFIIYVIDVSGGDKIPRKGGPGITQSDLLVVNKTDLAQAVGADLGVMERDARKMREGGPTVFAQVKGGVGVDHIVNLITSAWKASGAEEERRGQGGPRPTEGLEELEKQS

SEQ ID NO: 4004 - protein, 654 aa, Unknown
  Kingdom: Fungi, Phylum: Ascomycota
MRSSTWAALIGGLASASALKIDSIARLEDSKSVERGHCGSLDPCQYAAPGSYVPDPKTFFLPHVHNKKENHWGLCKNNAYCDEYDVFSKVKFDFKGDALVFDFNIPGAHYEEVDIKIQRQSPPGEYSPSFNLWTGHCQPNHNGGLSCKLPYHALNCNGWQDMCPAGDEGGWIFYVQIKLVINLYGQKITLVSQAVDKHTGACWFSLSYCCTKCPDCHGPPRELPPTHCASCKKPDSHHQKPKPSGHKHHPQPCSHCQPEHHPQPCSHCQPEHHPHGPPYGPPHGPPRRPPHGPPHGPPHGPPHGPPHGPPHGPPHGPPRRPPHGPPHGPPHGPPHGPPHGPPHGPPHGPPHGPPHGPPHHPRSEQVKDSKQGADAVKKPAAVPAPKKPTVPAAGAKAPAAAPVPVAASLPVAAAVLGAAAAAQDLKKPVVPATGVKAPSAKPPVERSAPIKGNKANKVVVPQNNKQTGTHKHKGHEVDVACQSAQVVIFGQGSHSHHLKELGSYPGHEECRHREGHYHTYVKHDLEVTVAGALELNSNAFGSFVVEFDKENANTEIVIKIDVWNTYFYVVEAAVFIDCKDSIEQGWGGRHGSHICRPETFPYWYVDEKGIGNYDFHIADEFKCRGDYVFALWVKVCIADDRKNCHYKHVPLNAA

SEQ ID NO: 4005 - protein, 282 aa, Unknown
  Kingdom: Fungi, Phylum: Ascomycota
MMTSDLRTEVPPPEGLQFLNLSTPTPSNDILLVRMNDPKTLNSLSSSRLRELDDVLSWYDREPTLRVLVITGTGRAFTAGADLREWRASLQDTTSGKKFGQREGVVPFTRRKGVKPVIAAVNGFALGGGCEFAVNCDLVIASSTAKFGLPEVHVGLAPTGGVLTRIVHTVGMQIASEIVLTGRHITAQEMHTWGIVNKVVLEGESVVIEALRYAEMIARGSPDAVVAARAGLRQAWETADVENATEDWLVTWLVKLEKGENMKEGLAAFTEKRAPRWRPAKL

SEQ ID NO: 4006 - protein, 516 aa, Unknown
  Kingdom: Fungi, Phylum: Ascomycota
MSTHHPPPPYTPDQLQSLYPPNLDLQLVQVLLRHGERTPVNARFANTGLGAFWPYCNSMKQLRSAVLNSDNTFGSLEWKRRLETFGGKDDGPVVATGPGGELDAVCDMGMLTDLGRKTTLNLGQRLRHLYVEQLRFLPPTIDNADSLYLRATPIPRALDSLQQTFQGLYPSSTRAPDFPPPTILSRTPGDETLFPNDGNCRRLAVLARAFAQRTADRWNGSEDLKYVTKKIGKHMPDEDAPVAVDGRPRLSGVMDTINATDAHGPATKLPREFYDERVRAIIDKIGVEEWYSGYRESREYRTLGIGGLLGDVVARMVGSAERTAADGAYEVLKQGQSAPIRFGMSGCHDTTLAGALTSLGAFENEKWPPFTSHIAIELFKQKTSQGEANATTPSAAAAAPVVEAKSWLSRIWGGAGDAGRAGIPPAGIGRKTVTELSEEEKRTLQGYFVRVRYNDRPMTIPGCRTPGNHLEGDESFCTLEAFKSIVDKFTPKDWKSECRANKDAPVFPTKPEPAGH

SEQ ID NO: 4007 - protein, 472 aa, Unknown
  Kingdom: Fungi, Phylum: Ascomycota
MSAIGHYRAKLNLFIAQQTSPHASFMKFARSYSSSPLGGSIPAKKLKYVPTSGTYPKGFLASGVIVGIKANNTTKPDLALLTSDRPCAAAAVFTTNKFQAAPVTFSRDVLRSNGNAGFRSVIVNSGCANAVTGTGGLEDAGRMAKTTDQKIGKDDSTLVMSTGVIGQRLPIQKIVDYIPVAYHEAGDSHKHWLTCAKAICTTDTFPKLMSRSFELPSSPGVEYRIAGMTKGAGMLAPNMATLLTILATDAPIAPKIMPSVVRYAADRSFNAITVDGDTSTNDTMALLANGAAGGKEVAEEGSPDYEAFKDVLTDFSADLAKYIVRDGEGATKFVTIKVEESLTEEAAREVARTIARSPLVKTALYGKDANWGRILCAAGYALISPPGQPVNDVPDIVPERTSVSFIPTDGSPELKLLINGEPEQVDEERASEILEMEDLEIMVRLGTGKKSAVHWTCDLSHDYVTINGDYRT

SEQ ID NO: 4008 - protein, 593 aa, Unknown
  Kingdom: Fungi, Phylum: Ascomycota
MGAVPPSTARLDELLEQVRGEFTSQMRQAEHLDQQINTQISEMQMVREKVYTMEQAHMTLKQKYEEEIAMLRHQLAEVRKGNPQAAMAGPPQHSASSQQQPPSIAPGNGLFSGIMGGSQGGLAPPQQQQQPAPQEQHMGPGHQMAQGPPGLPGPPPHPNAQGQPPYQQGYPQGPNGLGPQAPPSTASPGPRGRGVGRPPNAVGPATPQINNPMPYPGNAQSPQVSHPTPDHARMGGPRAPPPVGNNLGDLDVEALAPQYKKLGTDWHAVFNPQVQRVLDVDLVHTLVHESVVCCVRFSHDGKYVATGCNRSAQIFDVQTGEKVCVLEDHNAVEMSADLYIRSVCFSPDGRYLATGAEDKLIRVWDIQTRTIRNHFSGHEQDIYSLDFARDGRTIASGSGDRTVRLWDIEQGSNTLTLTIEDGVTTVAISPDTNYVAAGSLDKSVRVWDIHTGYLAERLEGADGHRDSVYSVAFSPNGKELVSGSLDRTIKMWELSGPRGDRSQAVPKGGKCIKTFEGHRDFVLSVALTPDAQWVLSGSKDRGVHFWDPRTGTTQVMLQGHKNSVISVAPSPAGGYFATGSGDMKARIWSYRPL

SEQ ID NO: 4009 - protein, 548 aa, Unknown
  Kingdom: Fungi, Phylum: Ascomycota
MAFPAKQMFVLACCRICEPIAFMSIFPYIYYMIEDFHITDDASKISVYAGMVTSAFTLAEFATGVMWGRLSDKIGRKPVLLIGLAGTALSVLIFGFAPSLPVALFARALGGLLNGNIGVLQTTVAELVTVKEHQPRAYTIMPMVWCIGSIIGPAIGGALARPCISYPELFAKGTVWDRFPYLLPNLFSAATVFIGVVVGLLFLEETHALKKDERDRGRELGDYLLSKLGAFRGCSPSSRNPEKQPLLSGSPERPHKSLSPMSDLDNSSEDESLPAYRSSENSPKLTPVDRNTNMAQNRPQSTGARPASRIFTKAVIMNIVSYGILAFHTMTFDQLFPVFLSTAPPKHPILDLPFRFVDGFGLDTKTIGVIMSVQGVYSLLSNYLVVAPVTRRLGSLRLFRILAFSYFALYLVTPYLVLLPESMRMGAIYILVIWKCTFATMAYPSNAILLANSAPSKQVLGTINGIAASTASLCRALGPAVSGLLYAWGLQTGYSGLAWWFSGFVSIIGAFLSSQITEGGGHFDQVPDAEDELSEEALLATFEEDESV

SEQ ID NO: 4010 - protein, 987 aa, Unknown
  Kingdom: Fungi, Phylum: Ascomycota
MSWDLLQRFLESDVFNSHPFLSVSYLSRYADHIGIHYVLCNKLRQFPYEDIEFFLPQLCHLIISVDNESMALEEFLLDLCEESVTAALLTFWLFQTYLHDLAANPATGAFQTCRRVYNKVQHIVFGLADTARHDKIKENILPVTVLSSFVLASVALPMIPQWAGPLAVAQARKPQPLTLTEPAMEVADVAKPPTRAKTVSATSSRSRRTKEGRISSAPDANNPDGTRPRTPRSAVPVTIVTKPRGSEAPPTRPSALELRSLEARLSSASLPLPSPRVSTRPSTPVSAGVGPRPGESIHRRHSHHHSKALMTPSDLSPLQKTRLLRQHYFRSQTAFLTALEGISNRLVVVPKPARLSALRAELALISQDLPAEVDIPVICPPTLVNGSPGKSQHHRIMRLNPAESTVLNSAEKVPYLMMVEVLRDDFTFDPETADNQRLLGRLMSEGENAKRLFDVTSDTPRLAAAQAQEARTPEPVADSVFEPISGDLGSSPMLKPFDDEPSTPRFSSKSQAASSMQRLSSGATTSSTTLDAATPRTSGQYTSRSSSPGPARKMTLTLPRTAAVDQPDFSALATHMRTASQMLAQLEANSGKRPKHEVAAIRAKIIASMQSLEEQSFETEDQGPTFDTIIAKTTSNTTVTSPNPDLEDDGPIDPAINASAGRERMENDFKTGGVQRRGDRDDPSAAVFGEAWEAKKERVRKSSPYGWMKNWDLVSVIVKTGADLRQEAFACQLIDVCHKIWVDAETDVWVKRMRILVTGESSGLIETITNGVSLHSLKRSLTLASIESGSNPRQRIATLRDHFIKAFGQPDSEPFKAGVDAFKKSLAAYSMISYILQLKDRHNGNVLIDSEGHIVHIDFGFMLSNSPGSVGFEAAPFKLTHEYVDVLGGLGSPDYDDYKQLCKQAFQALRRSADNIIDLVAMMGLDSKMPCFSVGVATVTTTLRQRFQLHLSADEAEQFVDDLVAKSFGSYYTRLYDTFQYRTQGIY

SEQ ID NO: 4011 - protein, 110 aa, Unknown
  Kingdom: Fungi, Phylum: Ascomycota
MAVTKSSTCCGKGNVECACAKQATCSCGKQSALNCNCAKASDENTVNGPRCSCRARPAGECTCERASAENGSVAGEKCACGSRPAGGCTCEKAADGGFNPANEIDFTTKA

SEQ ID NO: 4012 - protein, 425 aa, Unknown
  Kingdom: Fungi, Phylum: Ascomycota
MRSPAPGEVMDITNMLNNKGGMHHQQPLPGHLPLIKADPIMERSVSPHGSEHSHYSTHSLARSYSSQGLPGPLHMSGMPNGIPLPGYPDMHGMHGMSTMHMQAMPQQGHEQNSPPLTKAYACSTCGKGFARRSDLARHERIHSGDKPHFCDFKGCGKTFIQRSALTVHQRTHTGEKPHHCETCAKKFGDSSSLARHRRTHSGKRPYKCPFADCQKTFTRRTTLTRHQNHHTGTIEEAAVATAAALAASKHNKAIPRSEADHLSAHGSPMTTPSPGQRTMSMSPSVDLSGNGLVRHSQDFQYLQQSGSIPVHMRVGSPASTTSAGYTTMRPTSHPTGYGPPSILEPSLEQHQSGSGSANGSAAGSPHMSSVGWQSPAHMASPAHHGAHYAYPETDYPHHAAMGQMFYGAPTHMRRPQSAEPGMVHM

SEQ ID NO: 4013 - protein, 272 aa, Unknown
  Kingdom: Fungi, Phylum: Ascomycota
MFEQPNAKRVRRDELFQSDRSDESSGDEAMNSDLRARLNEQIAKSLGLVPEPETGRQTTSKDAKSARKSRKDSEEQPDTDDEHEDDREKSADEFEFQLFSTSAPTTKVVLEDEKLGDGAFVRKRPESYYLVTRIPEEQRLRYAFAAVTGDEVLECAKARSWGLELPWKVVHATHNGKLRALMEDSRTKDPSKGRGRPGKKKRIATRTKARAEAEKSKELNAKMAEKEEQIKDKKKRLNRAKKLRRRAKAKEQKGGGDGGGGEDDSVDSDGST

SEQ ID NO: 4014 - protein, 416 aa, Unknown
  Kingdom: Fungi, Phylum: Ascomycota
MLTRPLTSLASRRACWRGAQRAAFSSTAARHADFTHAVVGGGVVGLAIARRLAQRPDTTTLLIERHLSVGTETSSRNSEVIHAGIYYGPSSLKTQLCVRGKNLLYELCEKHSVGHRRTGKWIVAQNDAQREALEGIHSLCQKIGVDVRWLGDEEISRDGEGVRALKGALDSPTTGIVDSHGLMVCLRGLFEDAGGVVAVNSPVESVNPLGTGTPGNGGWEISVRDGSTGETSTITTETFINAAGLGSVDIHNSIVPPEKRTQLFYAKGNYFSYSASTPSISRLIYPAPEPGAGGLGTHLTLDLGGRIRFGPDVEWVDTPEDLAVNAGRMDLAVAEIQKYLPGVDASCLEPDYAGVRPKLGKRGAVTAGKGFQDFVIRKEDGYEGWINLLGIESPGLTSCLAIAERVDGLIYGNLKE

SEQ ID NO: 4015 - protein, 857 aa, Unknown
  Kingdom: Fungi, Phylum: Ascomycota
MVSRNTLLTLLLASPAVRGASKHPRSREELQHPEGKRHLQPLNIRQEPPPPVTVTVTVFPEECSEVPPVPVDPVDPVDPVDPVDPVDPVDPVDPVDPVDPVDPVDPVDPVDPVDPVDPVDPVDPVDPVDPVDPVDPVDPVDPVDPVDPVDPVDPVDPVDPVDPVDPVDPVEPVPPGTPTDPEDPEDPEEPECDAELLPGGVVKRSVPSRVIRKRGTWRRFLSRRQDGDGAACELGVEHIVYPKDGNNAVETGAIYTTMLTLVAPTGISAEEVPGLGVLFWRVVLTSKQAEKIKDTPGVAFIYVPCKDDCYDPTTEDIHRQPDAGDDLTVIGQFKGETLEWYQNNYVYHKKAGEGVTMYFLDSGANLEHKEFTEGSNIASRATWMHTNPDITDATKNDEFGAGKPGHGSCMLTRAAGHKYGVAKKIDPVIVRVPSFHFGMEYWMQGLKHILNDVGDGKRAVLLMALYWPRKTDGGDFVFKGIDGSDGYDTIRQKLGDLLRKLIEKGVTPVTGTGNIGLRSLDGLPATLADVNAEDQIKELIVAGAVNGKGDKKWLGSNYDDGKKLPHIYAPGDTVKCTKHKNEDPTSTEYRDSSGTSQAAAAVAGLAAYFLSLADLPQFQGLVDVSSPQKLKDYMIELSYPRGPNADLRVFFNGISRLDLGGLDATGPTCTIRKRQDGEDATLPDWEDCNGPEDDPQGPGEDPESPEEDPEDPEDTPEDPPTDAPGDPDPARSWTCEINQYGSTVIDDQCKCLSEECDPEAAEPADGCVIQIVSKDQWGCDDQCGGCAFEVPDVPEPGEGNDEWECHEYVSRSNDQCTCQRKECADDADPLECTVLMLKNQNGCDDFCGGCKPTDLLG

SEQ ID NO: 4016 - protein, 814 aa, Unknown
  Kingdom: Fungi, Phylum: Ascomycota
MAVQSKLRKTAAEDALAAFIDKWTDIIRRRIRTTSRTTRLLAVLALASSIILGAEGSRRWWKNRREEREQGRKLVRTNSWLYNKDGSRTIYVPYKDSTSKVVINTTKPLTFEAHRRLFLNPPRVSGLGDGVVPGAQTKPGLNLAFLHQFLSLMSIMIPRWSSKEAGLLLSHGVFLMLRTYLSLVVARLDGEIVRDLVAGNGKAFSWGLVKWCGLGGFASYTNAMIKFLESKVSIAFRTRLTRYIHDLYLNDNHNYYKLPTLDGGVGHGADQYITQDLTLFCASAASLYSSLGKPFVDLCVFNFQLYRSLGPLALSGLLSNYFLTASILRRLSPPFGKLKAVEGRKEGDFRSLHARLIANAEEVAFYGGADMEKTFLNKEFKSLKSWMEGIYMLKIRYNILEDFILKYSWSAYGYLLASLPVFLPAWGGIGGVAEMAGGGGKTGRERNRMKDFITNKRLMLSLADAGGRMMYSIKDLSELAGYTSRVYTLISTLHRVHADAYYLRSGQNELYSLSDVQGTIQKGFDGVRFEHVPVVAPSLWPQGGDELLESLSLIVHSGEHLLISGPNGVGKSAIARILAGLWPVYRGLVSRPKSTGQDGIMFLPQRPYLSPGTLRDQVIYPDGHHDMREKRRSEDDLKRVLEEAKLGYLPDREGGWDTRKEWKDVLSGGEKQRMGFARLLYHEPKYAIIDEGTSAVSSDVEGLLYETCKEKGITLITISTRASLKKYHTYNLVIGQGDSGEGWEFERIGTEREKMQVEKELQDLRERLAKVDEWKKRREEIDAELAAVWTDKGDVVDPPAYTQQPATGEVQQQS

SEQ ID NO: 4017 - protein, 388 aa, Unknown
  Kingdom: Fungi, Phylum: Ascomycota
MNLVEAAARGDLVAVTAQVAQGIDVNTQDANGRTPLSWAAGSGSEAIVEFLLSQSGVEPGLADTDGRTPFSWAAGNGCREVVQQLQRRGIKQDFENAAGRTPFPWPAGNWHQEDTRILLSSEEPADTQDKNGRTPLSWAAGNGHHLVVEDLLNGKKVRNDFADLDNRTPLSWAAGNGHDKVVRALLQIAGTYQYRGARIAADSRDSNGRTPLSWAARNGHDNVANILIIQVDINATDYEGLSPLLQAAKHGHSAVVECLLSGPDIKLNFADALGQTALHYAAKSDHIGVVTKLLTRREVSVDAKDIGGITPLRKAVQHNATQSIQSLLQSSASTEGILRDDWLDAFGEPSSYIVLLSEMPGGIRGINFIAEECLSTALSSSAQKRHLL

SEQ ID NO: 4018 - protein, 78 aa, Unknown
  Kingdom: Fungi, Phylum: Ascomycota
MALAKKAYPKATLKKIIKAHSNRNIKKGADVSIFLNYVLFMENLVKEAAIKSKQSGDRGLTARSVRKVTRDTLARFKG

SEQ ID NO: 4019 - protein, 447 aa, Unknown
  Kingdom: Fungi, Phylum: Ascomycota
MSARYDGTPVQPPSPYRQLPPREFDVRGQGVKRGVSPPSSQFTRLPSLSSWAHAGPQSPIITADPRLGDPRVDERAAHPYPYQTPQAPQAPHPHFQPVNPELNASRQTTALFDQGPPAGETIQPNMCFRGDSSSEIQHAEPRPRPIGRTTSRSSMAPPSYREYPSRPPSYYEAVPVSKERPMVSSSRPETHYKRQASSPAPQVQPSKKSREQTPTTMRPRVRTRDVVPNLLGPDKAHLIQNMKFTLQIRQQPQQARSCGFADKDRRAIDPPPIVELKIDGDGLSKEDLDVYMNYDRYVMCCTLLDERGVDAMNMEQDGLRSKRMMGENTVVPFVGADEHGHVGCFFSFNDLSCRTPGDYRLSFSVSALPTMEESRAGVRYPRMTDITSDVFKAYNAKLFPGMTESSALARALKEQGCNISVRKGNEKTKSSRVRNAPRDDDDEEEDF

SEQ ID NO: 4020 - protein, 1400 aa, Unknown
  Kingdom: Fungi, Phylum: Ascomycota
MRAPPGAFLNTPAIASRFQSTSDPTRRQLFQQPETRDARSGALVRTNSSSAQGHDGTVATSSTAQGSDSLVAQNSMPPPKPENIPPVVKAANAINTFLKTDESFPDLDSCCRQGASSDYELQNSDSAMAPFHKTQMYPIPNEILDNYNRGELQTLMGLFAEINHAWVVIDNSLYIWDYTRSDPQPLGFEEQSHTIHAVALMPPKPGIFQSKVTHVMALATSSEMILYGLSAKKGISGVMEVELYSTKMSLPLRGTDVRIITGSANGRIFFGGSNDIDINELYYQSEEKWFSNRCGKINHTNPGWASVVSLQSGFWSQKVPEHLVDIAIDDSRNLVYTLSSRSTIRTYHMEAPDRLTKVIEKEKMHCLRDIAHMITQSKLLNDRTRIVSISPISKQEASKLHLMALTDTGCRLFLSATNTSSIFYNPQSNLAPQSMQVQFIKFPPSEGGRPSGYGNSENVVDLESSLLYPSQKGMRFPPGYFLDFVAKGSNTNEDSLFIVGPESARIKNTPPTAPLKHYEHGSWIEIGSRAEAVGLITSSFAAASQPVGFGNELAVQFDEPTSEFAVLTNTGVHVIRRRRLVDIFASAMRSTAGDEGLEKVCRRFISLYGRVETVSTALAVACGHGGDVRPGAARAIDQTTEDHARSAFVDFGGQPTIAETDGTTLTTESVKLSSRHDALALYISRLIRKLWKVTVVKQVLDPTTKGIVIDSTIPLQGLAVRQEQLERLRKFLHANRAIIQGLSGPSDLQRASSRQEEVALQAEHQALHALQKLMESISEGISFVLMLFEERVTDIFMRLEATARQQLMDLTYEKLFSTPEGKDLAKLLVKAIVNKNIESGSNVETVADALRRRCGSFCSPDDVVIFKAQEQLKRASDQHLNANSSRMLLHESLRLFEKVAGSLTFANLHTAVAQFIELKYYAGAIQLCLVVAREKDRGNTALSWINDGKPNGDLRADAFSERKRCYDLIHDVLTHLDNASSREPEMVDGKYTLIATKRLEAYDVVNNSEDEVFHFDLYEWYIEQGFTDRILAIDSPHVTTFLQRLSTTNIEHADLLCRFYTNRSRFFDAAEVQAALAEGDFPIDLKQRINLLSRAKANANVQTLGVSRQKQQMLNHQVTELLEIAHIQDDLLERLLADDRLDPARKEEIKADLNGKIAGLSDLFNNYADQAGYYDLCLLIYHTADYRNPTTISSTWVNLIETIHAAVTSETESLPSGRGPPPLPYESVSSKVQNIAHRTSLDSFVFPIQTLLPELCRYAVAYEQDATIGADPTWPVQLFLSLGVSHDMIVRVLENVFDTQDYGFSGPVRNRMIELIVFVVRDWAAEVRRRGGGGGKGSGGMGMSVAELLQRCESALPAPGHGSNHGGAELAEVRRGLKALRREVAGLVERSPTGGSLGFM

SEQ ID NO: 4021 - protein, 181 aa, Unknown
  Kingdom: Fungi, Phylum: Ascomycota
MATQYEIEHNIKFTEPRRGRRVDMASFFSLLSQIAEPSSTSGDQHNNAHATPTPVDTAALFRLLQDQLQTLHSTSPDATNRGFLEELITSLEADIHDPPARLQGVSQEFVDALDRVDRKRLRKDDDCAICKVPYLEDEYCLVVELPCKGAHQFDLEQEMGKKKEVPVVEDDEESDGDMMYA

SEQ ID NO: 4022 - protein, 745 aa, Unknown
  Kingdom: Fungi, Phylum: Ascomycota
MESADAQAHPPGPGPTPAHPDPQRQTQGAATGDAAAPTPPVKRRGTVACRRCRRLRTKCIHEGVEPPCEACRLAGDKAAKECLFPRRGEKDVDRQFRRRPAPAAPSDSDGYAKSSPHAAGLSSPGIRPSEVGSRLISSLSSAPSLSRDEVLPPIDEVVEGCRIFVTSYFQLGFIPKAVFLEKLVRQPENVSSFLLCCILSISARFTPSLTKRYGGAREATDHFLEVSRLMVPSEMYKSSLERLQAFFLLSISQWGNGDRERSSIDMGVAVRMAALQRLHCEESYALESGSNAEDVVTKESARRVFWMIQSQENLHSGYKTPAPFPLEDITTLLPCNEKDFAFGTVPSDRAALAGTPPAIAQPQLADTPTRCLFATLIQAHSLWGAVSRKASRSDSSVNKIPPWDLKSEYQISAEELHRWEQHLPPEHTFSVWNLRGWKSESLDLAYLAVTMVLRLTNIVSRRLYLDDMLAILSPGPVTERFEPSTPTMANANEQSAGTSYPTPSSTAFDNHGAAPPGFWQNMSEELFTNVWQLHEQIDAFLSMRAPDEGFPQILVFCIYMCGSVSSYLWRYPSLCPKLADRAQVMAQRSLEALATLHAAWPTSATWAKGLQRIATPLPAASPVDAKSAPGPTAQNRTSTGGPAHGPAHTINAPASSSMTQHPGMQHILHQQHPHEGMHGELTNMIPNGASGEIAARFGGMQPGAMPGEVFDMELTAFMQGDFHFNPYEGIPQGGTTYMDNNDHSH

SEQ ID NO: 4023 - protein, 86 aa, Unknown
  Kingdom: Fungi, Phylum: Ascomycota
MTPTPNNDEDRQHDVRSGKKIVSLAMNNQGSGQDVCESRNSRDASPYLELRRQVALTVIKIDPQGKEEDGVQKCLEEKYAANPSVE

SEQ ID NO: 4024 - protein, 303 aa, Unknown
  Kingdom: Fungi, Phylum: Ascomycota
MAPNNKPKEPFWLGGAAASMAVCFTHPLDQTKYRMQVTKSQTTMLSAMYRSAANNGITSLWAGLSASIVRQSSYSTARFGGHTFLTERLLAYTGEKKLSVMSNIACAGASGGLAGIIGNPAEVVLVRMCADGAKPVGQRFLYSNVFEAFARTVKEEGLSAFSKGITANIARSVLMNVSQIATYTSAKQYLIGSLGLADDVKTHAASSLLAGTMATTICAPADVLKSRLQSSAGQSGLVGVLQLGVREEGLRFLMKGWLPAWLRLTPHTILTFVFMEQLRRLTTVGIPWLKADNVEEMKEAVLR

SEQ ID NO: 4025 - protein, 165 aa, Unknown
  Kingdom: Fungi, Phylum: Ascomycota
MIRSTSDPFLSSTFNFNIATDFRRTPDWREARHSLIQTARQTSQLECQTQSAMFGLLGPFRVTSPLSGGLLWKTPWRLSKFQKRRHRLRLRAVDSVVATVDAALAKKGETLEALERWKAEMPTEAEMLPKDKYTMFDRKAKRYRKGIHKLPKWTRVSQRLNPPGF

SEQ ID NO: 4026 - protein, 493 aa, Unknown
  Kingdom: Fungi, Phylum: Ascomycota
MNAIHDDTEKGQLLPEQSTTPQRPQRKVSPCRLLVAAAAAAATIYIFLPSLISLLSTGTCGHHNLSHASTVAQVQQCAIDNLKADTWFLDDAVPIKPEEFIERRDRMAEALAENGVDAFVLEPGYTFQYFGNTSQVDWEPWEPEERPFLMLILPQTSKSGKVTAKTAFLSPSFEEGRVRMLGIPSRDEELDIVVWEEHWNPYTTLLESRLFKHKSGAPVIMADEEMRDYIVRGLDNNGFKTVGLTPEAELVRQTKSSAEVELIRTVNTGTVQAVRAMRPCLVPELTEDEVTEILNNAMLSIGFQLFFNIVLFEEHGALPHGGFVTGGKKLTYDTMIVIDVGAHYLGYSSDICRSFLIDPPNEEYTTSDPLAEEKASVWQIVLDAQTAAAHAFKPNHSAASVDIAARTVIEDAGYGYGFIHRLGHGIGIKAHESPYLNKFNKESILSPGMTFTNEPGIYLEGKFGVRHEDIYLVTEDGEAELLSGPRAKGLREP

SEQ ID NO: 4027 - protein, 560 aa, Unknown
  Kingdom: Fungi, Phylum: Ascomycota
MRVLNVVKTVLPQALLAAARPSCGQLHNPVTLADYGTFSGTTVNTSFSGLPLPNHVDAWLGMDFGVTPERFSPAQWPEPFRGVKDGSKYGSICVQEITASYPEAEQSEDCLNFNVYRTPGVPLDQKLPVLVWIYGGAFFFGSYKSFDGASFAASSKDPMVVVTFNYRVSSLGFLPSKLFDEEGLSNLGIRDQRLMLEFVQKHIGSFGGDKDDLTLGGRSAGGHSVGIHYFHNYGSDAGSKPLFSRAIMQSGSVTSRAFPDVAYPLYQRQYAEYMAHIGCDNIDSNSETLDCLRSADLNDIRDISNKIFWENHPNVTWPFQPVQGGTLFEKTGTQSGIDRTFFHVPVISSTTSDEGKTYMPGNFETNDEFLGYMHNGSPALNDTDLELLESLYPDPATDNDPNSPFANSPNSTQYNRLSAAWSDYGYACPSQETSYRTSAAGVPTWKLRFNTNNRYPDWQGIPHASDTRYTWNDPAAQYPEISPIYHGYLSSFVTTGDPNTNRHPGSPEWLIYEPEGYELDKKPGRQLVVQPGDTKMEDDDIRRAACLYWRDPERAPRLSK

SEQ ID NO: 4028 - protein, 526 aa, Unknown
  Kingdom: Fungi, Phylum: Ascomycota
MLGFDTKVETSSGSSDKQLPTVLDDYLYVVGGGVAVHLPGDNADSETRVAGLNVTLALSLKEDWQARDAEFKTIPADDFPTAIGHALWANKDDKEIVFWGGKDFASDQTGSSNPKIWTLTADGNGGGKWTSKEPPSDIRRAAFGGYTECGGKGYFVGGYGEGTTDGPAFTGNRIAVPGLISYDFNNGTFRNESTEGLTDTGAFQKGSAVCVTLPGQDPKLFVLGGAEPQLTEVADNNVVGLQSFDNAFFYDLKKQKWFKQETQGSRPAARQGTCAVGAQGPNGTYEIFMYGGFRDGGGPMDDAWVLSIPAFRWFRIDAKSDTRYSHACARVGSQMIVVGGNDNPVWNKKDPFPKGLGIFNLNSLEWKDTFEADAAKYESPSVVRTWYNERGHDTIPWGSDEIKEAFLSTDNVDGDGTSDPEPTSTPDMGSSTSAPTGAIAGGVVAGVLGLTLVGAAIWWWRKRKNEEPREPINEADDSFAFKGYEMDSGYMPSELSSPATERIAESRSGNKRFELDARHSAVELPA

SEQ ID NO: 4029 - protein, 324 aa, Unknown
  Kingdom: Fungi, Phylum: Ascomycota
MEKYSQFRDRATGIAPFLPVSTPLSAVSTLTHTLLFLFRLPFFITYAFTYFVFLHLLPLPVFARKIALWGLMAIPGIWWVDLQLDGVKRGHLAEQPRDRFPHPGSVIVANFTSPVDAVYLAAIFDPIFTVSYPGSTKVRRVGLLGAIAQALAPVKTAPPQNAKLVDLQELLAANPNRIVTVFPECGTTNGKAILPLCPSILTLPADIHIFPVSIRYTPSDVTTPVPGQWFNFIWKLLSHPTTCIRVRVAEGQVNNSTALTNGESTSAELRDRSVSNGADVSPEGRKVLDRIGEALARLSRVKRVGLTMEDKRAFVDTMNGKKTK

SEQ ID NO: 4030 - protein, 1052 aa, Unknown
  Kingdom: Fungi, Phylum: Ascomycota
MPSASSKTGFRRMQTFKTDYAPCTITQYVSERSGMQVVVADRKGPKVNGYFTLATEIFDDSGAPHTLEHLIFMGSKNYQYKGLLDKLSSRAYSGTNAWTATDHTAYTLETAGWEGFAQILPVYLEHVILPTITDEGITTEVWHVDGEGNDAGVVYSEMQAVQFRSSEIMDLKARRLLYPENVGFRYETGGMTDALRVLTPERIRQFHRDMYQPRNLCVVIVGETDHENLLQILDEFEESIKDDLPPLDSPFKRPWIDSAQPPTLKETVLTTAEFPEEDESVGEILVGFFGPNCVDIIATSALTILLTYLCGSSVSILENIMVEREELASSVSYWWDTRPNSVIWLQPTGVATEKLEFVEKRLFELLREVASNPLDMEYMKECIRRERRQVKYHAEVSESFYATNIITDYLFGKRDGSTLRELETLSEYDTLEEWKDEDWRAFIKKWIVDAHHVSILGKPSLELATKLKSDEEARIARRKEELGASGLEKLGKQLEAAKQKNDEPIPPEVIDRWDVPGTESIHFIESDTARSGHARAIGAGEGHAQKLIDGTTESKLPLFLQFEDVPTNFVHITIHVGTAAVPDELKPLMPIFSDNFFNTHIMRDGKLVNFEQVVMELEKDTVSYGLSSARSLGDPDGIMVQFQVEPEKYASAINWLRTMIFDSVFDPMRLKAAVNKALADIPEHKRDGRSMSSEVDSAIHLKRSCLTFAKRTLVRAVYLKRLKKLLEKEPEKVVGWFNQVRSSLFTFQNSRLLVTARLSTLPNPRSAWDIFVGSMEAKGDMNPIPKPVSLLNEEGQKPGSIGATIVPMTALESSYTVSTAPGIASFEDPRLPAIMVAISYLEAPEGPLWNAVRGAGYAYGSHFARDVDSGVISYRVYRSPDASKAISASYDVIRKVAEGEVELDKHLLEGAVSQIVVMFADEQATMPGAAQQNYVTGVVRGLKNGWSKELMRRVRNVTQEEMKAVMREFILPVFQPGKSNIVVTCAKNMQEGMETAFKGMGYKVQTHELSHFHDDYGLKTGDDDDEDEDEDEDEDGGSYTGSSDSESDDGKL

SEQ ID NO: 4031 - protein, 657 aa, Unknown
  Kingdom: Fungi, Phylum: Ascomycota
MPSFGQNDPQGPPEVTSWARPSEREESVASSCTLMGEEDNEVVEQEFIDLTLEDRDDGSHQKPRAREAIRGRLEAQQHNITAGDFVEVDDTTIGCYTAEFILVKAISRYGENQHLIRGVPFARTRRMLGKLPKKLNEVCTIHYFSNAPQKSAKTPILVEVPISSVHGKRLLITTNALYPIHNPKLTTFTNIEDPTVRATAIEEHGTLVCRWKVEIFTSSECPQSKTIEEVVSRILPEEVANRRYRVNEANVLRQWRGETIKGGSWAARSDKNATLDEKEHGLMARQRGQRYTLFDSFCGAGGVSRGADLAGFHIQHAVDKSPNVWATYQANFPQTSLYMGSVDDFIQNSNDSKTKVDVLHLSPPCQPFSPAHTREAAHDDDNRFALMGCFALINMTRPRIVTLEQTFGITHQRHGEYLRTLINDFTGQGFSVRWQIVRLATWGSSQDRKRLILIASSPGERLPPFPAPSHSENGHGGLKPFNTIAKALSCVAIGDVLHDLDTVRYHEPLKAPFSANRLAGTITTSPGGFYYPDGTRDLTLREFACLQGFPAHHTFEGTRTSILRQIGNAFPPNTVRHLYKHIENWLLKQDGMTPFVPKASEVIDVESAGTTPRSGRRRRLMPFSSRVQPQAPVDVDQVDVEMTGFKANLAMGVIDLT

SEQ ID NO: 4032 - protein, 457 aa, Unknown
  Kingdom: Fungi, Phylum: Ascomycota
MGWLLPLTYTRPRHVDIDDARHSEDSAMTTSDKSDGSVKSGNSGASSGIPDSLTFDKIISGGTCPPMTVRDFMNYLVYIEHSAENLQFFLWFRDYEKRFRAADTRDLSLAPEWTQAMEDDAVAKMRRMNVEKMRPDPKAADIFKGTDFEKQGQELQPTDIYSPNPFNTPPRSAHSNADGDSTYTPSYGVSTHASTHKTQASNAFAAAGVSLPFTVQPFRDEINRIIATYIMDGAPRQLNLSASEQKVAVQALSHTTHPTAFRGLIRNIEGALRHQAHPNFVRWSICNGNPARVFFARALGVGLIVEGLVAGILLTLSGVPRGFRALPAIALVLGISTLIAAYKGMCVVLHGMHHRHVRPWELFVQEDGSDDGSEASYCHKTSLESFGSTNSYEEEPWVVKYEKRNVVRKIFDREVWIQEPALRQIQDTIFVQAMLAALLGAGALTAIFVAVPGGHFF

SEQ ID NO: 4033 - protein, 847 aa, Unknown
  Kingdom: Fungi, Phylum: Ascomycota
MMQMQHQAPPPPPPGIQQGHYPAERVSIQAMNEAVWLQIGSFSEMLRSPEEAMIAYEKALSHNQNSIPALNAIGMLLKGREAFEKALNYFRAITQLDANNGEAWGNLGHCYLMTEDLQKAYDAYQQALVNLRDPKDPMLWYGIGILYDRYGSYDYAEEAFSQVMQIQPDFEKANEIYFRLGIIYKQQSKFVQSLECFKYIVSSPPGPLTQEDIWFQIGHVHEQQKDFDSAKAAYQRVLEHSPNHAKVLQQLGWLHHQQSSAYETQDRAINFLEKSVSADNSDAQSWYLLGRCYMSQQKYPKAYEAYQQAVYRDGKNPTFWCSIGVLYYQINQYRDALDAYSRAIRLNPYISEVWYDLGTLYESCNNQITDALDAYQRAAELDPGNPHIKARLQLLRSGGSNGGQPASAPQPADVHPQAYQANGPVGPQWGGSTQQPPANGPPPPAQGAGENWAGRLSQVNPPPQPPNPYDGRGGDTFRGQAPPIQRQPTPQGEQQGRPPFSEQNRGGPPRRTPPPGAPHPYHQGPPPAQAPPGPAPAANRRVLNPGYDGQAPSAPGQNANGPNGAPPNGAAPFRGANQSPRPDGRDSRPPYDTRMPSPKSAYPQHPPPANAGYPAHPEAERQGAPDNGPPPPVMSEGPPSRAEDRPPSVGPKRMREWEEESAAKKQANDENRARLDDMRHRRPSTPPRTDSFRRNSSEARRFEEQRRAEEPRKAEEPRVAASDNYHPSEAAHHPQNHTAPTSQLPPMQPGSSEKPGASTPKEERPAAVPAAEASTAPARPSAPPAEPERAARKMDVDEDYDDSAEEDKKPAIVTNGSGPASAAGDTKAPSPTSASANGAPAVAAKTE

SEQ ID NO: 4034 - protein, 412 aa, Unknown
  Kingdom: Fungi, Phylum: Ascomycota
MAPDRHDRGSSRRHGVWGHWVPLVLTLTIATAGVAAWAWSQRKDAEEENEHEPDLDYENADYGDNPPYGSSRDYRPPPNQGGPPPQQPGPDGYQAVTDGPGDPSQAGWGARMSGALRRTPSPQQFFDSAGKTVAGGVAAAGAVMGKALASIREEDKQYGDRNPWSEEADAKKDRSVPASGKRRKTVALIVSADSKSTDFPEDGFQEHASILSHIPRHNDFAEIKLFVLIYAPGLKDTGADTAISNLPPPSLASSYSNIGHDQAQTPGDEAKNPMQVTLSLASSSPEYNAVYSQALNIVEKESMILPFTSSNGHVHILRHLSPEVIYLQQSLAGDNGSIVTNLQTWLRHDIILVVGAESGSGGLADSESEAERTTKVEQWWQKPERVGRGRGVIVVDGMRVADDWAKRVQGKD

SEQ ID NO: 4035 - protein, 2670 aa, Unknown
  Kingdom: Fungi, Phylum: Ascomycota
MSKTEANGEASGATLDLPILTKDLASSSTHARIARLQDTSEAISQHPASNASDADLLKLLFHTHSYYHDRESRLAVQKCLSTILRRGPDPKALVLLVKAMRQESQKPGIATSSAFVLVEWCSVLMQRLAATPAWDALGDEILMADAAALDKCLQPSTKRSVAHSATIVTRRAFRSLFSSSETREKYLSSAVKLLTTKASASTAKHALLLGVISGVSARQEGLRPIMEAQKSQVYEFYTREIIGSKTAVPEHISSGLSDFFVSFATLDEVEKNLIPPLEKGLLRAPEVILGSVMKKFVLSLPNSFDLSKILSEKLLKPILSNVKSSNAAIRAGALDSFRAVVTRCSDQAVLARVVDEIATPLKGAKLASPDHRLLHAEMLRAIALSEETAEVIGAATVTVAVKEGNEAALAAETSAMAIASTYLLQKRGELSKALIDAIVKGLGEKKPGSRRLWLLRVGDIVSSLADRETTAGVTAFVDAVLPKMVDVFTDAIANPPISAQNGTIVGAYILTALASIMEARSEKAAALIAKASVFKHALSIAEKQSFLLNSRVYGKVTADEDLEWFSRALSTVFPKLDNDSDGDVSQAASEGIIYLVTSSTVPQGAQRAAAKSLTQLYLERPGVVSQLITEALWAGLERTQTSTDKEAKLEPQNLIEILRAICLEANSYTEGSKPAQEVLEQQACSLLVLARPELIPRSSWIDLCLRMGLDPGALARKYEEDLLREIGARTSPEQKSDVIRLAASNAAAELAFVSPESIIPRLMKLIGRDLDPKQLQNVGPVEAAILRTPEGTCFVDVLAKKAKESVPNKNSKDYDLLKWEEELRSQIDQKKGQQRKLTADESAKVNAQMKKEAEIRKNLQDVEARLMRGIGIIKALATGPPTDAGLWLGTAVQLLLGVMDASASLIVGDVPSSAYLACAEKVTPKLGSARTFIGVATLRLRDIQLLEQYAEEKVDDLVTRVLYRLRFAAEQRPFDAVSLIYCLPLIVDILKKGGIGESPDDRDAQLVLAVEFLAFHTDVCQDEATPRGQLLSILIESMQVHGQHYKLIKDCFADLCRCIAPNIRSEEIAILTQGTVVSQASVRSTVLQSISTEIDMSEVGFCSEVWLAAHDDEEENQDLGREIWEESGAALDEAVPMKMMPYLASKDAQLRRAAARALAEAVEANKGTSDSILDHLKATYVDLVSQKGPQLDEFGMPKKMDTTDIWEPRQGIATAFKELATVMNTTQANAAFDFFIEAGPLGDKNAAVRAEMLEAAIGAIDAQGKNMVESLMQKFESTLESPDRHSEAADRVNEAVIIMYGALGRHLQAGDAKIPIVIERLLSTLSTPSETVQYAIADCLPPLVRACSDRSSQYFERVLDELLNSKGYAQQRGAAYGLAGLVLGRGIHSLREYRIMSSLKSAMENKKEANQREAALLAFELLSTVLGRLFEPYVIQIVPQLLSGFGDTNADVRGACLAAAKSCFANLSSYGVKQIMPTLLDGLDDQQWRSKRGACELLGAMAYLDPQQLANSLPDIIPPLTAVLNDSHKEVRAAANRSLKRFGEVISNPEVKSLVDILLKALSDPTKYTDEALDSLIKVQFVHYLDAPSLALVTRILQRGLGDRSQTKRKASQVIGSLAHLTEKKDIVPHLPILISGLKLAAVDPVPTTRATASRALGSLVEKLGEDALPDLIPGLMQTLKSDTGAGDRLGSAQALSEVLAGLGTTRLEETLPTILQNVESSKPAVREGFMSLFIFLPVCFGNSFANYLGRIIPPILAGLADDIESIRETALRAGRLLVKNFASRAVDLLLPELERGLADDSYRIRLSSVELVGDLLFNLTGVKATADGEEEEEDEEAVREAGTSLKEVLGVDKRDKILSALYVCRCDTANAVRSAAMAVWKVLVPSPRILKELVPTLTQLLIRRLGSANMEHKVIASNALGELIRKAGDGVLATLLPTLEESLQTSIDSDAKQGICLALKELISSATPEALEDHEKVLISVVRAALTDSDEEVRETAAEAFDSLQQILGKRAVDQVLPFLLNLLRSEEEADNALAALLTLLTETTRSNIILPNLIPTLTTPPITAFDAKALASLSKVAGAAMNRRLPNIINSLMDNEVNCKEEDLRKELEVSFDTVIQSIDEYDGLNTVMNVLLQLLKHEDHRKRAATARHLGNFFSSSAVDYSRYNPDIIRSLLNSFDDGDMDVVKNSWAALTEFTKKLRKEEMESLVMSTRQALQRIGVAGANLRGFELPKGINAILPIFLQGLMNGTAEQRVQAALGISDIVDRTSETSLKPFVTQITGPLIRVVSERSTDVKSAILLTLNNLLEKMPTALKPFLPQLQRTFAKSLADPTSEVLRSRAAKALGTLIKYTPRIDPLIAELVTGSKTADSGVKTAMLKALYEVISKAGANMGESSRNAVLTLIDTDVDERDDTMTITNAKLLGALIKNVPEAAAMPLLKNRVLTTHFSTSSVLALNAVLVESPDSLLQSQAAEELPELFCQGMAAKTPLIVDNFILATGKLLLSSPPKSFDSIKAIFTTLAQVIEPGNPTDSRRLALVVARTLSRTDRDMVRPHISIFAQPIFASVRDPVIPVKLAAEAAFVELFNVADEENKVFEKFMAGPGSELPANTQRSMGDYFKRVATRLGSQIRERREAEGGQGGLGLSNDEQEDEREIWSVGKVDLGDVFT

SEQ ID NO: 4036 - protein, 1683 aa, Unknown
  Kingdom: Fungi, Phylum: Ascomycota
MRGYGQPGSFGPECESSMMAARVTHVSQLLPVAHNKYTFKYHVELFSPASPTHFIDFTSAATAQAHAIAVIEDLPTTPSRFRHWKEARLFSGVSLWLPARGSNGAQHFLYFTAQRVVTPANSCSFPSPRPTTTTARVQHQAITTAENTVHCPTVKFLYAFPPNPPTDDEFSTALHHEIHQQHLAAAPLYRLRSLHSILGVWPHIPLQLFSLLRTHVAAVGAMTEVGAADLSRLLHSKRNEYDAIVTSRKRKLRELFAVATHAESLPRDGFTNPNATEPAPAESLFLQANDILQDKLFDDATLPKRSEPNVGFFVQSLHNVLFPPAEIQAHPTAVTTKIETPAPAPAPAIKQSPSLPSNTKQGPAAPVGRLTPASSVSSPLSAPVESKSSSASPVVSGLNVAAAQVVPNREVRGTPHVATSTNSDARARHPGQVSFPPGTKGSPSAAASQTVPRSTIGDRNEVSGVETNGRATPAAGVAEAMKSGDAVSSPGSTAASVATPHIHTASTDTSPDKEAPPALEAVREKSSTTTPDARPTPSVQPSRNSDQAAGSIIESAEEQLLRESRLSAQAATSRAPSSEPPKPAAAATSSAVAAPSPSLRADATTKPEVPDSQEDLHDKMDLDSTLMVNDKPSTIHAPQQRKSSDSIAPETSLLAQSPSKDTQVAERAVTRVSSGAMRLKSVTEIVGGTPRTANSDRAMTQDFENQLTPLTSTSHSPSSRYRHGRPQSRGQVSTVLFGKQPKRNEERSVAGDEKEILKPEDDYFTPLFVQGFTNSSSWMQPMEKLLFQANKTIATPDALLALQDHQACKVLRRVYHLQQNDKWSLRQPKRCPEPARQTSQWDVLLKEVKWMRTDFREERKWKMALARNFAYACAEWHVASPEVRKQMQVPAHIPPKAQPTADVSMTDADEDAPENQPTPDLVSSADSPQNIEELSEDFVETVAPSAIFALQEDDLVFGLRRSPTADRLLDELPMYSSPLQVPKVDPLNPDFDPDALWRRPALPLSKYVEGQMKVVAPVPPRKRSRYEYEDDSSDDEAETLSRSDTRIHHMQLPPASDTVSLFKAEMKHTRDRLHAGHQFRPPSEHPMPIQSFYECRSPSQWTQSEDDELRTLVREFTYNWPLISGMLSSRSQFTSGAERRTPWECFERWINLEGLPADMSKTQYFKAYNSRIEAAQRVIMQQNQLAAQQASASGNNTTPLRRRPSTPLRVERRRNQKHLTLIDAMRKLAKKRETQQQKQQQTAAQSAANKKSIDSSSQRLPTKTPRDYSLLRWERDQALAERMAQYAAKQDVQRRKAAMAAARNQGQAGQVGQAAAGQAQAAQGGVPAAQQVNHAGAVNGVNGVQRNNIPSQVAAVAAAAAAAQQQNRPRMPLQAPVNGMVNGGGVQAHMNGGLSAPVAHMNVQPQMQAMQAQQQQLSQQQQQQQQQQQQVQQQQQQRVQMSTSQAELLLRAQRMAEQQRSAIQMQQHAQHNPQHQQHMQQQSQSQQSNAGTPGSQGTQGSPPMRNGVANMNQQSFMNNAQTILAQYNANNNHGTPKGGLHMPSLAAGSPGQAQARPQPQFPNNISAQLAQLEANFLAKNPSLTPEQTRQLATEHLTRAMMQQRQSAMNAAAGGAAAAALANSPGITNGMTATTSPHQYAALLRHQQQQQASQAAQSASPVPQAQQIAHQRQSSEGSTPSVPK

SEQ ID NO: 4037 - protein, 234 aa, Unknown
  Kingdom: Fungi, Phylum: Ascomycota
MRSNNSPTGDRPTAAAGQPANKGRQVSHSLVPQCHTQAFPSQANEPIFHLFPLLPAELRIQIWKACNHPRMVEISREPSSIPNGDLEYFWSPQPVVAIQQACHESRNSGCYVKGFSLGAAPRYTWVNFSTDTIDLSQFAMDEPEMEYSRIEKLHIDVVAWDLFMDEEVLYLCRFKLLQSLSLLSPDADFEYWVCYRGIPGPHDWGCSPDKVTIVEKKSGWQKSLAQCVRDQRKT

SEQ ID NO: 4038 - protein, 393 aa, Unknown
  Kingdom: Fungi, Phylum: Ascomycota
MAPAIPAWLNKRSLNQAANAAWGPLVEASHQLLTRNDDDDKDKKKDDDDDAWKKEDPSAGVLDPHDISNVGFFILFALIGLALVLTMIWFFFWAKNGGFYFKENDWDDYKTTVLRRKGPNGTILSNATPSTNLGGGSVYKDIDDDTTTVVTESTALSGVTAGASDIGAREKRRQRQEQRDREKQRERRKKRSSSKRHVGEAGVEDDMAEKAARDELRNYRHEKAARVGGINKQSEGSNWDGSTNPSDSTVSSELLSHRQETPTTTPTGTPTKKAAHSGTGGNNGIRKVYSTADRNNDRESERIRNEARRLREEGRSARRDFSYQRSAGGTGSEVSGASQSLLDGSDVGTKSYHHPMPELREANEAREARQREREERRARRGGYRRGRGEDTDM

SEQ ID NO: 4039 - protein, 1080 aa, Unknown
  Kingdom: Fungi, Phylum: Ascomycota
MASPTGLTGSQELPEHSETSTTDTDDSRDTTVPVGRTTPDIFAGVYRGLRKLPSVRLPSKVSLPSLRRDPSPAQTDAIPEQASVDDATPTGHQNANSVSFIQSLDKPLPRPPPGNTQVQSPTNSAQYSTPILRQQFEYSERLDQRGSTGTPTSNREEAQFDRNGGSMDGGAGAGLSNGQSNYMQGTSGSMSSLASSLRQDGAEENGERLAPRHNGQGSAGPSPSMSSGRAPPSGSQSVGGPSQGSSAHLSGLMCNVHRTTGREPHPLVGATTTVLGDKLYVFGGRILSRSRPAPLTSDLYELDLIRRHWTKLETTGDLPPPRYFHSMCALGDTKMVCYGGMSPMTPAPGSSATTEQQSEVTVMSDIYVYDVPTKKWTFIPAQDPPQGRYAHCACILPSTASFSSHRAPLSALRHNPSSGNPNEGRIGINIDGSGGSEMVIVGGQDGANHYIEHVSVFNLRSLKWTATQSLGKSCGAYRSVAAALPPSISSVIGRGYQNGSQRSEPTPQPPSRDAMSSMLIYSNYNFLDVKLELQIRTSDGTLHERPMSGTYSPPGLRFPNGGVLDNHFVVSGTYLTSSKQEYALWALDLRTLTWSRIDAGGGVFGQGSWNRGVLWSRRNTFVILGNRKRSLVDDYNHRRINFSNVCMVELEAFGFYDNPRKSSPLSGFISASSPYTGPGLNIARKAGYTAGGRYHSKASEELGEKAFAMRELSDMDILCIGGERIPINSRIVARRWGPYFVQLLREGTATQDGSDAATLRSGLSSNPLRASAMTITPSSRAGDSSASITSTMLSGSSGNAPPSTAGSSNTGSGALSGEDPNPATINTAPTPRSLPPNSRPRCLYLPHTYLTIQALLHFLYTSALPNPSSPLCTPQILCSLLQVARPYRIDGLLEAVIERLHSLLDSRNAAAVFNATAMAAGGGRGIDGSLNPNFFVGSLDPIGSPTSTSDFSLAGTTANGSFVSDGDSLSESLRINTNVAPNRPSSGELSASGSVSGSEWSNSDTGGDTDHGRNAVWNGELSSVIGLQKRGLRGLMEGRRMRERTGTDTGMPSASAAYAGPAGNQGQQQQQRIGLGIGSS

SEQ ID NO: 4040 - protein, 818 aa, Unknown
  Kingdom: Fungi, Phylum: Ascomycota
MVSIRSLATALASVALLVPFSIAHSVDRNPLSYISLLDEPDIRLPSKRVHAHSRFDLTFSIHQGAQEVRLVLEPNTDVIPNSFSVTTIGTDGKPKSIKSVDRSQHKVFRGKAFVRRQGLNGWHEAGWARIMMHRDGKAPLFDGTFRLDGDLHQIQRGPQYRRTRLQYDPELEDSDENVMVVWRNSDIMPFNPADDEEAHLELKRAVNDAASCAADSLEFNRRDDDLEYRNLASMDSRDLLGRQTDDGDAGGDGRGARLIDSIGSTDGCPSTRKVALVGIATDCNYWGEFDGEEDLRRHVIGLVNQASEVYESTFNISLGIANLTIIDSECPSSAQDSAPWNVACGGNVDISDRLNRFSEWRGRFEDNNAYWTLLTTCASDSAVGLAWRRQLCRRGAASAGQNNETVAATNVVVKKSSEWQIFAHETGHTFGAFHDCTERECPVGQSSQQCCPLSTSSCNAGGDFLMNPSTSDSHNRFSPCSIGNICTTLRLDTEADCLTDNRNVDTIMGSQCGNGIVESGEDCDCGGTDSCGENSCCDAETCKFRGEAQCDPSNEDCCTDSCRFASSGSVCRPSSGDCDPEETCPGDAARCPTDEHADDGEDCGDGLQCASGQCTSRDQQCRNVVGETVASNNTEACDEDQFLCRVICTAPERGGNTCVMYNQNYLDGTPCGSGGRCQDGTCEGNSTLNQIGSWFDRNQNIWIPIVAVVGALLAIAILSCMFSSCRKRRRAAARAKAAPPPRPRPEMNNWQSFNGHYGNSPPAHHASGGVHPGFQPPPPAYGQGMNNGVHSDMQSHMYEQPPPQQFGRWNRTRSMRYA

SEQ ID NO: 4041 - protein, 220 aa, Unknown
  Kingdom: Fungi, Phylum: Ascomycota
MRLTLSPIVLLALSIVTDAQLLFPFSSKPGVKDSPSASDKETVRRPLPFGQLPLMPPTTGNDGDMTIQPSVPLTDILGTLRSLTTFSSLARMQTTTTTLLSDLGTNTTVLAPLNSAIESLPRKPWESPRDYDEHGVSAYEGDDGQDRANANLRRFVEAHLVTKNPWEKGEKVKTIGGRDVWWEEKNGKKVVMPDEIEVDRVANQVANGEVWILKGVLNYV

SEQ ID NO: 4042 - protein, 1200 aa, Unknown
  Kingdom: Fungi, Phylum: Ascomycota
MYIKQIIIQGFKSYKEQTVIEPFSSKTNVIVGRNGSGKSNFFAAIRFVLSDAYTQMSREERQGLLHEGSGSAVMSAYVEIIFDNSDDRFPTGNKEVVLRRTIGLKKDEYSVDRKVVTKSDVMNLLEAAGFSRSNPYYIVPQGRVTALTNMKESDRLNLLKEVAGTQVYETRRAESLKIMNETNNKREKIDELLEYIKERLTELEEEKEELRGFQDKDRQRRCLEYAYHHNEQVTVHQALEDIDNARQDGLDTTDSSRSDFIKGEKAIARIDAELHKLERETELLQIDRRQLEEDRRDSAKALAKTELRAKNLKDGQSSREQARAQHAAELEAVQTEMANKEAELARILPEYQKKKQQEDEIRRQLDAAEALRTRLFAKQNRGSRFKNKNERDAWLQQEVGELENTISTQKANLMDANEEVARVQKSIAQSEKDIANMRARLSNWSNDRMAMAEQSTKARDLLDKLNDERKLLRREDDKLHSVMSNARQEKEQAERTLSHAMDSQTARGLATIRRLKQDQDISGAYGTLADLLEVNEAYRLPVEQIAGASLFHYVVDNADTATKLADTLHKQRGGRVTFMPLAQLRPRHVNMPRANDAVPLLSKISYDDDYEKAFQQVFGKAVVCPNLTVAAQYARSHGLDGITAEGDTTNKRGAMTGGYIDPRKSRLEAVQAANKWRAEYEELVEQSRGIRRQIELKDQEITGAMSEVQKVEQKLRQADDGFEPLKYELMNRSAHLENERSQLDSALRRRDAVEKNMNSFMEEADAHKSEIGTEFKKSLSSTEERQLEELSLTTQQLQMQWNELSSNRRDLERRKQVLEIDLRQNLQMRLDQLNSLAFEDSAGGESSGGLKAVQKELKKAQNVLRSVEESLLETEQTLEQLTTRMEEATQEKATLDQNQHELSHRIEKQQKRMEKTLQRKALLTTQAAECAKNIRDLGVLPEEAFDKYENMESKTITSRLKKVNEALKKYKHVNKKAFEQYNNFTTQQDQLMKRRAELDESQGSIEELVEHLDRRKDEAIERTFKQVSKEFATIFGKLVPAGHGRLVIQRRTDRRQQPADESDDEAKGSVENYIGVGISVSFNSKHLDEQQRIQQLSGGQKSLCALCLIFALQATESSPMVIFDEVDANLDAQYRTAVAALLDSISNEIGTQFICTTFRPEIVHVADKCYGVTFRNKTSSIDCVSEEDALAFVDEQAKPT

SEQ ID NO: 4043 - protein, 940 aa, Unknown
  Kingdom: Fungi, Phylum: Ascomycota
MGDTVRTQASASASLDAGPAPRAPDANQAPANEAPATEVPAATTTTSSNVTAPSELQPSQFWTEQGLPHAEPAEDDADSALGDNNSSTASLSSSILHYRTINGRTFHSERGNAQYWAPNDDQQNDTLDIQHHVYTVMQDGKLFYAPLGDKIGKVLDIGTGTGIWAIDMGDEHPEAEIIGTDVSPIQPDWLPPNVRFEIDDFTQEWTFEPNSLDYVHMRFLIGSVTDWNALFAQAFKVLKPGGWVESLDNDGFFCCDDDTMPPTSAMGQWGGVFKEGAKAMGLKASFAIISEGLQRKGLESAGFVNIQEKLHKIPVSAWPKAAKEKQVGQFTGAAMCNDTEGTVGLFAGALGWSKEEILIYSAHARKEVREKKIHAAFDNDLLIEQGGHTTGRLIDLTFRQVILITIIQLDERIANSGVTDSKHCKSHEDTPWHAEARDPNRVITKGQARTLTKNFAHYLRHEYRIGENGGGKDVVLGFSLGQRALACFFYGVIAAGGVYSAASPAATPSELARQIRDGSATVLACSKELEPVALKAAAEAGLPKSSVLVLESYPDIRLSSSDGAKRCDFRQTLDWELITETERLKKLTACLVYSSGTTGLPKGVQLSHSNLVAEVFLLSVITRPASEKWEKTGWRGRTLGHLPTAHIAGIQGYFINPMFEAHVVYWMPSFNFEDFVKYCDTLKITGMFSVPPIWMAIAKHPAVKDQFRYLRSAVSGAAPLSADIQAAVGDKIEGTLRQTWGLTENGGAATYVDPERTDTVGSLGPLLPSTEMRLVDEDGKDVAPGEPGEALLRGPIVAMGYHNNPEANRTSFTSDGWMKTGDILRVENNLLYVVDRKKEMIKYKGLQVAPAELEGLLSSHPAVSDAAVIGISAGGTEVPLAFVVKAPGADVSAEDLAQFVKERVSSHKQLRGGVKFVDVVPRSPSGKILRRQLREQQAKL

SEQ ID NO: 4044 - protein, 584 aa, Unknown
  Kingdom: Fungi, Phylum: Ascomycota
MASTTVQASTFQNPIFTGFHPDPTCTFVPSQNNTFFCTTSSFIMFPGLPIYASQDLVTWKHISNAFSRADQIPSMDNIVRGATSGIYAPTLRYRDGKMIIMSTVAHQGYPGENYTRWDNFIVTSDDPYSSESWSDPIQFDYPGIDPSPYWAPDGTAWVAGAKDGKTMPQAPMDLETGEWLGPLRDTWNGTGLPSPEAPHIYEKDGWLYLIIAEGGTRERHRVNVARSKSIEGPWEPGPHNPVLTAYQNEESLFQAVGHADLFQDASGKWWSVILANRAGGDYAEDPYNSNFPMGRETALTSVTWQDGWPVFQNVSAQMSGNWTLPPQVGLIEGGEGGLVGENDSLDFEPDSDLPIHLFYWRLPKTKHYEISPDSHPNSLALRSSRLNLTGYDGDSTRGWGQTFLARKQAHSLFRFSVDVEWDGHLTKDGHEVGVTILQDQSQHFDISIVMLHDSATNKTSPHIRFRGISTTPFRLPENKLYVDETYPLRDSWKGEKLRLQVEGLNATHYEFAAGLGGEDEDREMQVFGHCQGDKLIPYYSGTVVGAFATSNGRYKERDFEAYVSRWRYTGVRQILDNDEKMGNL

SEQ ID NO: 4045 - protein, 1202 aa, Unknown
  Kingdom: Fungi, Phylum: Ascomycota
MEGEEPTQATQDVLDPRRLGQQNSGFSDEDISDIVCILYPHSESARQEVLRLAQEDSPHVIGRTDADGVDPNYDLEDHASRFSLAEAEGNYALILRLSAAIKDPTAGFVFGRNALRCDVVFVKDPLKRISNVHFRIYVNKHGSVMIEDQSTNGTVVDENVLTSHPKDPTQEPVPRWMLNSGSVIKVHLHQQVKDLTFRVRIPRRDAEYDMAYMNKVREYFERHGLDDEGSPEAAPAVAVPRHLRDDEATPKRPHRSPVKRKDTGVMRREWTGSGKYNRIGTIGKGAFAVVYKVASKYDGSPYAAKELDKQRFMKNGVVDQKAENEMKIMQCIDHSNIVRYIETIDWDDRLLIIIMEYVSGGDLGRHISERGPLPEGDVKLMAGQLVDALSYLHVRNITHRDVKPDNILISSLDPLVVKLTDFGLSKMVDSEQTFLRTFCGTLLYCAPEVYTEYAEYDEHGVRNRGKKVRRPPGQRYNHAVDIWSLAGVLFYTMTGAPPYPVKTGISHSELLHMIMTTYVDTRPLQNAGMSHDGVHFLTRMLDRLPEKRATIHELVGHSWLTGPVSESVQASQSFDELTDDENEVNFDNEDLDMDLDTFRQPTDDMYEEDRISDSIGYDSEKENGQFEEPRQGARLFGEVGSSAIGSSGVIPSDLLNLHRSNDSMRETEIMDSYVDEAYDSESHPTPRNKSRQLYQQTSPSMAQNQSADQLDSLVYEVASQSLGGKDHPAASVELRAMSFKRKPPSTETSGEHDDENFTPGKPTMKRLKSETTLESMSDDALEELKLIASIPPIKRLHSGRQIDSAVNKVVFWAQDRKTWHLDYPEMTQLQKDAFVQAAERRGEEFCPGGSPLWKLAMKYFAPMATHEASQGRGVPTMRRNEQMLEDDSMMFPPTAAATEPAAPSALAYDSLPPTQNPDGQIVVPVRAVESSQRAIALLESTADSVIQGVSLPVTNSLISFGRGQENTQVFEPPTESRVPKYAFKILLWRDGYDPSKDPTKVTPPWQQDTVSADEADQYSFWVCTKATVGIQINGYQLASSDNRNHAGPSQFWARLHDKDELVIWGAHDTENHTKFVFRCFWGGSSRPRPPQYRGFETASRDVVQKLNDACQLTERRMRDTREKDSLKNEAMKDHAFRNRLVERERERSRVFDKKRQEAVELLKQAQFARRGSPASVASTGHFRTPHGASSVSQDRRGAHSIR

SEQ ID NO: 4046 - protein, 436 aa, Unknown
  Kingdom: Fungi, Phylum: Ascomycota
MDSYKLTATELQAKFKADELTVTQYAESLIGRVKERNPTVKAWAHFNPELVLEQAKALDEVPKDKRGPLHGVAIGVKDVIYTKDMPTAHNSSIYEGSFPKIDAASIQILRQAGTLIFGKTTTTEFAATVAGPATTNAHSPNRTPGGSSSGSGAAVGDMQVPIGLGTQTGGSTIRPGSFNGIYALKPTWGAISREGQKLYSLIFDVLGLYARSAADLDLLAEVFDLQDDEASPFSSLKGAKFAICKTPMWSEVGEGTKNAMDKGASLLRAHGATVEEMTLPPVFDNVTTWHKIVLGSDGHPAFLADYRTSKDQLSPFLQGHVERAGGWTRKQQLGAFDGIAKLRPEMDEILGQWDAIIVPSVPDEAPEGLDSTGSAVFNSMWTAMHTPVVNVPGFKGANNMPIGLSLVAPRYHDRHLLRVSRAVGEVFEAEGGWRAT

SEQ ID NO: 4047 - protein, 272 aa, Unknown
  Kingdom: Fungi, Phylum: Ascomycota
MASYVITGVARGLGYEWLLQLSKDPSNTVVGLVRDKSATDAKIRADATLSPRNNVYILEADLTDYNAIKKAAVDTSAITGGKLDYLIHNAGVIPKLDAFDGPGALGDRPEEITQVIRDVFEVHVTGTVHLFNLFLPLIQKGNAKKIIATTSGYSDDGLTRKFEIAVAPLYSASKSAQNTIVAKYHAEFAKDGILFLGVAPGTVDVGQFNDLTEEQMQKQGKTGEKFMQYTPDFKGPITTEESVDLMLDVINNATIEKNGGDAISQFGNKQWL

SEQ ID NO: 4048 - protein, 1214 aa, Unknown
  Kingdom: Fungi, Phylum: Ascomycota
MATTSNMFMYSLTIQPPSNVVSAVLGQFAGTKEQLIATAAGSQLSLLRPDPSQGKVVTLLSHDVFGIIRSLAAFRLAGSNKDYLILATDAGRIAIVEYLPAKNRFSRLHLETFGKSGIRRVVPGEYLACDPKGRACLIASIEKNKLVYVLNRNAQAQLTISSPLEAHKPNVLVVAMVALDVGYANPVFAALEIDYSEVDQDTTGQAVEELETQLVYYELDLGLNHVVRKWSEPVDPSASMLFQVPGGNDGPSGVLVCGEENITYWHSNQDAYRVAIPRRKGATEDPSRKRTIVAGVMHKLKGSAGAFFFLLQTEDGDLFKVTIDMVEDDEGNPTGEVKRMKIKYFDSVPVASSLCILKSGFLYVASQFGNFAFYQFEKLGDDDEELEFSSDQFPTDPKASYEPVYFYPRTAENLALVDNLPAMNPLTDCKVANVTGEDAPQIFTICGDGARSTFRMLKHGLEVNEIVASELPGIPSAVWTLKLNREEKYDAYIVLSFTNGTLVLSIGETVEEVSDSGFLTSVPTLAAQLLGEDGLIQVHPKGIRHIRGGAVNEWAAPQHRSIVAASTNAHQVAIALSSGEIVYFEMDSDGSLAEYDEKKEMFGTVTCLSLGEVPEGRVRSSFLAVGCDDCTVRVLSLDDDSRLENKSVQALTAAPTALAIIAMEDSSSGGSTLYLHIGLHSGVYLRTVLDEVTGELTDTRQKFLGPKEVRLFQVTVEGQTCVLALSSRPWLGYADPITKGFLVTPLNYVDLEWGWNFSSEQCEEGVVGIQGQSLRIFAIDRLGDTLIQKSIPLTYTPKKFLKHPDHPIFYTIEADYNTLPPELRAQLLADPSVVNGDSQVLPPEDFGYPRGNRRWASCVSVVDPLAEEGQALQRIDLDNNEAAVSVAIVPFTSQDSESFLVVGTGKDIVVNPRSSSEGYIYIYRFLEDGRGLDFIHKTKIEEPPMAMIPFQGKLLAGIGKTLRVYDLGMRQMLRKAQAEVAPQQIVSLNTQGNRIVVGDVQQGMVYVAYKPATNRLIPFVDDAIARWTTCATMVDYESVAGGDKFGNMFLVRCPTKASEEADEESAGLHLVNARDYLHGTPHRLNLMCHYYTQDIPTSIAKTNLVVGGQDVLLWSGIMGTIGVFIPFVSREDTDFFQSLEQHMRTEDPPLAGRDHLLYRGYYAPVKGAIDGDLCERFTLLPNDKKQMIAGELDRSVREIERKISVSQLKPLFIP

SEQ ID NO: 4049 - protein, 707 aa, Unknown
  Kingdom: Fungi, Phylum: Ascomycota
MASKGNSLRDRQIASLKKILNLNETVEASETEEAHANGLHAPVAPILDADGNPIWKVLVFDDMGRDVISSVLRVSDLRSMGVTMHMHIGSSRHPIPDVPVIYLLEPTAQNLQNITNDLQKELYSPAYINLLSSLPRVLLEDFATQTATAGTSDKIAQLFDQYLNFVVSEPDLFSLGMRKEHTYWALNSVSTSDDDLDRMVDRIVSGLFSVIVTMGVIPIIRCPKDAAAKLVAERLDRKLRDHILNSKDNLFSSQRTGATGTASSRPVLILLDRNVDLTPMLSHSWTYQSLVHDILDVKLNRITIETPNDEANPAKGSAKKSYDLTATDFFWAKNAGAPFPQVAEEIDSELLKWKEDTQAMTRKTGVQDIESLMQGDTGASAQHLKAAITMLPEMRERKSTLDMHMNILAALLTGIKNRQLDNYFQLEETVMKLAKPQILEIIKDNDKGSEPEDKLRLFIIWFLNTEQEVNRSDYQGFEKALADAGADVSSLPYIRQVRATTKMTQLATINNANQQAGGSGDLFGRFSAISSRLTDRLKDSGVPTGLSSNFESLISGVKNFLPADRDLTITKIVESIMDPAGAASSAIAKTENYLYYDPRSANARGTMPPPSAARGGAGTGNTPGGLPGSQGPGQAASFGQRRQGFSEAIVFTVGGGSMDEYGNLQEWVARTSGDRGRKRIVYGSTELVSAGEFVRDELARLGREVSA

SEQ ID NO: 4050 - protein, 502 aa, Unknown
  Kingdom: Fungi, Phylum: Ascomycota
MLVLEEQRYIHEDLERIEQAIADRIADEPKHIRERLNRDHEIEQLLGQVQSQSQSLIDIYKDESGHRAQEIQQIGTGDPFEEFYRQLKDVRDHHARYPNEQAENSEQRYKVKRAEGEVMPYIVDSLFSGEEAYGRFFDLNTCHEAFLNLPNARRLTYLQYLEFFDNFTPGYGGVKRNEKLTDQYFNYVGELASYLESFMRRTKPLENIEKILSSFDREFDVAWDKDELPEWQSDKPSTETGSKATSTGEAIWCDDCEKEFKNENVYKNHLTGRKHIKAAEQRKQRQEDGKDDTAAARGGMSATRTKERAVAEREFRVKRLASAMSTERGDTRVNVERKQGMTERERQQELDNLLNMSDAPQEAAADDDGDDEDGEEKIYNPLKLPLAWDGKPIPFWLYRLHGLGVEFPCEICGNFVYMGRRAFDKHFNEARHIYGLKCLGITNTSLFRDITQIEEAMKLWDKIQREKKRTTVDDGSVVQMEDGDGNVMPEKVYYDLQKQGLL

SEQ ID NO: 4051 - protein, 886 aa, Unknown
  Kingdom: Fungi, Phylum: Ascomycota
MPAHLSPDALALDPDEQDRLRPLNRSPHPYHHQSSELPHLSDRFRLQNGGARTSKRAGSDDEGDPPTIREEHTSFQGFSKESTPGSESGTEADDEHFLKGLPAPKTRLHKGLRGRNEPLSGAASPLPSPSFQDEDKLATQAQESKLAVEKSRVIDILRRNKNTCRRATEAAILAALGCVIATNQKVSPLVAASCKDLKTIGALYGSLLMLFPFRVTAWHYRKQRPARTIPLRLPHNFDPAPLFYPPAITLFVSYLVATDIPAVIIPNIILALSSIPQQLIPTFDRYAPYDTLHWLVACCPLIRAAWAGEPLEGLQLRAALPAETLVLIYPIHQTLCGVLHHLTTTSLLTAELQLLSVGLINVLLLAVSPQMKVLQSLLWVGGLAILVSCSSIIRSGITLARVPKWRFRPVPVTSRKSLWQNILAVVTWRKGKRDVSTHDDGAYDTPGSSDGDATSPVRNTLTRVRTLGIRGGPKSDADPAPSSPEGPQTHSMVRRHTLPHPDGAPAQRTTHTPSGRRKRATSVSLRPFLRMTYTQAAIRKWLYAGYVYACMAITIIFGIRVFIQEEALNGEEPIGWGLGYAFGELPWFRFRVVNANLERWICLPPRLEDEDAKQCDQGVVPRIRHDIGEANTRLVITGYWLAIFVTGLMVVFRLKDIYEVDTRRKVFHFMMVGMLLPATFVDPTYCALVLFLVLAVFLILDLLRASQLPPLSKPIATFLAPYVDGRDFRGPVVISHIFLLIGCAIPLWLSLAALSRTGTGYLAGWEVPTRDVSMVAGVVCVGLGDAAASLIGRRWGHRKWLWGGGKSIEGSVAFAVAVFIGLAAATAWLHLGGWVKSGASLTPVAYLRNTAFCATMASVTEAVLTGGNDNVIVPVVLWTCVKSLDI

SEQ ID NO: 4052 - protein, 374 aa, Unknown
  Kingdom: Fungi, Phylum: Ascomycota
MSAAEEDAYFSANPPPRNLPAHLSLAKSFINHHASQNRRVVLVTSGGTTVPLERQTVRFIDNFSAGTRGATSAEHFISAGYAVIFLHREFSLAPYSRHYSHAKDGVLDFLEVDEGSEGGMRVKVGGQEREKMKEVLQSYKAAREGNLLLTLPFVTIGDYLHELRAISRLMAPLGPNGLLYLAAAVSDFFVPPERMAEHKIQSTDAVKNFPGQSPLNPVPASAQPQEEEESFDNFDSSPTVPRHKRFIIDLDPVPKFLKSLVDGWAPQGMIVSYKLETDPSILVHKARYSLDRYQHHLVIGNLLSTRKWEVVFVSPRRDDKWIRVEREGGWGEAEGRPLRADELPKEDPGSEVEGLIIPAVRELHDEHISKTQKA

SEQ ID NO: 4053 - protein, 720 aa, Unknown
  Kingdom: Fungi, Phylum: Ascomycota
MASKTPRKNSSARSSSSRLPPAQPDSKADENEPPKPSPKKTTSFQSDTSKGEKATVLPTELEKPDAFENAEQSDDDDNIEITRASVDLDELPIELVQLIDNFVSSLNAKVHSAPPSIGRLSTLFQDFYATASSHINTHMATIATRQSRDASPAPSASSISSAASRLRARTTTGAPTSAKEKDAEHQMITTEELAERKRARKALDGRKALLEEIVERRLCEGIYSRIYRHRSTQDEAQDDKLRSKTAALELVGIGPTDLGIDLGQDESGVVSEEVQEKSKEIRAWLEGARKDMIQMHNSRYPLGKVNHLKAAHRSIVDTLAHFHPSASADEIMPMLIYTLITLPPEHLNVISDMHFIENFRWEPKLTGEAAYCLTNLEAAISFLQTVDLATLRADEHPSGPPKQVAFGEEKTETFPPAYQQGLTEATQSAAGTTNTTALASKPLDSPAGLKAATVLRNRRLSDLVNTPAQAIGAASDAVITTADQGIKTISNSLGDSYKFLLGKLREHQQGPSHSIIVPRTLDDARKLVSTPPPEEDDLVGPLAIRERFERPKRQNSRAEDRVLSLFNGGRDRSADSNRSAGSGKRFLSADDVTKAPPASPGQNPAVLEQMRNISNSFNPMARLGNIGPFRGFGRSAAASPVPPAKDAAKTVADGGDLATAFPDIAAALPPKQTPKIALPNRRFMELQSPGDLKLGEVLDLLKDYRRLANALKSMDAFEDK

SEQ ID NO: 4054 - protein, 312 aa, Unknown
  Kingdom: Fungi, Phylum: Ascomycota
MLYDLNIPWSPSTTQAQLLSTLTLSASLGYGTVALSHTLTLPLPSQFKKPLPELPTTNGQTRLPHVLHRATLPLSDPSASNYRIPSLAPMYDILAVRPLTKDAFHNACLTLDVPIISLDFTQHFPFHFRPKPCMAAVNRGVRFEICYSQVLNPNADARARANFISNATSLIRATGGRGIILSSEASSALLLRGPADVVNLMSVWGLSNDKGLESLRATPRGVVVNEGVKRSGFRGVIDMVKVPQSETKDKVVVDGQDKKQKKGQQSRENNGNNQKRKPREDASPGNAVSKRQAKKMKLAARTNTETSAQVPK

SEQ ID NO: 4055 - protein, 715 aa, Unknown
  Kingdom: Fungi, Phylum: Ascomycota
MAEQEEKASFFKPEDHQVAYVFHPDDVDARPGRPTKRRKVTKAALKSGGGQGRTGAADFVPLLNGAEAPAAVHQRERLFTEGWDEVHGRVKTILRESNSATLEQVKAFVGEAKVEITDKIPSAFIITGPDIAAQDLLFEQLSESLQQSLSSKFVRLRSSDGTTLKATLKKIIRDATAKGDDEDADDLRIGTGQNERRYLDYDLEALYALVRQSDCEHVFIAFQDSEGFDSGLLSDLILLFNSWRPRIPFTLLFGIATSVDLLQARLLKSVCQLIYGAQFDVVQTGTILESVFRTAVAAKDVPMRLGASLLRSLLDRQHDQVAGIQAFTSSLKYAYMCHFYANSLSALSDVKAADVLQAEHLEATRNTSSFRRHIDGLLASGEPEKLSQAKSLFEDDDVLTTTILTSGGNWDAWVDKLLRSLLISEAAGAQDGTFSEAYVHALDAGVAAEDASRVSSKVQRMEAEDIAKLIERVAEILGARDESLRLGPSDTSEDHALRDGLIVQGRALDQLRATATEQDIPLRSRYSGQSRVMRTTVIAQRVQLSRDTAALRDEDNQFTEIIDAVVKLLADYLGVPSAGSMFLSEAWLYDSRAPLRDVLVPRPQLVLKRCLTRPHDYLGCSCCKPDDEAGGIQATLPATSILYQMYLETGSLINVADLWTAYHALVEDKDNGEGSDGDERKALAEFYKGMAELRALGFLKPSKKKADHVAKVKWL

SEQ ID NO: 4056 - protein, 154 aa, Unknown
  Kingdom: Fungi, Phylum: Ascomycota
MVKAVSVLRGDSKVSGTVTFEQADENSPTTISWDITGNDANAQRGFHIHTFGDNTNGCTSAGPHFNPHGKNHGAPSDETRHVGDLGNVETDGQGNAKGSVTDNLIKLIGPHSVVGRTVVIHAGTDDLGKGGHEESLKTGNAGPRPACGVIGISQ

SEQ ID NO: 4057 - protein, 741 aa, Unknown
  Kingdom: Fungi, Phylum: Ascomycota
MATERIDISTSEISEWKSIVTLVVFVITNCIVLFPFPIPLYIPRQLADKSHDLLVKFRIIASRHDEPKHVARRTGNKSGRSKRFLRYTFPMNFITAPVIADLFLLAVGAIGRREVKEGTVGSDNIKPYDIMIFFITLAYIAISIDASGLIRYLAFKVLQWGGRVGHRLFFYLYVLWAVLSAGVGNDPVILSGTAFLAYMTRVSSNIVHPRAWIHSQFALANIGSAILVTSNPTNLVLAGAFQIKFIEYTAYMIVPVALTIIVLFPFLLYIVFQDEALIPQSIKMHDLSEEARARKPVNPNIPNARGAADEAEATDDNDKTKLLSLEEIMNPFLDKGGAIFGGVIMAATLATVLAINAAANDEEEHFVFYVTLPAAFVMFCWDMAFGWMHRHETREIAARGRRELEVAKREKADRASQGYSNSSDQTDGVLSGALVDEDTHGQMSDKAAFEMGAIDPESKATMSGPGFPPPTLVVSQEGDAVPDSVPKATEEQHSTPNKDLVQGDNIATQSSTRSTDETPSQETTTEKTSPQKPPRERTSLDSLLRKAHRWAQETFPTPMAVLMHLPFPLVPFAFAMFVLVQALVTKGWVPVFAHGWDHWVQKTGTVGAIGGMGFLSVILCNFAGTNIGTTILLSRVIQAWVEIHRSGNNNRPITERDFWATVYSMAIGVNYGAFSIAFSGSLAGLLWRDILERKHITIRALEFARVNLPIIAISMTVGCVVLIGEVYIIYNDGKNYVVPES

SEQ ID NO: 4058 - protein, 175 aa, Unknown
  Kingdom: Fungi, Phylum: Ascomycota
MPTKPHSTTTRLRDTCEKPDINKYHFFEVERSKIAMAPRKATDTEGQPTGLTTAENKFIKTMFDNMKTRPDADWDKVAEQMTLKDAKCAKERFRQIAQRHGWNNSGPGKVTKKPATGAGRKKAVAAKQRDDEEDDEEMADSEVKKLVKKRAGGKKAVKKEESGTEDDSLKGEDEI

SEQ ID NO: 4059 - protein, 489 aa, Unknown
  Kingdom: Fungi, Phylum: Ascomycota
MSSTPNTETVTHGSDEVKGSPPASVEAGEVNEKSLLRKIDAHLLPAVGVLYLLSFLDRSNVGNARIEGLTDDLNMTGNEYLTGLTLYFIGYVLFEIPCNIILKRTTPRFWLPTLTIAWGIVATLMGVCHNMAGFFVARFFLGVTESGLFPGVVFYFSMWYKRRERQYRISLFFSAASLAGAFGGILAWGIGHMRGTVWTNSWRWIFILEGIVTVVIAFAAYWFIQNYPDTATFITPTERSFIHKRLAADSDATNDEKFTWGNVLSALKDPKCWLYGIGFHTMSLPLYTLSLFLPTIIRDLGYTAAIAQLLTIPPYAFAFITTLSIAVISERQGQRALFIGGSALFAAIGYIILLTNKDPISKPGVSYVGTFFAAGGIYPATALVLSWPAINVSGQTKRAVANAMQITIGNLGAVLGTQLYRSNDGPRFVVGHSFALGYLVANVLLCATLRWVLKRENKRKAEVTPEQATAFGDITEWPGDSDPRWKFEY

SEQ ID NO: 4060 - protein, 445 aa, Unknown
  Kingdom: Fungi, Phylum: Ascomycota
MSTAFRSITPFLRTARQGLRNGSANPLQYAMKKQTTAGALNIYRTYAVFERTKPHVNIGTIGHVDHGKTTLSAAITKRQAEKGFANFLDYGAIDKAPEERKRGITISTAHIEYSTENKHYSHVDCPGHADYIKNMITGAANMDGAIIVVAASDGQMPQTREHLLLARQVGVQKIVVFVNKIDALDDPEMLELVEMEMRELLSTYGFEGDETPVIMGSALCALNNQRPEIGQQKIDELMAAVDEWIPTPERDLDKPFLMSVEDVFSIAGRGTVVSGRVERGTLKRDEEVELVGKGVDPIKTKVTDIETFKKSCEEAQAGDNSGLLVRGVRREDVRRGMVIAKPGTVKSHTQFLASLYVLSKEEGGRHTGFGEHYRPQLYLRTSDESIDLTFPEGTEDASSKIVMPGDNVEMVITMTHPNAIEAGQRFNIREGGRTVATGLATRIIK

SEQ ID NO: 4061 - protein, 192 aa, Unknown
  Kingdom: Fungi, Phylum: Ascomycota
MIFNNLSFTAVMAALAFSQGALGKLVVTNHCDKDVYIRTSQGKDCEKGKGGCLIDGFKPWKVPKGKHTWSHKWAGMSVSLKIAKDGEDGILQYEYSHEDAGFWWNLSDLDGEGPGLVGTPFRADNVGITPSGHGHMIGDCVDIRCKANEVCLDSYQHPDDWKTRWCPADTGVVHIDLCMPQEDFVEDGIWKM

SEQ ID NO: 4062 - protein, 486 aa, Unknown
  Kingdom: Fungi, Phylum: Ascomycota
MTNFRSKLRDSSLFVEGSYIRGEWQQSRSKRTFEITNPATQEVIGVCPESNVDDLHSAIDAASAAFPLWRAQSGRARGRIIRRLYELMVDNKADLATIITAENGKAKPEAEGEAAFAAGFFEWFAEEAPRLYGNVVPHSNPSFRTQILKQPIGVCGLICPWNFPLAMGARKIAAALAAGCTLVLKSDGLTPFSSNALAVLAERAGLPKGVLNVVTSLQDTPELGLAMCDSEVVKKISFTGSTRVGKILMKQSSETLKKLSLELGGNAPLIVFEDANLDIAVSSTIAAKFKVTGQTCVCANRIFVHSKIYDEFSRRLVEEVRKFRVGKGDEDGVTHGPLTTTTAKVEEHVNDATSKKAKVLLGGNALPKLGKNFFELTVLGDVDDSMKVMSEETFGPLAALARFESEDEVIARANSVEVGLAAYVITSDLSRYYRVCERLDFGMVAVNTGVISDAAAPQVPNPHLTTVSWFANKFQIWWCQTLWLRP

SEQ ID NO: 4063 - protein, 323 aa, Unknown
  Kingdom: Fungi, Phylum: Ascomycota
MVLMPPYASQYSPSLKKMDYARANRRKGIQMGNVIGDPFALATISIGLLAWLIAFIGTAVTQVEVPGISKFPWWAVVYTLFLNIGVFIVVASDTVHTYHVAVSSYSAVGLVLSSTAVNSLIYGDRASMQAAGAGYILLCIITIAWIFYFGSTPSSTPRAFLDSFALTKESATLHRQTMNAYGGTGRPETSNSVQPPQMYTSAQLNGFENPSPIGNGPGMNMNGPRSSQLNGGFNNPTPTGPSPPAGPQPTKSPGADTEVVPPTEYPYRAKAIYSYEANPEDANEISFSKHEILEVSDVSGRWWQARKESGETGIAPSNYLILL

SEQ ID NO: 4064 - protein, 1069 aa, Unknown
  Kingdom: Fungi, Phylum: Ascomycota
MPYDVNMSYTNQHAYEMVSEPRPYIDPQPYSNAPLSNSQKGDAEQGIPAGRYLTGIRLILICTSLCLCIFLATAEIAIVSTSLVTISSELHGFDRSNWLITTYLSAFTGFLLIWAKVGNGIGLKTGLISSLVLFLAFSAGCGAAETMDHLIVFRALQGVGGAGLMVLPSTIFFQLVPKSGYSTMNALLSCSMAIALVVSPLIGGGLSNGNNWRWIFYLNLPIGAVALLILILALPNRFPRHLDATAKEPTRRSFWSATGTFLWQADIVGALLLLSTVVFLVAALEEGGTVNYSWDSAFIIASLVVSGCLLVGLLAWQWWASRDSTTAVPSFPRTFTHNRILLSAVLGAFLVGAPMTISSIQMPQRYQLVNAQSPLDAGVRFLSYGVPFPVGVVTTSVLAGKVRVPFMYIIAAGTALQIIGFALLSTTPSTLDIWAGQYGYSFIAGLGVGITGGVYHFLAPLTIDKEEQYLSIGAGLQARMLGGSVGVAVVNSVWLNYVRHELDSTLSGTEVYLLLSDISNLRRFSLETQEVIRVVLSDAYNRQMLVATGVQLLMNIVGKPEDWSGHRRRPIRGSAGRPEAKAEAELGLVTLNNDQTEDSCLKNHPVASQPGAQAAHNGQIHDVNTLEKGDYSPASNSDGPSSYKPALNQETSDDAPDAYPEGGLEAWLVVFGCFCALFSIYGLINTSAVFATYFKATLLSEYSHSQIGWIFSLYLFMVFFAGVQVGPIYDLYGPRWLVATGCFLIVASLMLLSLCTEYYQIILTYSVVGGLGGALLNAPAYSAIAHFFNKRRGLATGIASTAGGIGGIVFPLLLRHLLGPDGVGFAWSCRILGFIMLGLAIPANLFIKNNPLIRADKDGQAKPSSVWLDLTVFRDARFALAVVGFFFMEWGLFVPLTYVVSYGTAYGISTSDSSVLLSVLNAGSVVGRFLPGLLSDRLGRFNVIIVTIALCAITVLGIWLPAKGSNAVLMAFCVIFGIASGSNLSLIPVCLGQFCESHNYGRYFATAFMMASFGTLSSVPVAGALLEIEDRDIGWNALILFAGCSYVVALVCYVAARVITVGWLPRTKF

SEQ ID NO: 4065 - protein, 872 aa, Unknown
  Kingdom: Fungi, Phylum: Ascomycota
MQPPPRSQARQPGSFSPLPPAASHGAPPPTRPPPPRRVESSESDDSGRMAPPPPINVQKGRQARDGSPVTPIYTQFANSSSASLGGSHQNFSRPGGGTPGGPRAGAVASSPIIRGHTRKHSATPGLFEPTLPSTNTSNLSQVSSLTASQIAAQAAIMSHQNSQQQSVQQQQQQLQQQQRYQQQQSQQQQYQQQQYQQQQQHQQQHARQRSQTVPFPGDAYEGVRRGSGSKAPLSPPTLSLTEASAPRESAFNHHGSQQAERPSGGSHSLAATAAANVVFPRSGHSSPREPSVSPQPFPSMPPPPIPPMPEKQSRSEKAKAKLFSRPSKISTKGESKEKPLPSPGKIGSALSALQRGNFSTSSLLDSSSHSMYNMNNSSSATIRAVDTNTDERGKEKERKHHFLSRQKHKLKDEYHLPLSSAASNSLPTDPNAPSSLYNFNIPASPGPNSSGFAKAKKEKRLGERSDSRLDNESTLGSQSDWPGPSSLPSLSQQSSYMYDPVDPSKLGLQNHMTLDDAFPYLKAKLLVIFEGEDLRLPIEDFNRVVQMHIQFCVQKRSPNLMLEDLRDLLAAGFSSLDRTLRNTPEDRFIPTLVELWLFTFTSILPYMQAIFLPLDLEVAGRGSLMSPEQARDFWGGVIAPTRTRQQRVAPAGSVLDVRRLVLMAYRDIVILPRYDTLKTIFSRLSLEFLPSSLANMALASPIPEAAALSTSPSESWSSMARPGTAMSLDPSVASYNSTSSTLLGDGSAGGRSRAISNVSFGSHGSDSVLRPFTPGGGGSSVQQVLGSVREQNVEDSKQVTDMVGRMLQCMSVLSSLGGGGDAGEEGNNARMEELCKMLKLNWLGRGRTGGNRRGMVGGRVKRDEIREEVRVS

SEQ ID NO: 4066 - protein, 417 aa, Unknown
  Kingdom: Fungi, Phylum: Ascomycota
MGGGEAIPGFPHPNPVESYWQLPPHHLAEHRTTRDLPTAQTWDYVIIGSGITGAAVAYKLLARDPALKVLMLEARTAASGASGRNGGHVRAGWHLNFSRNADAFGDDVALAFERFESDNVADMAAFVRDNAVDCDFCDVETADVYTDGAAWTAALNNMQRREEAMRHQRPDDGEKRDKRHVLEREAAQARIGLPTAVGAITYPAHTQNPYKLVCRMLELCLGMGLDLQTCTTALQVLPTRLEPTGTGSAQGGQVQDSVETGTGTWTVVTDRGSLRAHKVVLATNAYTNALHPRLRQTGFLVPARSQVSAIRPGSNIANHPVMTNTSVALNDIGLGDYFMVRDAQHSGAGDILYGGGRIISKSLNTVDDSILDEHVATYLKHAGSSVFGSKAWGHQGCPSEKTRFHTVAGGDSGWQSA

SEQ ID NO: 4067 - protein, 361 aa, Unknown
  Kingdom: Fungi, Phylum: Ascomycota
MPRALTLKKIDGKPGEVYYPIQIKDVPRPKPGDGELLVQLSAAALNHRDLFQRHHQYRAISFDNPMLADGYGTVVEVGPSVKRSDLLNRPVILTPMRGWDSDPVGPEGLMGVTGGTTITEVGTAQDFVVVDEEEVMPAPEHLSAVEGAALPLVGITAWRALVTKAACTTPGKNLLVTGIGGGVALQTLQFGVAFGLNVYVTSGSQEKLDKAIAMGAKGGVIYRNDAWEKELKSILPKDRPFLDAVVDGAGGKIVPKVARLLREGGVIAQYGMTVAPKMDWVMPAVLANIELKGTTMGSRREFRDMIAFVNEHKIKPVVSRVVKGLDNIEAIDGLFEEMEKGQQFGKLVIEIDGRSGSPSKL

SEQ ID NO: 4068 - protein, 319 aa, Unknown
  Kingdom: Fungi, Phylum: Ascomycota
MRLFHHFEIIFQLLVFLLIIMATNSALRRALHSVHLTAHEENLLFASRNVILHLATPLVTRMGITEKYSEPLQFLDLACGTGVVTDIVQKRVLPETLSRSKFRATDASEVMLGMTKKRVELEGWTNVETEVMDAKNMKYPDASFTHVAAALALHIIPEPDQVVKESMRVLKPGGIFGATTFSEANSNKWFAPDLDSAFRSLPFKTPSLLPAKMQIHDDGRWTDASWVESNLKALGLADVTAEEVSGTYHFKDAEEWMKVFEVMIMWTINSRWDEEMRKKMSVGEVKERVLKHLKEKYHGEGWDVDWTIIVMTGRVPALN

SEQ ID NO: 4069 - protein, 998 aa, Unknown
  Kingdom: Fungi, Phylum: Ascomycota
MAHALLLRTDSSTAFNTFPKNVGSGPQPSMNYAPRASQLSGSTAFAGSSSSIASTNTTINGGNIVPTGNIINQKADASRSLYQICVSLKQRLSLVPGFEPYLQQLDPLDPVDPLWNLLRTGYPLLAIYNALQPTDPLKVEDSASEAKKPKIAIFRFVQACMKELKVASADCFVITDLMGNDTSGFVKVIQVVNHVLDIAEQRGLLMQSQPYPEDEGLLPVVGATMSYRDHIVKELVDTERKYVQDLENLHDLKKTLEQKGDVTGDVLHQIFLNINAILDFQRRFLIRVETTNTAAVETQRWGAPFVMYEEAFDIYQPFIANQRKAAHVAQQVFDKIQMSAHPVAADFNTLDGFLLKPMQRLVKYPLLLKDLAKKTENEDIKGELIAGCEAAERVLYKANDAVNRDLLDEALEELIVRVDDWKNHKVEQFGSLLLHGVYGVVTGKSDQEKDYEIYLFESILLCCKELSPGKSKDKKDKTRSQGPKVRNKNAKLQLKGRIFMTNVTDVVSLSKPGLHSVQIWWKGDPGVENFTIRFTNEEAMKKWAQGLDIQRKENATPRMSAASPDAIAPDFAWTQAQAGGLENPYLQQDEDDDDDHPNGATPSQFPLPRTGSSFNLRQRSMTSESSQSLASIARAPAPRFPLPAPPPPLSLQTQNSGADSPGARAMDSYFSPIDHSPASSRTSTASGAFSSQGYNFPKTATPQPMWDDNNRYTAPAMPRAPSRDGPSPNPQTMNGRNPRGPSLPAMASRNSDAQQQRSRSYSTPDINAQQGNQPRSRQPSQGHIPAVPGIPSHLHPAHDSAIPRSNTGSPRNDIPIRSQTQSPGMQRERMHGHSGSLGGQMTQFPSQPVYSRSNTPGPPGLRVDSIAANSRTVSPALGTATLPPPSANSLASPDMPLPTQLKVRVNCDSGNYVTLVVAFNITYQSLIDRIDAKLARFTASSIGKGMLKLRYRDEDGDFVTIQSDDDIQIAFMEWREGVRNMYSGGVGEIELFCVGDTS

SEQ ID NO: 4070 - protein, 167 aa, Unknown
  Kingdom: Fungi, Phylum: Ascomycota
MSRFSRYDTDEERLPEGMTRVAYDSDTQIYTFQDADGSYWESAPGNQYGQLTRAGQEAHQSFHYSEAARPRPSWRRDMMPMLQFGVIIGVFLLFLFWFLRANAGHSSIVRCTEGTNKYTIKPDDTCWAIAQAKGIDIKDILTYNKGVDCENLVIGSAMCLPEPSSPI

SEQ ID NO: 4071 - protein, 584 aa, Unknown
  Kingdom: Fungi, Phylum: Ascomycota
MAYASLAKLNPEFGLYSSFVGVMIYWLFGTSKDISIGPVAVLSTVVGNLINQASASDPEAVPFVIAATLSISTGVVVLLMGLLRCGWIVNLVSAPALAAFMTGSAITITTSQIPSILGLTGFSNRRSPYEVFMNIITHAGEADTNAVLGISALLILYGLRYAFTTAAEGSEKHKQALLLLNSMRAVAVIVVYTMISWLVHCYSTGAPGFEVLGAIPRGFQHFGMPPVDSSLLTTILPYVPATIVVMLVEHTAIGKSFGRANDYTIDASQEMIAIGVTNLVGPFFGGFASTGSFSRTAIQSKSGARTPMAGVVTGLVVLLAVHLLTAAFYYIPSAVLSAVVVHAVGDLITPVTTLRQYWAVSRFELLVFLVGVVTSVVKSIETGLYASVALSTAALLYRSIPSGLKKPSNATASVTEGSGKRRYGTFEDHKNHVEVREYALGSCPPSRTSSPTRPGVVYHRIPASLDYNTAARFADDLIQNVQTHTKRGSEPQDQSWSTIGDRKQLGSGQQNLPSLKAIVLDFSLVQNIDVTAVQQLFDLQKQLEKYARPDTVEWRFLRVTSEQVRSALHGVSIIKVGDIEQAHP

SEQ ID NO: 4072 - protein, 541 aa, Unknown
  Kingdom: Fungi, Phylum: Ascomycota
MATDAKGLEHGVIKDDKRGSSGDDDLVHGGHASPQNGSIIDAQEFTYTEDRKIGVTGAVFLILNKMIGTGIFSTPSGVFAATGSVGVSFMLWLVGGILTFCGLSIWLEFGLALPRSGGEKNYLERAYKHPKYMMTCVLASQMILLGFSSGNALAFGRYALFASGSESPDGWAARGLGVACVTFAVLLHSTFPKWGVRLFNVLGVFKVVILLVIIFAGFAALGGHRRVPDPKNFENSFAIEEGEGYGGGGAYAYSNALLNVIYSYKGWENANYVVSELKNPRKTLAIATPIAIGGVTILYLLANVAYFAAIPKSDLATSEVLVAGLFFRNVFGNSAGARSLPVFVCLSNLGNVLAVSFAHARLNQELAKEGMLPFSRFWASNKPFNAPASALFLHWLVTVIVLLAPPAGPAYNFIVSLYTYPGVWINTFVTFGLIYLQWSKRENWTSQWHTYLPISILYILANIFMIIVPFIPPEGSWNADGYPYYVFPIVGVGVLLLGVVYWAVWNRLLPRLGGYKIVAERTFDETGGEVVRYRKVNVKHD

SEQ ID NO: 4073 - protein, 411 aa, Unknown
  Kingdom: Fungi, Phylum: Ascomycota
MKSQLSTLTRDQAGLQLATLTISLFSFLSIELGFRPLHQTLLTNDLGFERPVRICFSLVSSFRGELLLSTKVIIIMALCPSARWQKLCCSGSKHVIRSCGFTAGAPAQRISTQQRRHRSGPRQSSALSKSTFHINEDGFEPEVTTPQTNRQIVKARQFFGRCEFLYSAAELRQHPVNDHAVPEILVMGASNVGKSSLLNSLFGRRDMARASKEPGKTTLMNAYGVGKPVSQLTGGSEFDPKAPKHGLILMDTPGYGFGSRNEWGQNIMTYIEKRKALRGALVLISAEKKFNDEDRWILRQLASASTRITVVLTRADKLGGGLEQSCMNLASQLWRTAGNLERSLSLKVPIDIYAVSSHSIGQGDSGGIGGLRPAILDMAGIALGETKVEQTKESIQYTGKVVSFDDIQWKT

SEQ ID NO: 4074 - protein, 157 aa, Unknown
  Kingdom: Fungi, Phylum: Ascomycota
MSDFGDDPIGNDGGDEPTYEDDELNEYYDPEVGEFDENGNQRNGDDEDNVVTSGDPSASAAAGLKGPGGIKDKKIPDDERATTPMMTKYELARVIGTRALQISLNAPVLVDLEGLTDPILIARKELKEKKLPLIVRRYLPDGCYEDWSCEELTLPNL

SEQ ID NO: 4075 - protein, 466 aa, Unknown
  Kingdom: Fungi, Phylum: Ascomycota
MDARRSSSDEDGPSPSSADAPSPPERRRTSMDEDFLYRRIMTSAPAPRPSRPPPYEQKHAVPHAAGNGSSRPSWLGGGASNRNESAIIEDTESIIDNLPRYSPSVAIEGVFTKKHEIENTIKRAEDRHWHTRFVTLNGTALNIYNAKKDWGWGRTRDGPSISPDNPPWIRKGKLEKSYSLLHADAGIAADYKKSVHSGVEASYRQELTMGRRRYVIRIRAEEDQFLLCCIELETFVKWLECLFAAIDVAAPIDDRDFPRDMSIPRMQRIRWFRGQSPVRISPEDETREIGPGQDQAEAAPIPMPTVPPPRRRRSSTPEPLPSAELLTEATETALSREEPQSEADLDSEMHHAPGDDPGSIPHIAPRIDPPHRLSTSSYPNPAINPHSGKWFPEHNWSSAHDLLYAKLCYSNLLFRSPRKSNYIISKGKQWYVDWGTGRMVRVLPPTYGEIDYFGAWQTVHTENRRI

SEQ ID NO: 4076 - protein, 519 aa, Unknown
  Kingdom: Fungi, Phylum: Ascomycota
MGVSTRLTIALTMGCPCICSTIPPQELLSATVVVSSGHFPSLSPSSSHYRPVPLRTRATVAELPPPHPASASAYINTRLSLLSSIPSSPSPSHHHRCIHRRLQSPPRRFIYTRASTRPGGLLPNMKSALLTAAALVGSAQAGVHKMKLNKVSLEEQLASYSVEQQVQGLSQKYLGARPTTRADVMFNAQAPKADGVHPVPVTNFMNAQYFSEITIGNPPQSFKVVLDTGSSNLWVPSQSCGSIACYLHSTYDSSSSSTYKANGSEFEIHYGSGSLTGFISNDDVTIGDLKIKGQDFAEATEEPGLAFAFGRFDGIMGLGYDTISVNKIVPPFYQMIEQDLLDEPVFAFYLGDQEGESEATFGGVDKSRYEGKIEWIPLRRKAYWEVDLDFIAYGDEIAELENTGVILDTGTSLNVIPSSLAELLNAEMGAKKGYNGQYTIECEKRNSLPDITFSLSGSNYTLPATDYILEVSGSCISTFQGMDIPEPAGPLAILGDAFLRRYYSVYDLGNNAVGLARAK

SEQ ID NO: 4077 - protein, 305 aa, Unknown
  Kingdom: Fungi, Phylum: Ascomycota
MAHLTNPLATPAQLYNRTSLSSLPQDAQEGIFIATQCLTQAAGMLLELPQSVTAQANVILARYWLIESLMAHEFSHVSAACIFIVSKMGPIPQSPRDISNVYGYLASRDSALFKTESTTTNDPKSYYQSEVDHYRFHKDILALEPRILYALSFDTHVSLPHPLAITYLQTLDFLAQPKDQISKCVVQYLNTALLSPQLLYLTHQPNALATAAIYAAARDIGAKMPESAWWEVFDVDREELGFLVAAYRSLEGWMRARKEELPWVTEGVVTRQTVRAELKKKSLTLGSDDQVVDEEQAMMEMLDKR

SEQ ID NO: 4078 - protein, 553 aa, Unknown
  Kingdom: Fungi, Phylum: Ascomycota
MPPLRSSRPQECNLAAWLAYPLLCGALFQLSESSSSLAASCVVNFTLFGNTQLYVNWIEAQPKMADQETLHREQLANDQQQTSQDRSQGENATTENSVILRSQATNNAWWSRWRSPLLFAGLAFLFTPLTYLFTGEGPVDPTNFAERTRRVLKTVPLIDGHNDLPWQLRIELHNRIYDNKVDLTQRLLGHTDLLRMQQGQVGGQFWSVYVDCDTAQKHFEDPSWVVRDALEQIDVTRRFIEQHPKHLSYCDNAACVKRSFRAGRISSMIGIEGGHLLGGSIAAIRQTYNLGARYVTLTHNCDTSWGTSASTVAAGHPDKGLFALGYHAVKEMNRIGMLVDLSHVSHQMMRDVMGVVRAPVIFSHSGAYSVEPHLRHVPDDVLRSVKKNNGIVMVTFVNRFLNMKNPSSATIHDVVDHIFYIAELIGWEHVGIGSDFSGTPHVPIGLEDVSKYPDLIALVMKRGATDEQIRLLAGDNILRVWTEVEQKAKEIQATGELPVEEEYEDKKWHKGLKDSPWMLRQSREKAQKSGAADQPYMFNVDDEGKHNPLVKNP

SEQ ID NO: 4079 - protein, 106 aa, Unknown
  Kingdom: Fungi, Phylum: Ascomycota
MASVFAIGAGAAVAAFLGRAGLVAWRRSRGGVGAMGKAFYKGGFEPKMTKKEASLILSLNERAMTKDKVRKAHRTIMLLNHPDRGGSPYLATKVNEAKELLDKEGR

SEQ ID NO: 4080 - protein, 271 aa, Unknown
  Kingdom: Fungi, Phylum: Ascomycota
MVLAAHPNPTSPVLSHFSLEGKSALVTGGSRGIGLEVVRGLLEAGATVAFTYSSTKSDEITALTSTLSQENGGKTVKAYQCNVTDCAAVNSVVQQAANEIGGGSLDIVVANAGIADHIPAEDYPEDKFRQMLDVNMNGAFWTAQAAARVMKGKKTRGSIIFTASVSGILVNVPQTQAAYNASKAGLIHLAKSLAVEWTDFARVNCVSPGFIATEMLDVHPKEWRDKWFSMIPGARLCLAPELKGSYVYLASDASSYMTGANLVIDGGYTLP

SEQ ID NO: 4081 - protein, 493 aa, Unknown
  Kingdom: Fungi, Phylum: Ascomycota
MATRNPLITWLRCLFDKDRHHATKHTKKQRKQARLQTDTSDSDTFISSLNGPDPSPYDKIKPELPKVDRPSIAIIGGGIAGLALAIALTKRNVPCTVYEAGESLATVGAGIGLGSNSLAALDLIDPRLRVLYDLAKTGNERDAFKNCVFDALLAEPGLGLYREPSWKRGIVSAPYFERSSAHRRDLLNILESFVPEGTVKFSRKLSKATQLPDGKVEVIFEQGETILVDAVIGCDGINGASRRAVLGDIAPDAVAPTYCNMYIYRGIVPMPDAKSILGEHGGDSKRFMGKRRGAVVYPIARGCDANLMFYIRDDGEWPHGSRTVPCTRQEMQKDFEGFDVRLLKLLETVEPVRWPVYTHRGTPTYYNKRICLLGDVAHATSPHLAAGAGQSLEDVVVLAHLLALVNKPEQLETALQVYDSVRRPRASAVAESSYRAGLMYCFEGPEGDDMNKVVGEANRLFREIWEHDLQGDAMEAEKMFMQRDAESKTLEKS

SEQ ID NO: 4082 - protein, 629 aa, Unknown
  Kingdom: Fungi, Phylum: Ascomycota
MDDVQMSLLEMSANVQKTASLKRSHDDFASDDVVKSEHEHGLLTKSSSVDRAPPPTKTNAAGQPSPCLSPGLTDGGSSTPARQSPSPLTPSKGEQSQKNGHPDGSTPASAKAAPAQATNNGPAPKRKRLTAEEKELREKEEAEKKKDREEKLRQKAEEKAKAEKEKAARAAEREEKRKKKEEEDRLKAQQRDEKKQQKEDEIKRKQEAEEKKAKSQPSLKNFFGAPRVPKSAAATSSSSPQKAAPSSSTSTKTSISEYAKMFQPFFIKENTRMAGPANQMDDETREVKSRILDEYISGQRKHTLSPFDPVRLFELPARPPRRGRVHHPVRHIMETAYKAMETAQGSGGSGADVIMREARCKLAKVPIKVIAFSRDVRPPYYGTATYKPFLLGKPNLRVLAQKPVGRTLELDYDYDSEAEWQEEEGEDVDVDDDEEELDDEDDMDGFLDDSEDAGLARRIFVNTMEPESTGICFESDQRPDPILQEHKMEYIHEDMLQSDKPIDPWSTTYWEPEPKKTTVTKAIPQPEQASTMAPPPAPANAFAALSKPAAASSEGIKLVKDEIIEDVKRAILQNKLLSKVGMVDVVYQQFRDRSSRAEVKNTIEVVAEKKKGANRLKEWELRPGHELKL

SEQ ID NO: 4083 - protein, 626 aa, Unknown
  Kingdom: Fungi, Phylum: Ascomycota
MAQPQHQAPPPRAFSPAQHSPSPAASQSAFALPPNKRPRTDGAPSQPDSPYAGSPYAASPVAVGTPPTATASPTYPQGANTPTAYSTPYTNGHVTPGLNLPNSQAVGTPPLHTPQLPQQPQQQYTAATMAPLPHAATPAQAAGVMGPPQRPADRATKDYQYDPMDSLAGTGIDLSAEEKYMSELYATSFDTEARTGFPQNQPTSKGSFYGAGQANQGAEALAETEQEKVARDAAEKAWSESSMRLAVTRTQEVKDPFLLVALLHRRADKIAREHSIGLNLEYKNNVPTMGKMKVPEQSPPKVIVTTKLGPDSTATVHTTGSFIPHDAYLVDQLALLSIASKHRVRELLEDVSLVANSRQKTSHGEVPEDWAVAAAPSNRDPIGDTVDGNAAVESAPSPGTNPLKRHANGAMPNGTSASKMPKIASFMTATMREQAKKEREWEEARLRMRQKRKDGITDGGPSASRANSVAPATPGSVAPEPEKALTKKEMKKNQQMKAAEAHSHANQNMTSSMFAGLGGRSGLFGKKKSGKSYDWMNVGRGGSGTSTPSKGGGGGGKGLGAVPGSPAPGNMAMTTEGRNRLGTWREDKEKGKKIQLRDWVTVLERDGREAKALQRAYLALDLSDPR

SEQ ID NO: 4084 - protein, 467 aa, Unknown
  Kingdom: Fungi, Phylum: Ascomycota
MSSRHSAARPRRDGENFARTHHNEADDADPKRVKFDVRNPSILAADAREDDAILDADVIGGSNATKRGAVNLDGYDSDSDNENINVRANNRKKGNVDILEKLDNYDAKSGGDDGQATKPDEDDDDDMFAVDGDDEAGKAEDNGDPSEFDESGRKKKTVQFLDVAEIAGQDFNSKTGSTVRIDDQESSDDEADVELAIQEEDVDEEVGAGGLKRNAPKVEAFNLREEMEDGQFDQSGNYVRKAGDVDAVHDTWLQGLSKKEMKKAADAHQKREAEARKQRFEDDAVQISELLEQLIVRLEKAETPLEALARLGKGQAKTKKIPKWKLKKKGAMDVDEHKDEIEQDPAQARIKEAIDTITDAADKLLSRDYEDIYDQERELLIRAYSKETGEDWVEPKAAQASTEDEGPASDDVEWEFRWTDGRDGGGTQGPFKGQMMKAWQEAGYFGEGVEFRKVGDGNEWSRAVSFA

SEQ ID NO: 4085 - protein, 245 aa, Unknown
  Kingdom: Fungi, Phylum: Ascomycota
MVLHALQPCNSKPTFHESYEDPTFTPDFTETEFGRAIVSPDTPYVAFAGRHHLYYIDTRFSPEDAAHIKAQVEHTWRMKGDEYTKIDEIDATAEVRNAAGESVFVFDAPYARVLFADFINRHNPDIKLTEHGPGGDRLVPYQLASDGTLEKKAKSSSHGSETASDCTRPPDSVCGFCKKPRVDDVFASSQTNSVGTYQPLRARKVDTPRFEAETDADYYQRMDKLHWGDKKVRIPGTEEHEGRDR

SEQ ID NO: 4086 - protein, 271 aa, Unknown
  Kingdom: Fungi, Phylum: Ascomycota
MPTQMAKRLHGKTILITGASSGIGRSTAFEFARTSPESLKLVLTARRIDTLKQVAEDIVKEVGSGVQVHPVQLDVSKPDEIRSFLDKLPAEFREIDVLVNNAGLVKGVDKAPEIKEEDMNVMFATNVTGLINMTQAVLPGMLARNNGEGSGDIINLGSIAGREPYVGGGIYCATKAAVKSFTESLRKELISKRVRVIGIDPGQVETEFSVVRFYGDKAKADAVYAGCEPLTPEDVAEVIVFAAGRRENVVVADTLMFPNHQAAATIMHRKS

SEQ ID NO: 4087 - protein, 215 aa, Unknown
  Kingdom: Fungi, Phylum: Ascomycota
MPYNTSAIPPRDEPTGTTQLPLSRVKKVIAQDSDIHMCSNNAAFVITLATEMFLQRIAEESHNQAKLERKPRRNVQYKDVASAVSSNDHLEFLEDVVPKTVQYKKIKANALVTQARLNGEQPLDMAGSSSVTATGRPSTAKSNGIASANTSPKMIVNGETPATGTFSVPPRVEPDVSRRVSIGAVMAEDDPSQQLAMEMRQAAGSGRDGDVQMTG

SEQ ID NO: 4088 - protein, 378 aa, Unknown
  Kingdom: Fungi, Phylum: Ascomycota
MFGTLPDFTPRDSHSLWYTSTRNPGPPPGLLESLNAEANANGQHGAQARQQQRDHHKLLERTALARLAADEVYMHRRRLNIQNFGSGWLKPPGIPKTLHQLREEKREQEEHQEAMRREQLQQELAEAEAGGPPADEDGIMDDVQLDGAHDLDDEVPEADDFGMSDDDDEEETEDEDEDEDAEDADETGNVDEEHLREERQNELMAARVRSNNDAFREAIVRGDPDGDDMYGGAEELVEEDQGHMLDEDDFAENSLLPPGSMLNDEDMGVDLDDEIPEAESEGYEHTDSEAELSSDEENSEEEENDGEEEIGFAPRAALLAPPRSPTLRGRDHDHRTSASGPRASMDLSGLLSQDESSFMESSPAAQGRWAQGRHRHDI

SEQ ID NO: 4089 - protein, 612 aa, Unknown
  Kingdom: Fungi, Phylum: Ascomycota
MPSYTKLADDITEVDVIIAGGGTAACIVAGRLADADPGLSVLVIETGPDNRGVETIENPVFFLDHLVPTSPNTHFYKANKAEQLAGRECVVPAGGCLGGGSSINFMMYTRAQRHDLDSFNTPGWNSEELMPYLKKIERYLGPGSKDVHGDDGPVTVSYGTFRSETAAPEFIRALDTLGHRTVEDLQDLDTNNAASTWLRTVCPDGKRQDTASRYLHKKMDNPSYPNLHILTESKVVRVLLDDSKRAVGVEYTPSSGHQPAGLSTSTPTSPHKQIKARKLVVVSCGAIGTPPVLQRSGVGDPAVLKRAGIDVKVDLPGVGTDYQDHHLILYPYVTSLPAEETIDSILRNPASRPELFKKKDPRLGWNGIDMSSKLRPSDEEVKSLSPALQKRFQDDFQNEPNRPIMLMAMVNGFLGDPMSVPEATYVTVGNYTAYPYSRGHVYVTGPNADDPIDFDCGFLNDQDDVDLEMQVWAYKKSRDAIRRTSMFRGELAAGHPAFSESSTAACQPASGPSTEPIKYSAEDDKAIAQWVRENVNTTWHSIGTAKMAPQSKGGVVDKDLNVHGTSGLKLADLSVLPMNVGANTNNTAMMVGEKAADIIIKELGLQQPTARI

SEQ ID NO: 4090 - protein, 328 aa, Unknown
  Kingdom: Fungi, Phylum: Ascomycota
MVKNVLITGAAGFLGPKLAIRLLGDPSYRVFLTDLNTPSVPSDASNPDNCTCIQGDLCDPSSVSKLLSAAPEWHAVFIFHGIMSVGSEENPALAERVNLGATQALLKAISDLGAQSGKKPRVIYASSQAVYGPPYTTSGPITDDTPPTPAGVYGTHKYMMELYVNDMHRRGRIDAFSVRLPTVTVRPGAPSRSAAAWLSGILREPLAGLECVVPTRDRTIRNVICSPRVMIENFVRLMDAPSNAMPSNVRGVYAPGIVVTVQEMYDAFVKVCGEDKLKLVKEETDEEAERLLKGWPQNAEFGNAKRIGLLFDETCEQIFLEYVESLKK

SEQ ID NO: 4091 - protein, 257 aa, Unknown
  Kingdom: Fungi, Phylum: Ascomycota
MQKSLLVAVLFSVLSSVQAVPPDGISKRDIITPLPEGADEQELKFQPGLDFDSDGCYNTAAISPDGTTNPGKKATKRVEGECRGEDQLNNSNTYSRKRCNNGYCAIMYEYYFEKDQAIGGSFLGGHRHDWENIIVFVKGNSVMRVAPSCHGDYENARNTFAIQGDHPLLVYHKDGWGTHCFRHANTDDQLNIENPFGVWYRSPLVGWNNWPSNDLRTKMIDTYDGSATVKLRDDRFGNSLKEAAGDSVPGFDPFSDE

SEQ ID NO: 4092 - protein, 601 aa, Unknown
  Kingdom: Fungi, Phylum: Ascomycota
MPQSTSSIFPPASADPFKFPSRRSVVHSTEGIVACTQPLAAKCGLEVLRAGGNAADAAVAVAAGLNMAEPCSTGIGGDMFILFWDAATKSVKAMNGSGRSGAKCTLEAIRKDLNLDGSAGGDIPNSSVHAATVPGAPAGWVDTVARFGSGKVSMAEILAPAIKMGEQGFPVSEVAAVSWNKSEKLLRNASPNFAEMFKVDPKADGGVRPPGAGELMKNPTLAKTFRSLAENGKEGFYTGRIAEEIVKVLKDLGGLIELEDLKHHMDTGSEPVEPISLKFSGQGLGDNGLELWEHPPNGQGIVALMALGILQELEKQGKIPTFGPDDFNTTAYLHAIIEALRLGFTDAQWYVTDPNVTKVPSQGLIDSEYLGERAKLFDASKVMGDLEPGKPSFGSPALRSSDTVYFTVTDSQGNAASFINSNYEGFGTGIIPKGCGFTLQNRGSNFSLNDQHPNKLEPRKRPYHTIIPGMVTNMKDGSLHSAFGVMGGFMQPQGHVQVLLGQAIAGLNPQQALDAPRVCISAGQPNEKGVVDWTVNIEDGVPEKTIEELRGLGHNVKVLTGLQRSMFGRGQIIRYAQDPVDGTPIWSGGSDMRGDGAAYPA

SEQ ID NO: 4093 - protein, 434 aa, Unknown
  Kingdom: Fungi, Phylum: Ascomycota
MTSLGKTDPILILGGGTFGLSTALHLLRSGFTNITVLDSSSALPSSNSAGNDLNKIVRAEYENPFYVDLALEAIEKGWKTPLFASYYHQTGYLMLCSGEASEKPVKSMLKARASVETHPAFKGGIQSAESRSDIQRLAWQLDGPLSGFRGYYNPLAGYAHSANAQRGLTEYLATQGVRFILGNNAGTAKKLLYEDDRCIGVETQDGQTRFASLTVCALGANNASLIPLISSFTTARCWAVAHIQLTDRECDILRGLPVVNVRDLGFFFEPDPATKLLKLCHLGGAYTNTNSEGISLPSTTPVADFVPKEDELKLRQLLREAIPWLADRPFVDTKMCWFSDSADSEFCIDFVSGTKQSLIALAGDSGHGFKMLPIFGRWVVELLKAGKQRREQWRWKQGSGQSHDWGSSVSWRVGEAQELRDVILKEAPRLRAKL

SEQ ID NO: 4094 - protein, 574 aa, Unknown
  Kingdom: Fungi, Phylum: Ascomycota
MDVDTLPREAKRKRSAFDDALNAEPSSAGAVARISNDNGAVKVKTSRPDLKPRLEQKKARRQREADAQYGRGKRINTGSIKDRKLKRNLKKLEGKYQDAALKAKDAEILLENTSGFLEPENDVERTHEVRQQDIIDSVNVETAQKRFDLKLDSFGPYICDYSRNGRELLLAGRKGHIATMDWREGKLGCEIQLGETVRDVKWLHNNQFFAVAQKKHVYIYDRQGVEIHNLRKHRDVTHMEFLPYHFLLSTIGATGVIKYQDVSTGQLVSEVPTHLGQPVSFAQNPYNAILHAGHQNGTVTLWSPNTSTPLVKLLAHNGPVRSLAMDREGRYMVSTGQDRKMAVWDIRMFKPVHTYMTRQPASSVSISDTGLTAVATSTYTTVYRGLFDKNVPVQQRVESPYMRWGGEGRRMERVQWCPYEDVLGVSHDAGFSSLIIPGAGEANYDALEVNPLETAKQRQESEVRGLLNKLTPEMIALDPNFIGQLDLRSEEKRRAEKDLDAGPTDIAEEIRKRARGKNGALSKYLRKQRKKNIIDEKRLKVDQIYEERQQRQKDKQEEKEADLGPALARFARKQ

SEQ ID NO: 4095 - protein, 550 aa, Unknown
  Kingdom: Fungi, Phylum: Ascomycota
MERIEEPDSSRGHPEVVGGELDLSSPAGRSRRQLIWYKRHKRQAQTPTLSESHRRYLEDEGAFLDLPKTTTEALLPIYIALLDDLTPVVDGSRVVREYSNGQASVYLVRAMCMAVCKARQALPFLRITESGPLLEPCKFSDKVLRGLEAAVKADLEPDRKIKVQILALMHLNNDGVGGTDRASNHLCQAISTAWSLSLHWHVPGIPDQEQCRYLWWALRSLDRLNKPVMGAAPFMIDDSDVALHKPSHAGETYRSQIMAVSLSLGDVMKRATKVYKASSTANTDDANDFPSFAEVIGVIPLGTFLRAHRDYLEIWYHVTAMLSCRYSGPGSIPYARRLASADRILEIIGQGGHESLPPLPLVPYAISMSTTMIYRALRDGQRDPERASKDMGQCCGALDGLSRNWSSAKGVAQLARRLEKILSTRDKRRGRGVDDAGAVIEASARLPSNATPPDQVTSMPLAAMITPPQVLPESASFGQQPSPLWDPTTTYTQLDTAFHDLFDYGVPNVFRDTTSWEFLQVGGEGVGIDSTHVTSSDPDVGVAQSWSQSI

SEQ ID NO: 4096 - protein, 412 aa, Unknown
  Kingdom: Fungi, Phylum: Ascomycota
MKLSSIVSAFALATSASALPSLSPRADAGDQQEVAKLTESIRSDILAELDEREEKLAKRGEKATCTAKNVVFRREYGSLSKAERLDYVNAVKCLQKLPPRTPASVASGAKSRFDDFVVTHIQQTLDIHYSGIFPPWHRWFVYQYEKALREECGYKGYQPYWDWAKWATGPQDSPIFNGDKYSLGGNGEYIPHDGPVIVPPPGVGGGNISLPAGVGGGFVKTGPFADMTVNLGPVGGVEGTQPGVDGGLGYNPRGLKRDLGPAMNMRYANYTTVLNLLLKPDLEQYRLLSEGVPYTPEIGPHGGIHYTIRSMMLTPENSGDPGGDLFTSPGDPAFWVHHGMMDRMWTFWQSLDRKNRLCAVSDGDYGHITWANEPPSRKARLTDVIDMGYAGDSTTIGEVMDPLSGPFCYFYI

SEQ ID NO: 4097 - protein, 954 aa, Unknown
  Kingdom: Fungi, Phylum: Ascomycota
MSSNAFDPQDISKAMVTNPLVTLPQSEERREGGGEAKQALATLGCATVIPRDGLSIRDVKSCPGYAASTVEVRDSGLTADLKLAGEACDVYGEDLNDLVIEVTYETENRVHVKIQDNGNQVYQVPESVFPRPGGSASSEASNIHFAYTAEPFSFNITRKGSDEVLFDTSAAEIIFETQYIRLRTSLPADPYLYGLGAHNDPMRLNTTNYVHTMWNQDSYGIPEGANLYGSHPVYIDHRESGTHGVLFLNSNGMDIVIDEDDEGEKYLEYNSLGGVLDFYFFIGDSPVEVVKEYGLIAGTPSMVPYWGLGFHQCKYGYQDAFEVAEVVYNYSQANIPLEVMWTDIDYMDRRRVFTLDPDRFPLPKIRAVIDYLHTHDQRYIVMVDPAIAYVPSDTLTRGLDDDIFLLRSNGSVWIGVVWPGVTVFPDWFAENITSFWNNEFEIFFDEEEGVDIDGLWIDMNEPSNFPCNFPCDNPYESAKGYPPEPPPVREPPRELPGFACVLQPEGTECEDDDGQAKAKRDGGILDGPDFSARSNLLPSTMDLERRQEGEGDQKGLPDRDLLYPKYAIHNKAAFQDSWNSDKGGISNKTVNTNVIHQNGLAEYDVHNLYGAMMSSASREAMLARRPSLRPFIITRSTFPHAGSKVGLWLGDNLSSWDQYRQSIRTMLAYTSIFQFGMVGSDVCGFGSDTTEELCARWTSLGAFQTFFRNHAQLEAKPQEFYRWDSVAESARRAIGVRYQLLDYMYTALWRQTEDGTPTLVPMFYVYPEDKGTWTLENQYFYGEGVLVAPVLGEGSTSVDVYLPEGELFYDWWTWDAIQGEGGAYEVKDVNTTMIPLFIKGGVILPLRENSAMTTTELRKEGFELLVALDNDGKAKGELYIDDGVSLEQASHTLVKFEYEKGIVSVKGEFGEEWPVEVVRVVVLKPDGTQVVVEVGRTFTKDGKIQTKQCRSRHE

SEQ ID NO: 4098 - protein, 733 aa, Unknown
  Kingdom: Fungi, Phylum: Ascomycota
MRLSRIIVSACLGLLAPASAFTERRSDANLLDKKSAGACFGEQPPSIAPHKNFWGSLTKQETRDVLALLHSNETGFNLTDANDAGSHDNKVLSVELMMPNKTDVLPLLSSSCGTPIRYALVAIMFGSPEDAYLQEFKVGPLPITNESAVLPYTYVNTRKDGKIPVVNPDAEDYAEFNLKWMKEAEDVTKKLWNLTVEDGLQMPLAFAAPLTVTEEKVIMWQGFNSPVTSVYDTISLLPLGLYMRSDITGRDPENWTVTGWVYNNVFYPTLDDFRKVVDEPGFKSLGKNVDEPWAHTKTHGEPLPLDDLPPPAPVQAGKERFTVDDQENYVTWMDFSFYVSITKDNGVRLYDVRYKGKRVLYELGLDEAIAHYAQTTGETTYSQKDALCMFEIDKGFPIQRHSWAGHTTVTKNVAFNVRAIYTIGNYDYMTTYQFSLDGSVEISVRASGYISSAFYAQNEDYGFKIHDSLSGSLHDHVITFKADFDILGEANSLQKVAIVPSTESYVWSDGRKHNTMKAERSFIETEDDSKINWSPNGGAMYAVVNKDKKNKYGEYPGWRIVPSSGVAYLTVEDSDVTKNAAHHTTHHMYVTQHKDSELYAVGAYNSLTPEDPQVDFDKYFDGESLVQEDIVVWFNLGMHHMPHTGDLPNTVFSTAHSAITIEPFNYNLGDPSQASTQQVLIKTTDKAPEITRYGAQEATCPIDLAQLNPDLSGYSNTVSVLKYPYDGSKPDRS

SEQ ID NO: 4099 - protein, 325 aa, Unknown
  Kingdom: Fungi, Phylum: Ascomycota
MASLSLLTLLCAVVSAAPHRDIGTTLSVRQAEDACPVGYCTENGGTTGGAGGETVVVTDVNSLTEAADSDGPLTIVISGSISGSAKVRVASDKTIFGESGSSLTGVGLYVRRVNNVILRNLKISGVDADNGDAIGLDNAVNVWVDHCDLAGDLNAGKDDLDGLLDITHASDWVTVSNTYFHDHWKGVLIGHSDSNADEDTGKLHVTFVDNHWQSINSRCPSVRFGTVHIINNYWESLIATGVNSRMGAQVLVQSSAFANSAEKAIFFADSSNTGYVVVDDVDLGGSTNTAPEGSLSPGSLPYPAISAVGSGNVAGTVPANAGQIL

SEQ ID NO: 4100 - protein, 499 aa, Unknown
  Kingdom: Fungi, Phylum: Ascomycota
MAPLTLSHSSAAGLLLGVFQLARPALGAIDADWYPPSQRAVNNLTEVIEADGVYGYIYDTSETPDEKYGTYNWCNMPHVRKKEYVLADEGYELRYVELIQRHHKRTPYSSNAFPVEPYTWDCDDSLLHFYGEPLSSHSAAHAYRQGTISSINPFVPKGWIGSCQFPQITAEGLDDSWTHGKDLYEVYGELLGFLPKKGDEGVKEKVKYRATNNLITHQVAGMVINGMWDTTDAFPLLVQAANVDSLEPQYSCPSGSSLFNNIKSSNNPAWEKHLDLTKDLVSTLDGISGVTSAESNFHASFDPYYDNLSARQCHVDKPLPCKLNSSEPCVTQDLANAVYRMGHWEYSQMYRDNPDSLDSAVGMYGVWVAELAAHLREVVAGRTDALYFHNVAHDGSVSRLLSILQLDEMVWPGMGSEVVFELYEKTGATPPSPTPTPKPCVRRQKSESGFYVRVLFGGQVLKSSSPTLGKMNMVPVETLLDYFDKLVGKNADKVKAKCG

SEQ ID NO: 4101 - protein, 423 aa, Unknown
  Kingdom: Fungi, Phylum: Ascomycota
MFSLLAKSVALLASLAVASPIAAPSELSAPVARQSSGFANAVYFTNWGIYGRNYQPADLPASQISHVLFSFLNLRADGTVYSGDTYADLEKHYPDDSWNDVGNNAYGCVKQLYLLKKSNRHLKTMLSIGGWTWSVNFPAAAASASTRATFAKSSVTLMKDWGFDGIDVDWEYPESETDAENMILLLQAVRDELDAYSKEHADGYHFQLSIAAPAGPDKYGLLKLAKLGSLLDHINLMAYDFAGSFSDYAGHQANLYPNPGNPNSTPFSTDVAVQAYLDGGVPSEKLVLGMPIYGRGYTGTEGLGKPFSGIGEGDWEAGIWDYKSLPRSGATVEYDDVAHATYSWDPSTEELISFDTPEMISEKVNYLKGLGLGGSMFWEASGDRTGEDSLIGTSQKALGSIDGTENCLKYPDSQYENIASNLE

SEQ ID NO: 4102 - protein, 551 aa, Unknown
  Kingdom: Fungi, Phylum: Ascomycota
MRFSSSALVLGAAGSAAAFQEQKVLGGDSAKPVVNADFGADRATWFGQLESVFGEASDEVKAIWDEVSMLAPDAMEAAKKALLGVPPKPHTRRPDDKWDHVVKGADVQNIWIEGEDGESRRKVGGKLEDYDLRVKKVDPSKLGVDDVKQYSGYLDDNENDKHLFYWFFESRNDPENDPVVLWLNGGPGCSSLTGLFFELGPATINKKGEVVQNPWSWNRNASVIFLDQPVNVGYSYSSQSVSDTWSAGKDVYALLTLFFEEFPEYAKQDFHIAGESYGGHYVPIFSEEILKHKDRNINLKSALVGNGLTDTKTQYAYYGPMACGEGGYPAVLDESQCQSIENAVPRCQSLIQGCYDSESTWRCLPASIYCNNAIMNPYMQTGQNPYDIRGPCEDSDSLCYTALGWISDWLNKPDVMDALGVEVDTYESCNFDINRNFAMNGDWMKPIFRVVPKLLEEIPVLIYAGDADWICNWLGNEAWTEALEWPGKKGFNKAELKPLKLESESDPYGKVKSSGNFTFMRIYQAGHMVPYDQPEASSDFLNRWIFGEWLA

SEQ ID NO: 4103 - protein, 720 aa, Unknown
  Kingdom: Fungi, Phylum: Ascomycota
MVPKWMLALGLASVVSAQCPFADPGRLAARAEGREGGSRSHLEEYEVDDEDVYLTSDAGGPMEDQESLKAGERGPTLLEDFIFRQKITHFDHERVPERAVHARGAGAFGTFTSYGNYSNITAASFLGGEGKETPIFIRFSTVAGSRGSADTARDVHGFATRFYTDEGNFDIVGNNIPVFFIQDAIQFPDLIHSVKPEPDSEIPQGATAHDSAWDFFSQQTSTLHTLFWAMAGYGIPRSYRHMDGFGVHTFRLVTDEGDSKLVKWHFKTKQGKASLVWDEAQHIAGKNADYHRQDLWNAIESGNYPEWELAVQIIDEDEALAFGFDVLDPTKIIPEEIAPLFPLGVLRLDDNPVNYFAETEQIMFQPGHIVRGVDFSDDPLLQGRIFSYLDTQLNRHGGPNFEQLPINRPIVPVHTNQRDGAGQNVIHRNTAPYSPNTLNRGSPKQANQTQGRGFFTAPDRKFSGPLIRKRSSTFADHWSQPRLFYNSLSKVEQQFVINAMRFEMSHLSPRVQENVLFQLNRVSHDVADRIARVLGLEAPEADDTYYHNNKTADMSIVEKELPTIAMMQVGVLASMSSDGSMSDAAAIKEAFKANNVTVAVVGETLADGVDVTYSQAEAVSFDGIIVTESALSLLNSRRRSSLYPPGRPAQIVADGYNWGKPLGFLGDAGDALKDASIEDGDGIYVSNSTDEVVKAMRAGLAVFKFVDRFALDGDDDASDN

SEQ ID NO: 4104 - protein, 486 aa, Unknown
  Kingdom: Fungi, Phylum: Ascomycota
MSTQQKKMAHMALPSDFKWGFATAAYQIEGAVDKDGRGKTIWDTFTDIPGKIADGSSGVTACDSYNRTAEDIALLKECGSQAYRFSLCWSRIIPDGGRNDAVNQAGLDHYSKFCDDLLAAGITPFITLLHWDVPDALDKRYGGLLNREEFPLDFENYARVCFKGLPQVKNWITFNEPWCSSILGYSVGQFAPGRTSDRAKSAEGDSSTEPWIVGHNLLVAHGRAVKVYREEFKESNGGEIGITLNGDATFPYDPRDPKDVEAANRKIEFAISWFADPVYFGEYPESMRKQLGDRLPTFTEEEKALVKGSNDFYGMNHYTADYVKHVDGEPALDDFKGNLETTFWNYRGDCIGAETQSPWLRPCAPGFRDLLVWLSKRYNYPKIYVTESGTSIKGENDMPMEKILEDDFRLQYYDDYVKAMATASALDGVNVRGYFAWSLLDNFEWAEGYETRFGVTYVDYNNGQKRYPKKSAKHLAPLFESLVRTD

SEQ ID NO: 4105 - protein, 177 aa, Unknown
  Kingdom: Fungi, Phylum: Ascomycota
MAVEGLFSDDLVSPDVSAELPEGYRLRALRKTDFDSGFLDCLRVLTTVGEISREAFEKQFDDMEQQGSYYIIVIEDTNRSEKSVVGTGALIVEKKFIHSLGNVGHIEDIAVAKDQQGKKLGLRLIQSLDYVAAKVGCYKSILDCSDANEGFYVKCGFRRAGLQMAHYYNDDKKGKSS

SEQ ID NO: 4106 - protein, 492 aa, Unknown
  Kingdom: Fungi, Phylum: Ascomycota
MTLTTTLKTPITGDYKQPIGLYIGGKWVEGVDKKKFDVINPATEEVICQVCEGTEKDVDLAVTAARKAFNTTWGTHVSPNTRSNLMLKLADITEKNIDLLAAVESLDNGKSISMARGDVGAVVACIRYYGGWADKIEGKTIDIDPSMMHYTRQEPIGVCGQIIPWNFPLLMFAWKIGPALATGNTLIMKTAEQTPLSALVMTQFIEEAGFPAGVFNLINGFGKVAGAAVASHMDIDKVAFTGSTLVGRNIMKAAASSNLKKVTLELGGKSPNIVFKDADIDAAIEWVNFGIYYNHGQCCCAGTRIFVQEEIYDKFLEAFKKRAQANEVGDPFHEKTFQGPQVSQLQYDRIMGYIKAGKEEGATVEIGGERHGDKGYFIQPTIFSNVTNNMKIMQEEIFGPVCAIAKFKDEADVIALGNDTTYGLAAAVHTKDLGTAIRVSNALKAGTVWVNCYNKLHHQLPFGGFKESGIGRELGEAALANYTQTKSVAIQL

SEQ ID NO: 4107 - protein, 352 aa, Unknown
  Kingdom: Fungi, Phylum: Ascomycota
MRVLNTIPATALIGLTTAAPSPGLPFIANVWSGPFESATNAAFLSLLPNASTCGSPTPALDAVTLGCTVCEDEQCDGSVGFGGSPDENCETTLDAMIMDGGTFNAGAVAGLRRVKNAIGVARAVMEHTRHTLLSGDLATKFAKEMGFEEESLSTPEMEARCEAWREESCQPNYRVDVSPDAGSSCGPYSPLEKKTRRQEGKQLGHDTLSLIAIDHKGRMAAGTTTNGATHKVPGRVGDGPIVGSGSYADSDVGGCGATGDGDIMMRFLPCYQAVENLRNGMTPQEAAENAVMRMVTKFPEVSSGLVVVDKEGRHGGAASGWGGTFTYSFRGGDMADTEVVSVPNLTPREKEL

SEQ ID NO: 4108 - protein, 420 aa, Unknown
  Kingdom: Fungi, Phylum: Ascomycota
MASITNFPADVVPQAPEDPLFGLMAAYKADQSSDKVDLHAFLTAVKGIGAYRDNNAKPWVLPVVKKADAILRDNPELNHEYAPIAGIAPFTTKAAELMLGADSPAFKEKRATTVQTISGTGAVHLGALFLAKFFKGNRTVYLSNPTWANHNQIFGNVGLPIAQYPYFSKETKGLDFEGMKSTIQGAPDRSIIVLHACAHNPTGVDPTFEQWKELASLMRQKNHFPFFDCAYQGFASGNLAKDAAAVRYFIEQGFELVIAQSFAKNFGLYGERAGCFHAVTAPAGDASDTIKRIASQLAILQRSEISNPPLYGARIAATVLNDDALFAEWEENLKTMSGRIIDMRKALRSKLEELETPGTWNHITDQIGMFSFTGLSEAQVKRLREDSHIYMTKNGRISMAGLNTNNVEYVAKAINKAVRA

SEQ ID NO: 4109 - protein, 276 aa, Unknown
  Kingdom: Fungi, Phylum: Ascomycota
MHLRDNRSAKLQSEIMLFSIALTSFVSIVAATAVGTPTKKDLAARAAPVASLCTQYAYHADNGYEILNNLWGIDTATGGSQCTYYNGRVGSGVSFSSDWTWHGDQNSVKSYIYANRLFDRPLVSDIKGLPTTVEWSYNNTNIRANVAYDIFTDPDPEHPNYSGEYELMVWLDLYGGIWPITESPTGDPVETVTVAGYSWKLYTGWNGDMRVYSFLPANGAVHSFSADILEFFDFLSANYDYPARSQYMLIYNFGTEAFTGGPTSFNVPRFQADVQV

SEQ ID NO: 4110 - protein, 330 aa, Unknown
  Kingdom: Fungi, Phylum: Ascomycota
MVKAVVAGAAGGIGQPLSLLLKTSPLIDELALYDVVNTPGVAADLSHISSRAQIAGYLPKDDGAKAAFKDADIIVIPAGIPRKPGMTRDDLFNINAGIVKGLIEVAAEVAPKAFILVISNPVNSTVPISAEVLKAKGVFNPQRLFGVTTLDIVRAETFVASITGEKQPQNLTVPVIGGHSGETIVPLFSKVQPSASIPDDKYDALVNRVQFGGDEVVKAKDGAGSATLSMAYAGFRFAEKVLKAAAGEKGLVEPSYVYLPGVPGGEAIAKETGCDFFSVPIELGPNGAEKAINPLEGITEKEKGLLAKAVEGLKGNIKKGVEFAHNPPQK

SEQ ID NO: 4111 - protein, 1274 aa, Unknown
  Kingdom: Fungi, Phylum: Ascomycota
MRHHLASVAGATGVILMAATSNAEPFTPKHEEGRCAFRGHCGKLSFFGKELPCVDNGLAQDPEEELRKELVDLCGAKWADVPVCCTLDQVQALKNEMGTPNTLLGSCPACKDNFFNMFCTFTCSPDQSLFINITDSAEKGGKQLVTELDQLISEKYGSGFYDSCKEVKFGGANSKAMDLIGGGAQNYTEMLKFLGNKKPLVGSPFQINFPEESPDESMRALDMKPKKCNDEDPEYRCVCVDCPEVCPELPEVKDSTSCKVGVLPCLSFASIFTYSVLLFAFVSFIFGHVAWRKYAERRVERTRLLHESSHSDDEDEGGPVQTEAMRDRPTKRYWLNDKCDKAFYQLGHAAARFPAITIGTCLVVVAVLSAGWFRFELEVEPAKLWVSPTSAAAQEKAYFDDNFGPFYRMQKTFLVNDTQESGPGPVLSYDTLKWWAGVEKEIEQIESPTFGKYLHDLCFKPMNDACAVESVSAYYESQGGIDRDTWKDDLRRCTKSPVDCRPEFGQPIEAAIVLGGWEDDVTEAKALTTTWIVNNAAEGSDALLRAIDWENALIERLLKAQDEAAERGLRLSFTTEISLEQELNKSTNTDAKIVVISYIVMFIYACLALGTPMQHAFRNPALLLVESKVTLGLVGILIVLMSIAASIGFFSWVGLKATLIIVEVIPFIVLAVGVDNIFLIVHELERVNVSCPDQMVEERVARALGRMGPSILFSALTETVAFALGAAVGMPAVRNFAAYAAGAVLVNAVLQMTMFVSFLSLNQMRVEDHRCELWPWWQITKARVHLSGSNGYNVGGRATDSEEESFLQIIIKNRYAPMLLGKKMKLVVITIFLGMFAAALALLPTLQLGLDQRVAIPDGSYLIPYFNDLYDYLEIGPPVYFVTRGVDATQRHEQQEICSRFTTCESLSLTNTLELERQRPDVSYIASPAASWIDDFFMWLNPIYEDCCIENGKTCFADRDPAWNTTLSGMPEGHEFVSYLDKFLKTPADDVCPLGGQAAYADAVVLSEDGKDVKASHFRTAHTPLRSQEDFISAYAAARRIADDISERTGTDVYPYSLFYIFFHQYLSIVPLTAALLSAVVGIIFVVAAVLLGSVATAAVVTVTVVMSVIDIMGTMAVVGVSLNAVSLVNLIICVGISVEFCAHIARAFMFPSRTVMESNNNAFRGRDARAWTALVNVGGSVFSGITITKLLGVTVLAFTRSKIFEIYYFRVWLALVIFAALHALVFLPVALSIAGGRGYVDPESEGTAAQDLTDRRWRAIRVHDHSDSEDEEF

SEQ ID NO: 4112 - protein, 664 aa, Unknown
  Kingdom: Fungi, Phylum: Ascomycota
MRSSLTTGTLGAAILSSFVAAQSPFSIDTTDAIKKTASDIVWDMMQYYTGNQTGQTPGQLPGPPPNGDYYWWEAGAMWGTLMDYWLLTGDSAYNKVVMQAMQFQVGPHDDYMPPNQTASLGNDDQGFWGMAAMTAAENKFPDPPSDQPGWLALAQGVWATQAHPDRHDDTCGGGLRWQIPFANNGYNYKNSIANGCFFNIGARLARYTKNETYAKWAEETWDWMEGVGYISSKDDAIYDGAHVETNCTDINKAEFSYNNAVFTLGAAYMYNYTDGSDVWKARVQKLVDHGLKHFFPDGIAVEPACESRDTCTTDMQSFKGYIHRWYATTTKVAPFTAEQILPVLQTSAQAAIKTCTGGDNGRQCGFVWTTGTFDGKLGVGEQMNVVGATSSLLIANARSPVTASDGGTSKGNDNAGNGSDDFKKHEVPLTTGDRAGAGILTALMLGGAAGLFGWMRSHRHIVFTSLTHQQLSGKYISEMASPDFTDRSVFPCFADLPLADPSAASSSSPASYYLIGQVKENMTITSPTLIITDLSGVDLAVTFASSTFDVKPYKKGKTCLVIPNAERTAPAAEGKKGFVRIEVGKEKEVRCLPGTFEGLERFVDVQRAGMGECAGGGCDQEGSSRCLGCGTVKYCGKDCQVKGWTGGHKGECKMFKAVNEIWGQ

SEQ ID NO: 4113 - protein, 559 aa, Unknown
  Kingdom: Fungi, Phylum: Ascomycota
MKFYSLFLLLAATLAAAQQASSSARVPIPGLTGGTDSSGKRPSRPGINGLQRANGPAWDLYIQALAAFQAVPEDNQQSYFQVVGIHGLPFVSWNGVGNVAGGGNGYCPHNEVLFSTWHRPFLALFEQILVGHARTIANKYTGSNKAKYVAAANTLRIPYWDWARDGAKLPASTTATTVSVNTPTGRKTIRNPLYSYKFQKFPFTYANFGGTIGQYPQTMRCPSTSNRQATSRFNVVNSNLARDQSYLKNSVLQQYLTFTRTNSFAVMSTDSQGGYTFEAPHNTVHNDIGCSNPSGHMTNLGWSAFDPIFMLHHANVDRLIAMWQASHPNSQMFTGSYRTNSAMYGTARGSTYNSGTALKPFYRTSSTMWTSASSQSTRAFGYTYPEIQDWTMSASDLQRSVISQVNSLYGTSATRAKRSVESRADDTVLQYMAEISVDREDLELPSTINMYLGDSLAGTFTLLSMPKVGPSFGNIPLQEPLAAFKADATESPQNTVIRLLKSALRIEMVTADGTTKSILNVPSLKVNLEISEVLPAKSEFEFPTYLNTTQVGVKLGELL

SEQ ID NO: 4114 - protein, 486 aa, Unknown
  Kingdom: Fungi, Phylum: Ascomycota
MYTQSTLPTLLLAGSAAAETIHGVVVFSRHGDRTTKWYGSQQLTSLGAEENFLVGSDYRARYLNASSPQHILGMSEDQYVSTQVFASAPNQPILQNTATAFLQGLYPPLKDLDPELASQTLNNGSESESPLDGYQYVVLQGVSDNSPDTIWIKGDDACPAYKNASKSFMQSEEFKQRDEETRDFYAGFYDVLKDGVYNIEPENMTYANAYNIFDLINVARIHNESSPAVNVSDSDLDQLRTLSDSAEFGLNYNKSQSARSIGADTLSGAVLSHLNQTVASEGKTKFALLAGSYDTFLAFFGNAGLTEVSEDFYGLPDYASTMAFELFTEDDTDSFPEDKSDLKVRWMFRNSTAGELKAFPLFGSDETALSYSRFVDEMDKRAVSDVGTWCDKCGSTDDFCAAYQKEDGSANSESDESENGGKSGKGGMSNAVAGVIGAVVTLAVVAIVGGAAFLFMRKRRGNAASAPVMEKRPSVGSGSGDSAGRV

SEQ ID NO: 4115 - protein, 371 aa, Unknown
  Kingdom: Fungi, Phylum: Ascomycota
MGLAPSLVVAVVGALVALPSAMAGFDANANNNIAIYWGQNSYGQGSGQLAQQPLATYCANTDIDIIPIAFMNGITPPMVNFANTGDSCTAFAGNSWLLDCPQIEADIKTCQSQYGKTILISLGGATYTQGGWSSNSAAQAAAQQVWDMFGPVNPSSSVQRPFGSAVIDGFDFDFEATTNNIAAFGQQLRSLINRRSVSKPIYLTAAPQCVYPDAANGPALQGAVAFDFIMIQFYNNWCGTSNFQEGSSTQNAFNFDVWDNWAKTVSANPNVRILLGIPANTGAGGGFTSGSKLQAAINWSKQYSSFGGVMMWDMSQFPDEDQRNLVVQDDHNFLFYHEYEGEFNGRTGEYNLDHDNQNHTQNDAKEYHDND

SEQ ID NO: 4116 - protein, 485 aa, Unknown
  Kingdom: Fungi, Phylum: Ascomycota
MSLDPPTYLASLQSNIRQRPIPWEGQVRSGTLSEEQYSKIRAVDKSKKPEQRKEIVEGDVAGYSALFVGGSGKPGVLESAGKHANVIQYILVLLSDLLDAVPSLAKAILKSNDSYQHLLPLLKSNNTEDPIPLLTSHALANLMALARDESKATQQALPVILSYLSGLAKSTDAGLQDIAVQEYSAVLFGHVSRQQFWDQRSETIGPLVKILQTAAGIGNGANSSASLWSGNNGNSNGSSTRSTGFEGSLGGGVGLQLLYHVLLVMWQMSFEAEEIGDELNDEYDIVVLYVHLLRLSPKEKTTRLILSTLYNLLEKNQRSLLPTAVLARLPSLLENITSRHMTDTDLLEDMQSLKDMLDEYTKTKTTFDEYVAEVQAGHLRWSPPHRSSVFWAENARKILDYENGEITRKLAEIMSKPWDNDKQVLAIACNDVGCLVKEVPERRFQLEKVGLKRRVMELMQSEDENVRWESLRALGCWLKYSFEQQ

SEQ ID NO: 4117 - protein, 234 aa, Unknown
  Kingdom: Fungi, Phylum: Ascomycota
MFTGLVEEIGVISNLTRDETTGTTMTINIPAESTLLKDCQDGDSIAVNGCCLTVTEFTSTSFKIGVAPETLRITNLGTLDTSSRVNLERAVRADTRMGGHFVQGHVDTTAEIAKVSPDGEALTFRFKPKRADMLRYIVYKGFIAIDGTSLTITNVNDEEGWFEIMLISYSQEKVIMAQKKAGDTVNIEVDMMAKYAEKSLGAMLGGSVGPVAGSVPLLEKMVERIVAQALGAKA

SEQ ID NO: 4118 - protein, 873 aa, Unknown
  Kingdom: Fungi, Phylum: Ascomycota
MKISTLVAGALLATGGESFRIEKRQNGTDLAYSPPVYPSPWMDPEANGWQDAYVKAKDFVSQLTLVEKVNLTTGVGWMGERCVGNVGDIPRMGLRGLCMQDGPLGIRFKDYATAFPVGVTAASSWSRNLWRDRGKRMGRTHYQSGVDVLLGPSAGPLGRNPLGGRNWEGFSPDPYLSGIAFADVITGIQSEGVVATAKHWLGNEQERFRQAGEAGGYGFDIDESMSTNMDDKTLHEVYGWPFQNAVHAGVGAVMCSYQQMNNSYGCQNSKITNGILKDEYGFQGFVMSDWQAQHAGVSTAAAGLDMTMPGDTTFNSGISFWGGNLTLAVVNGTIPEWRIDDMAMRIMAAFFKVGRSVGNQPDINFSSWTQDTIGPVHMAANENVEQINFHVDVREDHAHHVRESAAKGTVILKNEGALPLAKPKFIAVIGEDAGGNSRGPNGCPDRGCADGTFAMGWGSGSVEFPYLITPDSALQAQAIKDGTRYESILDNYDWEKISQLVGRPNATAVVFANSGAGEGYINVEGNEGDRQNLTLWHGGNELIKNVSAINPNTIVVLHTAGPVAIDEWYDNPNVTGIVWAGAPGQESGNSLVDILYGKRSPGRSVFTWGRALEDWGVDWLREANNGEGAPQQDFEEGAFIDYRHFDRDYPEGSEKAPIYEFGHGLSWSTFEYSALTVEKRDVRPYKPTTGKTIAAPVLGNFSTDLADYTFPEGIRYIYQFIYPWLNTSSSGEEASADPHYGQTAEEFLPPGTLDGSPQDRHPASGSNGGNRQLWDIVYTITATVTNVGSVMDDAIPQLYLSHGGEGEPVRVLRGFERVERINPGESKVVRMELTRRDISNWDTASQNWVVTPFDKTIWVGGSSRDLPLSTVLP

SEQ ID NO: 4119 - protein, 644 aa, Unknown
  Kingdom: Fungi, Phylum: Ascomycota
MQLISAISALAVVTSAASATTTNNHVARDTASNNVNGPYVPATAPRDNLWAGISADEASSIREFLERQSNVTIPAGISFNTYDGLWVLPPNKTDSLAYLDGDGPKPPRYARVFGQANCFDREFMIGPLPVSNLTKATPLKYTNNGNSDIKNSWCDGDSTQGAEDQARRIASEEARRNATLERRESVNPYDEKMEWNGRELPHDEKAPPVAILPDGARHEFDPEQNYISWMDFTFFVATGPAGVSLHDVRYKGERVVYELAMQEALAHYAGPDQVQTENSYLDVTIDFTQYNLIPGYDCPSYATYTDAFCLFEYPKDYPMSRHRDFSYYHATQNIAFMLRSISTVSNYDYQTTYEFYHDGSIQVLVRATGYIQASDVIDVPDERAYGFRIRPELSGSMHDHVLNFKADLDVQGRNNTLFKTEFVPHSQVYDWSDGKTVNTMKVERDFVTNEDQGKINWAPNAAVAYSVVNKDKENELGENPGYKIYPSTGSPIHVTVKDSTVFGDLINWATHHFYVLKRKDSEPVSAHPKARTWDLQTLVDFNTFFDGESLEQEDLVLYFNLGMHHMPDTYDLPVTVFQGAQCGITLRPQNYEKSDNSVSTRQQIDIRNSEGEISVNTYGMEGLTGNYDLNGTSPPWYPLPSQWS

SEQ ID NO: 4120 - protein, 359 aa, Unknown
  Kingdom: Fungi, Phylum: Ascomycota
MRLIIREDAHKASTYVAQYIVDRITAFNPTAENPFVLGLPTGSSPMGVYKILVERYKAGQISFENVITFNMDEYVGIPRDHPESYHSFMWKNFFSHVNIHPSNVHILNGNAPNLEAECVAYEEAIKRAGGIDLFLSGIGEDGHIAFNEPGSSLASRTRVKTLAYDTILANSRFFGGDVEKVPKMALTVGVQTVLEAREVVTIILGQRKSLALQRCIEQGVNHMWTLSSLQLHPHPMIVADEDATLELQVKTVKYFKSIEKVALEQGFEQILPSKVRTGNGPLPKTTVEEVSSPTILAPQPTTSRLLRATPATEYPVRSVSPDLVPDRMASRIPEPALNKRLTPNPEQQAFRQNNVVNAY

SEQ ID NO: 4121 - protein, 458 aa, Unknown
  Kingdom: Fungi, Phylum: Ascomycota
MRSGAGAAAAAALLPSFVSGQSQYSLASIDAIKKTASDAAWDLMQYYKGNLTGETPGILPGPPPAGDYYWWEAGAMWETLIEYWMYTGDSSYNAEIMAGMQWQVGPNDDYMPPNVTASLGNDDQGFWGMAAMTAAEMNFEDPASDKPGWLALAQGVWATQANPDRHDDTCGGGLRWQIPFANNGYDYKNSIANGCFFNLGARLARYTGNDTYAKYANETWNWIEKIGFLNNESYAIYDGAHVEDNCTDVNKQEFSYNNAVFTLGAAHMYNYTGGSELWKNRVQKLVDHGLSYFFPDNIAVEPSCETARTCTTDMQSFKGFIHRWYATATTIAPFIADQVLPVLSDSANAAIKTCTAGSNGRQCGFVWTSGKNDGLLGAGEQMDVLGATSALLVSAAHAPLTAKTGGTSKGNPKAGQQSDDFAPHFSPITTGDRAGAGILTAVVLGCGIGLFVWMSTGV

SEQ ID NO: 4122 - protein, 552 aa, Unknown
  Kingdom: Fungi, Phylum: Ascomycota
MAPANTLPAWSELQNHRDTVGKKFVLKEAFSSDPKRFDRFTRTFAPEGGAEILFDFSKNFLTDETLELLVKLAEEAGVEKKRDAMFAGEKINFTEQRAVYHTALRNVGGWEMKVEGQDVMGGDNGVNAVLEHMKEFSEQVRSGEWKGFTGKKLTNIVNIGIGGSDLGPVMVTEALKHYGADDMTLHFVSNIDGTHMAEALKASDPETTLFLVASKTFTTAETTTNANTAKSWFLEKTDNKGEIAKHFVALSTNESEVTKFGIDSKNMFGFESWVGGRYSVWSAIGLSVALYVGFDNFHKFLSGAHAMDKHFRETPLKENIPVLGGLLSVWYSDFFQAQTHLVAPFDQYLHRFPAYLQQLSMESNGKTITSDGSSAKYTTGPILFGEPCTNAQHSFFQLVHQGTKLIPTDFILAAQSHNPITDNLHQKMLASNYFAQAEALMVGKTDEQVKAEGTPDELVPHKRFLGNRPTTSILVGGTIGPAELGALIVYYEHLTFTEGAIWDINSFDQWGVELGKSLAKKILGELDQDGNGEGHDASTGGLIGAFKKYSKI

SEQ ID NO: 4123 - protein, 235 aa, Unknown
  Kingdom: Fungi, Phylum: Ascomycota
MPSATISATEFDSIPASIEAFRNGEFLVVLDDPSRENEADLIIAAHDITTAQMAFMVRHSSGLICAPLSPALADTLALPPMVPASASQDPRGTAYTVSVDAADPAVTTGISSHDRALTCRVLAAEKPDADALRRPGHVFPLRAREGGIRVRRGHTEAATEFCRLSGKTEAGVICEIVDDGEEVAGQAIRSGSGMLRGVQCIEFARKWGLKVCTIADLVDYVEKTEGKLPAANGSD

SEQ ID NO: 4124 - protein, 582 aa, Unknown
  Kingdom: Fungi, Phylum: Ascomycota
MKLSQGIALWLQAGTAAAAVLEEVYQLPQGWQKISQSPDPDETILLSFAVRQPDIENIGRSMESKAASHLSREEARNLQKPCPKAVKAVTAWLHDQGITDTRPVEDFIRVRTTVGEAETLLNATINNYTYKDKPPVRRTQRYSVPDEVANDVAFVHPIANFMRPQKELTFASPPGSHDDSLLATRDAPCSKRTTPQCIRQLYGINTTASAKDTTPVRFGIAGFLEENANYVDALSFLKRTAPEIAATGYNFSTELINGAKNEQNPMYAGNEAALDIQYALALAYPSNITYLLAAGRGVQLNDSGDPLPDEFVTNEPYLEFLEDLLAKSDDEVPHVLSISYADDELSVPRPYAERVCSMLGLLTARGTTIFGGSGDGGARGARNSSCLVNDGSGRKAAMATFPATCPWVTSVGAVTGAEKLTAADFSTGGFSQYFPRPDWQDKDVEGYVKALDGKLTGLYNSSMRAIPDVSAIGTNFNVQVARTSAFLSGTSASTPVMASLIVLVNEARFKRGKQSLGWLNKVLYSDKVRSAFQDVTNGTSVSCQFEGEKEPGGWPTEKGWDAVTGLGVPKSYQKLLDVLLNI

SEQ ID NO: 4125 - protein, 810 aa, Unknown
  Kingdom: Fungi, Phylum: Ascomycota
MVVVPLLLICGLSGLAALGSNSGSETSGLEAKSLIWDDEHFYGDSPPVYPSPNMTGVGDWAIAFNKARDAVANLTLGDKVKLTAGIEHKSGCSGSIPAIDSIDFPGLCLSDAGQGVRGTDFVSSFPSGIHVAASWNKNLTYQRGNAMGGEFRTKGVNVLLGPVVGPMFRVARGGRNWEGFSPDPYLSGALVALTVAGVQDRGVMASTKHFIANEQETNRNPGKDDEGTVEAVSSNIDDRTMHELYLWPFQDAVKAGTSNIMCSYQRVNNSYGCANSKTQNGLLKTELGFQGFIVSDWDAQHAGVATALAGLDMTMPDDQGFWGDKLVEAVKNGSVSETRVNDMAVRILASWYQFGQDKGFPKPGIGMPKKVTDSHKIVDARDPAARPTILEGAIEGHVLVKNTKKTLPLDEPRMLSLFGYSAKSPDLFAPANGELGNSWIIGAEPATAQHIFSGSSNDEDHQAIAINGTMINGGGSGATTPANFISPFEALNSRAYADDTAIFHDFRTAEPAVVPVSDACIVFGNAWAAEGYDRPSLRDEYTDKLIVSVADQCNKTIVVLHNAGVRLVDGFIDHPNVSAVIFAHLPGQDTGPALVSLLYGESNAWGKLPYTVPRNESDYGSSELVGPTRPEGDFERFPQSNFTEGVYTDYRHFDRENIAPRYEFGFGLSYTTFELSDLSVMLNEDVDTAELPTGAIISGGQADLWDELVKVSATVRNTGESAGAEVAQLYVGLPSGKGKADSPRKQLRGFEKLNLQAEESTEVVFMVRRRDLSVWDVTAQRWRLQSGKYKFWVGSSSRALPLNGTVEIKS

SEQ ID NO: 4126 - protein, 1054 aa, Unknown
  Kingdom: Fungi, Phylum: Ascomycota
MKVGPNGASVITQVRINLFTKVILIMLVGLLLSAPLYPLFSWTQGERVDGQHMAMIMALQTGCTAIFGAVLHMCTTAKRHEIFTASVAYMAILVVFMGQTTFTRYRTRLTMDPSSEGLLKHGGRPSLDSRSSLSDLDATEYLNNGEGNIRSSKEFARDKADQDAQWAASKPRRRRCFWISIAVGAIVLLLASAGGFGWKKIKTAPPDGLSPPWYPSPKGGSVRQWADSYKKAASMVANMTLPEKVNVTTGTGWSMGLAVGNTGPATNVGFPGLALQDGPLGIRFADRATAFPAGITVGATWNRRLMYERGKAHALESRMKGINILLAPCVGPLGRLPAGGRNWEGFGPDPYLQGVAGFETIKGIQDQGVMATIKHFVGNEQEHFRQAWEWGTPQAISSNIDDRTMHELYAWPFADAVKAGVASVMCSYQMVNSSYACGNSKLLNGILKDEMGFQGFVMSDWLAQRSGIASALAGLDMTMPGDGIAWMDGESLWGPQLTKGVLNGSMPIDRLNDMVVRVVAAWYQLGQDDEELFDRKGPNFSSWTNDKMGFTAPASGSPQEKVVVNQFVEAQGNHSELARQVAAEGTVLLKNNGILPIQRDGEAASGFLTAPADRKLRIGIFGEDAGPGKGPNECPDRGCNQGTLGSGWGSGAVEFPHLVTPVDALKKAFDAEKVDITESLVNDVKKLGGKPDKNDLCLVFANSDGGEGFIAWGDVKGDRNDLFLQKGGDDLILHVAETCGGGKGHTVVVLHAVGPVVVEKWIDHPGIGAVIMANLPGQESGDALVDILFGDVNPSGKLPYTMGKSLDDYGPDAKVMYMPNGLMPTQDFKEGLYIDYRYFDKYELEPRFEFGFGLSYTTFEFKKIALKEVKGKSALPAKRPNAGAQSPEFEDVLPDVKEALMPAEIRPLDMYIYPYLRPQDEVKQGDYPYPDGYDEPAQLSDAGGDEGGNPDLWETHVTVSFEVKNTGSRDGQVVPQLYLSYPESDDVDFPVKVLRGFEKVHLEKGESKKVKMNITRRDLSYWNVDRQNWEMVTEGKYTFAVGQSSRDLPLEIEW

SEQ ID NO: 4127 - DNA, 781 bp, Unknown
  Kingdom: Plantae, Phylum: Streptophyta
atcaaagaaccaatctttctctcattaccagccatgactactcaattcgtcattctctcccttctcgtctcttgtaataccctcatttacgccaatgccgaagacacgggtttcgtgggctcactagatcacaaggcattgggtttaaagaagaaagacaaggttagccatttccggttctacttccacgagaccttcaccggaagcaacgccaccacggtcttcgtggttccgccgctcccccagtacagctccaccagctccttcggggcaatcggggtcatggacaacgtcttgacggcgggaccggagcgtacctcgaaggtggtggggagagtggaggccttggccgctgccacgtcacaaacggagtttaatttattgatattttttaacttcatattaacccaagggaagtacaatgggagcaccatcaccgtgttggggaggaaccgcacctccctaaaggtctaccattgagtacaacatctatgtttctcattattaatgagttaaagcccaataaagagactttcatcatcaaaggtgcaagctaaggggtgccttgcccatatacaaaaagaataagaaagcatctaaaggttataccattctacatttgtattgatacgtatgctttgtacttagtatgctatgatgtcaacaagtttaattacatggtgtaaaagcctttgaaactgaattacattggaaacttctatggaaaaatatggctggtatctttagtctttttttaaaacaataatttagtttatctttt

SEQ ID NO: 4128 - DNA, 2351 bp, Unknown
  Kingdom: Plantae, Phylum: Streptophyta
acccttgacccatttttgttgtgcatttttctacggtcaaaggtcaacctccatactcagtcagaagcagcttcttccaaagacatgggtgatgtgtgtgtgtgtgcatgcctctcttatcatacataaaatgctccattccctctctcttctctccccaatttcaaacccaacaacaaaacaacaccaacaactaacctttttcataccatagttcttgagttgagcatgtctttcagtttcactgaccttctttttaccaacaacaataacatgaacagggatgatgatccctttggacttgagtttgctaataacttcaagtcagcttcactgcctctctctccttcttcaatctacccttcttatgctgagttccctcctggttttgccccaaccacacagtcattgaattcacaccactttttttcttctcaaaatgttcctgcatcttacacaactgagccatcttctagcatgagcttcaacatgagaaacagttcaactatgggtcaacatggaaacaaggaggaagagagaaactactctgaccactctttccaaacaaaagcaaaccacgtgcctctctttcaatcttccacaagcatatttcaagtggagccacaaaagaaacaggacacaatgatattcaatgaagctgcaaagcaaacagatttctcatctgagaggacagaaacaaaatctgaatatccatccactcagggcttctcaacagcattagcctcaatcaaacatgaaatacaaagcaattctgctccaggatctgttcaatttaactccacttttgctcctaagtctattagggaacaaaggagatcagaagatggttacaattggaggaagtatggagagaaacaagtgaaaggaagcgaaaatccacgtagttattacaagtgcacgcacccgagttgcccaacaaagaagaaagttgagaggtctttggagggacatatcactgaaatagtatacaagggaagtcacaatcatcccaagccacatggtagaaaaaatggttctcaatcaattcatcaaacttcttcgccctgcaccaactcggggatttctgatcaatctgtgggagatgaagatctagagcaaacatcacagactagttattctggagggggtgatgatgaccttggaaatgaggccaaaagatggaagggggagaatgaaaatgatggctattcctattcttctgctgggagtagaactgttaaggaacctaaagttgtggttcaaaccacaagtgaaattgacatacttgatgatggatataggtggaggaaatatggacagaaagtagttaaaggaaacccaaacccaaggagttactacaaatgcgtagccccgggttgtccagtgagaaaacatgttgagagagcttcacatgacatgaaagctgtgattacgacttatgaagggaaacatatccatgatgtaccattaggacgaggaaactcaagctatagcatgaacagaaattctctaaacaacacctccaacaacaccaacaccagcaatgtaacagctcctgctcctataaggccctcagcactgactaactattctaactcagcaagtttcacaaactcacttcatgacacaaagcaaccaacatctgcaggtcaagaaccttttccaatggacttgctgctgagccctggaagcatcggattttcggctaatgactcattccttcagtcttttttgtcaaagaacttttaaatttggaagcagaagaacactagaacgttacacataaaaatatcactgatatgtttatgtatagcataggggaatagaataagaaaatcatgagcatctactaattttagtgcactaagattagagactagaactacagcattctaaagcttgacaagagttagtccttgtttcaactttcaatttagaacaccagaacgttacaataaaaatatcactgatatgtttatgtatagcatataggaatagaataagaaaatcatgagcatctactaattttagtgtactaagattagagactagaactacagcattctaaagcttcacaagagttgggcattgtttcaactttcaatttagtaataggagagacagaaaacatgttgaccttgaattctattattcttttgttgcttttgttcaattgttttctaagatttatactagttgttgccaatgtctactttggtatataaatgtctactcttactagttatggttacttttggttgtgttgctgactataattttttcagtcaaagtccttatttgtgcaaattatgaaatagtcagcgacttctgattagtcaggaaaatgttca

SEQ ID NO: 4129 - DNA, 1785 bp, Unknown
  Kingdom: Plantae, Phylum: Streptophyta
acccacgaggattctcagcaaacaatgaactcctgagaccagttgagtctatttccctaattaaagccatggaatattctccactgtccattgttattaccttctttgtgttcttgcttttgcattggctagttaaaatttacaagcaaaaatcgagatacaaattgccccctagcccatggaggttacctatcattggtaacctccatcagctagcattagcagcttcacttcctgatcaagctctccaaaaacttgttcgcaaatatgggcctctcatgcacctccaacttggtgaaatttcagccctggttgtgtcctcccccaagatggccatggaggtgatgaaaacccatgatgttcattttgtgcagaggccccaacttctggctcctcaatttatggtatatggagcaacagatattgtttttgctccatacggtgattattggaggcagatcaggaaaatatgtaccttagagcttctaagtgccaagagggtccaatctttctctcatatcagacaagatgagaacagaaaactcatacaatcaattcactcatccgcaggctcatcaatcgatcttagtggcaaacttttctctttgttgggcaccactgtttctagggcagcgtttggaaaagaaaatgatgaccaagatgaattaatgtctttggtcagaaaagctataacaatgacaggaggatttgaattggatgacatgtttccttcattgaaaccattgcatttactgacccgacagaaagccaaagtggagcatgttcaccagcgggcagacaaaatcttagaagacattctcagaaagcatatggaaaaacgaacaataggaaaagaaggcagtaatgaagcagagcaagaagatcttgttgatgttcttttgagactcaaagaaagtggcagtctcgaggttccaatgactatggagaatatcaaagctgtgatatggaacatatttgcttctggaactgataccccggcatcaacattggagtgggcaatgtcagaaatgatgaaaaatccaagagtgagggagaaggcacaagctgaattaagacaaacattcaaaggaaaggaaataatacgtgaaactgatctagaagaacttagttacctgaagtcagtgatcaaagaaacgttgaggttacaccctccttctcagttgatccctagagagtgcatcaaatcaaccaacattgatgggtacgatataccaataaagactaaagtcatgataaacacatgggcaattggaagagatcctcaatattggagtgatgctgaaaggtttatcccagagagatttgatgatagttctatcgatttcaaagggaatagctttgagtatataccctttggggcaggaaggagaatgtgtccaggcattacatttggtttggctagcattacgcttccattggctttattactctatcactttaattgggaactcccaaataagatgaaacctgcggatttggatatggatgaactcttcggactgacagttgtaaggaaaaacaagttgtttttgattcccactatttatgaagcttcatgatacatgtatttttttttaataggccaaaggagattcaataagagtaccaatgatattcagaataaaaaagttacagagaataaaggaacccaaggcgcaaagaaactaaaagaaaagccacacagtgataatatttgtagtgcatgtctattgagatatctttacactttggggagtcttgtttgatgtaattttttgcttgtta

SEQ ID NO: 4130 - DNA, 1612 bp, Unknown
  Kingdom: Plantae, Phylum: Streptophyta
aatcaagtcttacccgttagatacctacctttaccttagaatctttctttattcttaagctaaatatactaaacaaagattaaaggaaccttcgaccttgagtcttgaggtgtagtataatagttaattaatataaatttgcggcaactattgaaagttgaaacttcctcccaacagggttgaaacttcctcgtagattctgccgtgaagtctaacggccacaggcttttttctaacgtcggcctcgtaaaaaatccttactccgtcaaccttccaaaacacgcgccatatgttgttgcaataacggctcatattcaaagacacgggaaagtacttcaacattaaacagaagcaacctctttctttctctcttctttctctcatgtttctcaaaacctcctatatttaactctgtactctttctccttctcaactcaaacattaattcccactcatactaacatattacgatgtcaagaactgtagagatgacaattttgtccgcagaaaacctccaaatgaatagaaaatccattagaggaagcacatttgtgacggttcaatccgacactagcagcgacacaagtgctgctaccaaagtggattcagagggtggaagttacccttcgtggaatgagaaggttgtgatggacgtgccattgcatgcaaggttcataaccgttgaagtgaagtgcaaaacgtcatcatcagggtctaacagtgttggcgtggcacaaattccggtttctgatttcattggagggtatatgcccgaaaaccaattgcatttcttgagctataggttgtgggacggcaaagttaggagaaatggggttataaacatttcggtgagggtgaaagtggctgaacattcttcttgtaatttgaattctatgtcattgtcagcggtaactggggtgccggtggccggtaatggccccactggagttgtcacagggattccagctgtttggttaaactaccaaagaaatctttgaaactatcaactagcccaaaattatttcaacagcattagtctcaagtttgagtcaaacgtatatagctgcatttatcgctcacagtggtcttatctggcatgattaggattatctacagtgaaagacactagtaatctgtacccaaaaaaaagaaatatttgaagggtttggtttgttatgtactgaaaaaagaaagcattattcattgcttttccttctcgacttgctgtagaaaaactgtgacaaacagcatgaaggctgaagagggattcagaaaaaaagtaaaataaatgttgagcaaatatctggcaaactattggctcaattacgacttatgagttttccagtagtatatatgtacagtgaagatatgaaaagaaattgctgtgtttttggattaactaagactgtcactatatatatatatactcgttaattgattgaatatattttttatatttaattataataagaatttatattattaaattgatgtatgtgaaagttaatgttattcatcttattttaaatctacacatagaaaaaataaatttgtttgaagtagtgcacccccaaaagttagatttttggttaaattacagtaacaaaaataa

SEQ ID NO: 4131 - DNA, 2246 bp, Unknown
  Kingdom: Plantae, Phylum: Streptophyta
ttcacttcattcagcataataaacactgctctctctaaccttttccccaaaccaacttacactcaaagaaagcttgttctccttctgcctagtaagaagcaacttgttttagaaagaaaagaaaaacagtgtcattgctctttggcacaataagataatagaaaatggaaagcgacaggaattgggagcagaacgcactcatcagtgagctaattcaggggttggaggtagcaagaaagttgaaggaagacttgagttcagcctcttcggttgacgctagggactcacactcactactgcagaggatattgtcttcttatgacaaggctttgctttttctaagatggaatgaatcagtgtccatgcaacaaccaactaaaacttcttcaccacagtcaccactatccattgacaaaactcctctgagggaagacgctgaagaagatcatcaagaacttaaacacaattcgaagaaaagaaagatgatgccgaaatggacggaacatattagagtgaagatcgagaacggcgttgaaggacccctcgaagatggttacagctggagaaaatatggacaaaaagatatccttagtgcaaaatatcccagaagctattataggtgcaccttccgcaaaacaaaggggtgctttgccacaaagcaagtgcagagatcagaagaagaccacactatctttgacataacttaccgaggaagtcacacatgtaagcgaaacgatgccgttctgccgccaaagtcaccagattatacacaagacggctccttgactgtcaaaacggataacataacggcaccttccgcttcgtttggatgcatggcgcaagataactaccacgacttatttccttctttggtcttagagaatgatccattttttagcaccctttcccaaacatcctcgttatctgcaaacacacctgaatcaaattattttgtgtctccgactttcctcgaacatgaattcgatggggtctgtaacaagccctgccctgattctgaacttgcccggctggtttcagctgatacatcaatcaccagttctccaattttcgactttaatttctcgctcgatgcagtgggaattgattatccaaatttccccttcaatatatgaaaatatggttagcatttgcagaaattgcacttgagaatgaatttcatactattttgtagaaagtatggttagcatttgaagatgatgtataacactccagacagcactaataaatgcccctgtagttcattctgaataaccacgttacttaagggtggtttaatcattttaaataacgaattctctttaaacaaaacccattttatttagaatcatacatctgaattgattgggctgtctaagccccagacaatcaccagaagcaccctatacacctacagattaacccccagacaatcaaaataggggaacggtgtgtgatcatgctgcaaaataggggaagaatctagagagtttgaaggctgacttcttaagggttaagaaagtagtgtgaattcacagaatcacagaggaagcagcaaagctaataaataataatagcccattttaagctgattgaacatcgagtgacgaaattaaaatgttcatttgcacgactggtgcttatattccacggtcctttaacttttttcttaagttaaaaaaaatactttccccatgctgttgtattttcatccaatccaatttagttatatttcattttctccacaacctgtaaacactgtaaagcactaagggttctatttcattgttgggccaaagcccatgtcaagatagctatgatgcacccacaatcccacaaatagtctaataaaatcgtaatttttaatcaatatcaaccaatactaaagtgttcagagagtatatccttaacttttctctaaaacgtgtattttcaatatagcattaaggaaagtcttatcgttaaacaagctactagaaagcgaatgcatgatttgtacaaacgccaccctacatcggtgagagcaaatgaaatgggcatctagcatacaacttattagctatgttagaagtcaatcattagagagtcaactatggttagaaagtaattggttgttgattatggttggtagtagttagttagacttataactaacttttagttatggttgttagtagttagttagacttgtaactaagttcctctatgtataaaagcttgtactaacaactaaactagacagaagcaat

SEQ ID NO: 4132 - DNA, 884 bp, Unknown
  Kingdom: Plantae, Phylum: Streptophyta
tatagctgtttggtcacaaataatgctccaccacatggttggttcttgtgatagtcgtcaactctatataaatggaggagattatgacctagaaattacaatatcatttgtgttacctctttgctagttttgattagatctacaacaagaaattaaagaaatggctttcagggcagcgagaaatgtaggattgaggttgggaggaggaaggcgatcaattgctactgccagcgctaaaaagcatgatgattgggcgactctgaaggcagagttagcaccggtgtacatggtgtgcggaatggtggcaatggctgtggcaattggatcacacactgcgtttcaacaactggcgcgttctccaactgttcatataaacaagaagagaagagagagcatgccagaggtctctgatcctgatcgcaccttcaactccgccaccaaattcatcgatggttccttcttaaggaaactctctcacattcaagacaacaaccccacactccacgacccttcccaccctaatcctttcaccactcctcgaaccgctcacaccttgaagactgtgggcgttcacccctccagccgttgatccttctttcattttcactatttctaaatatgacaactttctccacctatatattttttctaattttccatttctatgctaagaaatattgtaaataagccaattaatgttttatatttatttatttattggcccattagtcttaggatagctgagactcacgcggcgccacttcaataattagatctctgcatgatcttctactcatgcagctttgtgtatatatatatatctatatattatataaataacatctgaaataaagccaccacggcaattccatgagcatcacatt

SEQ ID NO: 4133 - DNA, 2240 bp, Unknown
  Kingdom: Plantae, Phylum: Streptophyta
gcagcggtgtggtgttgtgttgatttgagtcccatattgtttgtttttcgatggctaaattgttcagagcgtttttcttcaagtctcttttcttcttttggtaccgttttctctttaggcaactcaggaacctcgtccgtttccacagaaccattagcaattctttttcgggtgcaacaacacagtttaacaaatacctgaaattcccctctctaatccaccgatcagacctcaacgatcacacgttgatctttgatgtcgaaaacgcgttgttgaaatcctcttctttgttcccatatttcatgctcgtggcctttgaggcaggggggcttataagagccatagttttggttcttctatacccttttgtttgtgtgctgggaaaagagatgggcttgaagataatggtcatggcatgcttctttgggatcaaagcttcgagcttcagagttggaaggtccgttctgccgaaattcttcttggaggacgttggtgcagaaatgtttgaggctctcaaaaaaggagggaagacagtgggagtcaccaatctaccccatgtgatggtggaaagcttcttgagagagtatttggacattgatttcgttgtgggcagggagctgaaagttttctgtggatactacgtaggattgatggatgacacaaaaactatgcatgccttggagctggttaaagaaggaaaaggatgctccgacatgatcggaatcacaaggtttcgcaacatacgcgaccatgatgattttttctctcattgcaaggaagtgtacgtggtgtcagaagcagacaagaggagctggcaaaagctagcaagggagagataccccagagcccttatatttcacgatggaagattggccctaagacccactccaaaggagtccatagcgatgttcatgtggctaccgtatgcaataatcctcgctgttattcgcatttccctcgctctctcactcccatttaccatctcaaccccctttttggtctttagtgggatacgtctcacgaccacagcatcatcagcgcccacaggctcccacaacattaaacagaacaaggggaatgtcggtaatctctacgtgtgtaaccacagaacattattagacccgctctacatctcattctcgctacaaaacaacttaaccgccgtgacctacagtttgagtaggatgtccgagatcctggccccaataaaaacggtgcggttaaccagaaagcgcgacgaggatgccgaaatgatgaagaggttgctggggcaaggggacctagttgtgtgtccggaggggaccacatgtagagaaccgtatttattgaggttcagccctcttttctcagagatgtgcgatgagattgtacccgttgcagttgacacccacgttagtatgttccacggaaccactgctggtggacttaagtgcttggacccgttcttcttcctcatgaaccccgctccagtttacactgttcggcttctcaaccatgtcttcactaattcacaattactatcatctcacaccagtaacctttaccaagaggctcataattcgaggtttcaagtggctaatagggtccaaacacagattggaaccgcgttggcgtttgagtgcactaaactcacacgaaaggacaagtacttgatgttagctggtaatgaaggcattgttaattccaacaccaaatgcataagcaagtccaactcttagtggatcgatcgagatcgagagctagtacgttaccctttgtaaagtcgccaacaaccatgttagctgtgtcgtaaatgaccaattacatatacaggatccatgataaagatagaatgccaatcaaggggacctcagtaaattaaaattaattaaattcgtcctattcctttctcttgattgttattatttcaaactttgtaataattccttgtgtggtacaaaagcaattttaattctcatctatatatagtccttcttattatgcaattaatggatcgagctaccgcctaaacgtgcaattatgttgtactgtatcatgtggtgagagaggattcgtaatgcttttacctcgaacaagtcttgacagctccgatcccattcatttattgtttttgcattaatttctcagttttgttgttcatgaacttttctcagctatcatgtactatatgaaagtcaaaatcaggggacgaacctcaaaaggtagtagtactctctttcctccaagtttttaaaatggtt

SEQ ID NO: 4134 - DNA, 1779 bp, Unknown
  Kingdom: Plantae, Phylum: Streptophyta
gtggaatccagtctaagaagcaaaacaaacatgaaacaccccacaaattggcttccccatgttgcggcctataaataagactctggagaagaccatcatcatcatcactcctcaaaaacagaaacacaaaatggctgagcagaggcaaaacaacgtccacgttcttgttctgccataccctgcccaaggccacatcaaccccctcctccaattcgcaaaaagattagcttcaaagggcgttaaagccacagttgccaccactcactacactgccaactccatcaatgcacccaacatcacgatcgaagccatctccgatggcttcgaccaagcgggcttcgcccaaacaaacaacaacatgcagctcttcctggcctccttcagaacaaacggttccaggaccttgtctctgctcatcaaaaaacaccaacaaactccctctcccgtcacctgcattgtctacgactcctttttcccgtgggctctcgacgtggccaagcagaatggcctttacggagccgcctttttcacaaactcagccgccgtctgcaacatattctgtcgcattcatcatggtttccttcagctccctgttaagacggaagacctccccctgcgtcttcctggtcttcctcccttggattctcgctccctcccgagtttcgttaagtttccggagagctatcccgcttacatggccatgaaattgagccaattctccaacttgaacaatgcggattggatcttcgtcaacacctttcaagcattggaaagcgaggtggtgaaaggcttaacggagctctttccggcgaagatgatagggccaatggtcccttctagttacttggatgggaggattaaaggggacaaagggtatggagcaagtctatggaagcctctagctgaagagtgcagcaattggttggaagcaaaggcgccgcagtctgtggtgtacatctcctttggaagcatggtgtcattgacagcagaacaggtggaagaggtggcatggggattgaaagaaagtggggtgagtttcttgtgggttttaagagaatctgaacatggcaaattgcctcttgggtacagagaattggtaaaagataagggtctaattgtgacatggtgtaaccaacttgaattgctggctcaccaagccactggctgctttgtgacacattgtggctggaattccaccctcgaaagccttagcctcggtgttccggtggtgtgtttgccacagtgggctgaccagttgcctgatgctaagtttttggatgaaatctgggatgttggtgtgtggcctaaggaggatgagaaaggaattgtgaggaagcaagagtttgtcaagagtttgaaggttgtgatggagggtgaaagaagccgagagattagaaggaacgcccataaatggaagaagttggctagggaagcagttgctgaaggaggcagctctgataatcacattaatcagtttgtgaatcatttgatgaatctgatatgaatggaagtttgaaagtatactgagtgcctattctcatcatcagttgttatttgttagtggatgcatgtattctggtctcatttgtgttcactttttcaatatggaaatttatgtgaatgtatggcatccttttttagtttcattcttgtctgccaataacacctgtctcttctaatttatcatgtatttgttacaaattctttattgaaaagaaatgatcagttcataaatatcacatatggctgtccagaataaataaatctactcattcattt

SEQ ID NO: 4135 - DNA, 1372 bp, Unknown
  Kingdom: Plantae, Phylum: Streptophyta
accaccatccaattaaaaaagaagcttgcaaatttagacttcaagggagattcctaacttctggaagaagccacgaaggcgaggtgagtctacgtgtgttattttgaacgaacacgtgcagcgtgtgaaaacacttaaaaaaataggtgaaaaaggcaaattactagaaaagttgaaattgaaattcgaaagaccgaataaaaatcaaagtcctctcctaacctcacatataaaaaccgaaccatttatcattttcctcttctcaattcaacatctgcaaactccaaccaaccaacttcttaattaataactgtcgtcgtttcaatctcgttacacatctcaaaacgcagcagcagcacactcgacttaaaatgcaagccgtttcactctcacctttgtcgtctagggattcttccgacgagttcgctggaaagttcgaacacgatttcgtggctaagctcaaaatcaacgaaaacgaaaacgaagagaagcataacgaagatgaggtagaagaagaggaagagtttagcttcgttctcacgaattccgatggatcgccgatctccgccgaagacgcgttcgacaacggccatattcgtccgatttttccgattttcaaccaggatcttctgttctccgacgattacaacggcggcgacggtctccggctgccgataaaggtcttcgtcgaacacgcggatgtttctccgtcgccgtcggaggcgacgacgccggcggaaggaacatactgcgagtggaatccgaaagcggcggtgaagagcaactcgacgggattctcgaagctgtggaggttccgagacgtgaagctgcggagcaacagcgacggaaaagacgcgttcgtgttcttgaaccacgcgccggcggcgaagccggcggagaaggcgagcagcgtcgtcgtgaagaaggttgaggtgaagaaggggaaaacgacgacggcggcggcgtctgcgcacgagaagcattacgttatgagcagagcgaggaaagagagcgataaacgcaagtcgtatttgccgtataagcaagatctgttcgggttcttcgccaacgccagtggattgagcagaaatgttcatccttattgagaatccgttaatttgattcagaaatttcatttatttgtatgtaaattaatgtttgaaattcatcaacctaactagggaattacctcttcctaatttgctatcatgtaattagattcgaggatgatgtcctagagttgaaatatttggatatatatttttttgtagatgaagatatccagacaaattcaattacgtagcatttttatttttcacgtatacctgccgacggcactatctttcaataacgattgctgagatcaaattag

SEQ ID NO: 4136 - DNA, 1121 bp, Unknown
  Kingdom: Plantae, Phylum: Streptophyta
gtgctatactccaagttatctcatctacgatctccacaacccttttgctctcacctctttaatcacactgaatcatacatcaatcaaaatcttttccttcacacaacaagatccaagcatgtttagatccatgactactcggagagggtatgaaagattaggcaaagaatctgccaccactgcacttttgcatgaggggttcaagaggagcacaagtttgccttcttggggatccaattcttcaagaaaaatggctcttggttccacctatggagaaatcaatctaaagagaaaccccacaaagaagggtaataatagtgacaagaagagtcacccacttctcagcttcttggctcttcgtaggaaaaagaaaacaacagcaaggcctgaatttgcaaggtatcttgagtacctcaaggaaggaggcatgtgggatttgaattccaataaacctgtgatgtattacaaatgatcatagcaagtttgcttcgggtttgaatgcaaaattaatttgttggcatattaatacgttaagagtttatatagtactactactatttgattcttaattatgtccaattactttgacaagatgtagagtatggttacttttgctattaattaatcattcatttgaataatttgcaaacatcaaaagttcatctgccctttttcgataggttttagtaatataattaaagaagttaataaacagacttttttttccccactgaattggtagttcattatgattttgtttttaataacagcttctttttattctattttggataaatcaaaattcataaatattttgggcaaattacaacacatagctgatgtcgtaaggtacaactgattataactagtgattatattggcatacactaaaataatccatgtatttgaaatgtgcgtgtttaactattttgaggaataaaggatattttgcaattgatggattcaattatgttatgcttgtctgcttcattagatcctattttagttggatcaattgtttagaggcaaatttatttttaaatttgaaggaatttgatgacgcgcaaacttataaaataataataatatatacatggaaacccaatatacccattgacacc

SEQ ID NO: 4137 - DNA, 2627 bp, Unknown
  Kingdom: Plantae, Phylum: Streptophyta
tcaaaactcatgttaacctcaattgtaatctccctcttccatttatctattccagtgtcaaatcctctgtctctcttctctaccaagctattattctgaggatgcaacttcttctacaaggcatccttttctcattcttggtcataaccatcatcctaaaccagattccaacatcttgtgctgatgatgatgtgcaatatctgaaatgcggttctccttttcattgtgcaaatctcaaaaacctgagttatcctttctggggattcagtagacccctatactgtggccaccctgcgtttaagctacaatgcacagatgaagtagcaacggttaccattatgtcagagagttagagagttcttgaagtcaatgactcttatcatggacccaaacttgtaagaactgactactggaacaatacttgtcccactagcctcaggaacatcgccataggttgcactttcttcgattatggttcagattctcagaacctgactctctactatgattgttcttcctctccatttcctcaaccagatagcttttcctctcagtttaattgcagtgtaaacgaaactcaaatgattaactattttgtgacggagagcatgcttgaaaatgctgggtcaagtgaaatactgggaacatacaaatctagagtagttagttatgaaagtttgaatttggtcacagcttccgtaatcaatttcaagagtcttgatatattatggttcgcaatcagatattcaagtcaaaagttctggaagtttgttcaaattttggagtcagaagctgaagttctagaaacaaattcaaccgtggaaaatcttaaggccgctcttgaaaatggttttggcgtggagtgggaagcaaacaatagtttgtgtggtgaatgccaaaactctggtgggcattgtggttatgacccaatctcaagtgaattcgcttgccattgtagcgatagatcttttccatctacatgtaaatcaggtagcagcaaagtagctgttgcaataggcgctagtgtaggagcagttggagcccttgttgtcattcttggatgtgtgtactttgtgttgcaaagaaggagaaaaattgcttataataaacaaagaagcagcatggacctcttcatgcctccttcaagcggagacacttttgcatctacaactaacacgtctcaaagtctatcttcttaccaatcctccaacactgacccaatgccgccgaggagtaactactttggagtccaggtctttacctatgaggaactagaggaagctaccaaaaactttgactcttctaaagaacttggtgagggaggttttggcactgtctacaaaggtgaactcaaagatggacgtgtagttgcagtgaaacgccactatgaaagcaactctagacgtattgagcagttcatgaatgaagtccagattctagcccggttaaggcacaagagcctggtgacactctttggatgcacccatagacatagcagagagcttctccttgtttatgaattcatacccaacggaacagtggctgatcatcttcaaggaagaagcacaaaatcaactaatttactcccttggcctataagattgaacattgcagttgaaacagctgaggctctagcctatctacatgcaaagggtgtcatacaccgcgatgttaaaaccaacaacattctcctggatgataacttccgcgtcaaggttgctgattttggtctctcaagggatttcccaaaccatgtcactcatgtgtcaacagctccacagggaacacctggttatgttgaccctgagtattatcagagctaccagctcactgataagagtgatgtttatagctttggagtggtcttagttgagctgatatcatcattgcaagctgtggacatcaataggaatcgcagtgatgtgaacttggcaaacatggctatcaataaaattcagaaccaggaactgcttgagtttgttgatccttatcttgggtttgagagggattatgctattaggaggatgacaacaggagtggcagaattggcctttaggtgtttgcagcaggaaagagagatcagaccctccatgaatgaggtggtggagatcttgagaggaatcaatagtagtgatgggcttggcgcacgggaagagacaaaagtattggaagttaggacagatgaagctatacttctgaaggtttccccggtttcaccagattccgttgttgataaatgggttagcggttcctctgtatctaattcctcatagcttctaagatttccttttcttttggtgaagaacaagattagatagtgaaactactgtactagtgttaatgagctagtttagaagtcatagccttcacatctatttccactaaaaccttatgtttaaacttttatttgcggcttgtatgttatgatgtgaaatatagtactatttatcagaaggtgaattcactgttgattcaaaaatgcaatacccacaggggagagaaaaataatacatatatttgtggtgtaaatactcttctatgttagttgctttgatgatgtgcttttgagaagaggtttgttattcatctcatacaatattttatacaacaatatttttctgtattta

SEQ ID NO: 4138 - DNA, 1872 bp, Unknown
  Kingdom: Plantae, Phylum: Streptophyta
actgcatgtacatccatcaagatccacattaagcaagttattcttagattcagaacaggaatattggtgagtgaagaagaattaagaagagaagcaagaatagtgtcataggatgtatgtgactaggcctttgtctctgtataagaaatctgcagatgctctctcattgcctccacctgagggccccaattctggtattttggtgatccaagatgaagatttggtgccaacctcttgttttgggttgggagagttccatgaagtgaaggagttgcctttccctcaaaatctaaaccttgagttgttctatagatcaggcatttcactgaatagaaccactcactaccaccatgttgccttcattccagttcttaaccagcccttgtcttccaacaaatactatgtgataaatctcagtgggaaaaaaagaggggaggcatacattaactcaaagggggaagatttggacacattctgtttctacaatgctgtatctgatgtaccactacatccaatagttatcaatgacacatatcaagagtttgagatatttcctagaagaagcaaagttactttcaggagtggtttttcagctaaatctgttgccccagatggataccctccaagatttttgagtacaaggtggaaagtgagtgcttcaacttcaagtgattctagcctaggagaagcatcaggtgtgaatgaaaccctccgtgccagcaagccagagttccaattctccttagcaaaaaagagttcagatagtgttgttgtgggaaaatggtattgccccttcatgtttatcaaggagggaactcacaaaacattgaaggaagaaatgagaaagtcaatgttttatgagatgacactggagcagaaatgggagcaaatcttttcatgtgagaatgagtatggaatgggaaacactgtgaatgtggatgttgtggttcaaaaggaagtggttgtaattgctggctgggaagcagtgattaatgagatggatattgctgaaggttttgtgtggtttaatagtgtcaacaatgttggagaaaagagtagtgtgggattgagcactgcagtagttgagagaatgaagtgggagcaggaaagggtagggtggaatggaggaatagagaagcaaattagagttaagaaagtggaagaatttgaaggcacaaatgggtggaagaaatttggatgttttgtgttggttgagacttttatactaaaaacattggacggaagcatagtactaacccatgctttcaaacaccatgatcaactcaggagtaaatgggaatgaagatttctggaattggttttagaccaagcaaaactcgtccaaatttgtttgcaagtgtatatcccgtaggtctttgtgaaagaaaagaatgacttatcttgtagtatgcttccaattttgtaagattttgttgactaagtttgttcattcattcagttttttcagtgtaatcattttgatattgcataaagattataaggataaactgtcgagatcattcttcatgttctttttgcatcaagagccccatggttgatatggttcaatatattggattaagtattgaatcatgtgcctcgagtaaagggatgcctgtattggaccatgagactaaatctcagatgtatcgagtcacgagcttcgaatctgtctctaaacatctcaaggaaaaaattgtgtttcctgaagagatacctatatatgaggataaaccacaaatgtattgagtcacgagcttgaaaattgaatgcattgaattgttgagcaaaacttactcatagaatcaggtattggaagactaggtttgacaagtaattttagattttagtagcttataagttactaataaa

SEQ ID NO: 4139 - DNA, 2445 bp, Unknown
  Kingdom: Plantae, Phylum: Streptophyta
cttagcatgttttacttctggaacataatcaaacactccagaagtctctagccagctctgatactttctttcgtaaattctcgaactcactctgaaatttctaacggtgacaataaattgcgttcccggttctctctctcctcgctcatagttactgcacatacgaaactactctacaaacacaacaaaactctccaattctgaagattttcttatctcttgtctttgaaactagaagctccgtgattgatcaatggcgacaaaagaaggcaaagccataggcatagacctcggcacgacctacagctgcgtgggcgtgtggcaaaacgaccgcgttgagatcatccccaacgaccaaggcaaccgaaccaccccctcctatgtcgccttcaccgacaccgagaggctcatcggagacgccgcgaagaaccaagtcgcgatgaacccgcagaacaccgtcttcgacgccaagcgtttaatcggtcgcagattctcagactctcctgttcaaaacgacatgaagctgtggccgtttaaggtcgtggcgggaccgggcgacaagcccatgatcgtggtcaattacaaaggcgaggagaagaaattctctgcggaggagatatcttcaatggtgttggtgaagatgagagaagtagcagaggcgtttctcggacacgcggtgaagaacgcggttatcactgtccctgcttacttcaacgactctcagaggcaggcgacgaaggacgcaggggcaatttcgggtttgaatgtgttgaggattatcaatgaacctaccgctgctgccatcgcgtatggattggataagaaggcttcgagaaaaggtgaacagaacgtgcttattttcgaccttggtggtggcacttttgatgtttcaatattgaccatcgaggaggggattttcgaagtgaaagccactgctggtgatactcatcttggaggtgaagattttgataacagaatggtgaatcactttgtttctgaattcagaaggaagaacaagaaggacatcagtgggaatgctagagcgttgagaaggttgaggacagcgtgtgagagagcaaagagaacactctcttctaccgcgcagacaactattgaaatcgattctttatacgaagggattgatttctatgctacaatcacgagggcgaggtttgaggaaatgaacatggatttgttcaggaagtgcatggagccggtggagaagtgtttgcgtgatgccaagatagacaagagtcatgttcatgaggttgtgcttgttggagggtccactaggatccccaaggttcagcaactcttgcaggatttcttcaatgggaaagagctttgcaagagcattaaccccgatgaagctgttgcatacggtgcttcagttcaagctgccatcttgagcggtgaaggagacgagaaggttcaggatttgttgctgctggatgttacacctctcagtctcgggctcgaaactgcgggtggtgttatgactgtactaattccgcggaacactacaattcccaccaagaaggagcagattttctcaacctattccgataaccaacccggggtgttgatccaagtgttcgaaggagaacgagctagaacaaaggacaacaatcttcttgggaagtttgagcttactgggatccctccagcaccaagaggagtgcctcagatcaatgtctgcttcgacatcgacgctaacgggattctgaatgtctccgcagaggacaagactgctggtgtgaagaacaagatcacgatcaccaacgacaagggtaggctgagcaaggaggagattgagaagatgttgaaggatgcagagaggtacaaggcggaggatgaagaggtgaagaagaaggtggaggcgaaaaactcgcttgagaactacgcgtataatatgagaaacacaataaaggatgagaagattggagagaagttgagcccggatgagaaggagaagattgagaaggctgtggaggatgcgatacagtggttggaggggaaccagttggcggaagtggatgagtttgaggacaagcagaaggagttggaagggatctgcaaccccatcattgcgaaaatgtaccagggtgctgctgctagacctggtggagatgttcctacgggtgatgatgacatgcctggtgctggtggtgctggttctggcgcgggacctaagattgaagaagttgactaagcttgtgcatgtgactaactcaaaaactttggttaggttcttgttatttggtctaataatgtaagttttagtgatgatgtaaggtttcaggaatcgtgaataaggtcttttttgcttcatgtgatgagtgtaatatcagagatggagttgagattaatgtaattttttatacagtttgggcttttaatgtatgttttgattcagaaaaactttgttcctttctacttgatcga

SEQ ID NO: 4140 - DNA, 1317 bp, Unknown
  Kingdom: Plantae, Phylum: Streptophyta
atggttttgtcatggacaaaagggagagtgttccggcgtgccagaaaggggaaagagttgaaaaatttcggtggcgacttggagatagacattgcgatccccacccacttccggtgcccggtaacattggacatgatgaaggaccccgtgaccgtttccacgggcataacctacgaccgcgacagcatcgagaagtggatcgagtccgggaaccgcacgtgcccggtcaccaaaacggagttgacaaccttcgacatgatcccgaaccacgccatccgtaggatgatccaggactggtgcgtggagcaccgttcccacggcatcgaacggatccccactcctcgtatccccgtcaccccgtacgaggttgctgacacgtgtacgaggatcttgtcggcggcgcaacacggggacgagaacaagtgcgtggagttggtgagcaaaattaaagcgtggggaagggaaagtgagagaaataagagatgcatagtttctaacggtgctgctttagcactagcgaacgctttcaactctttctcatcgcgtgggttgttaattgagaagaacgtggttgtgttggatgagattctgggtgctttggtatggatgcgtcctctttctgaagagggtagatccgtgttggggtcatcgagttctatctcttgcatggtttggttcatgaacggtaaacaattatccacaaggcaaaacgctgctttggttcttaaggagatgcatgttgaggctttggtgaaatgtgtaggagtttttgaggctttgattaacatgattaaggagcctgttgggagtggttccaccaaggcctgtttgtcaacgattttcaacttggttaataataaaagaggcgtgacgacttgtcaaaggtttgtggaattgggtttggttgatgtggtgttggaggttcttgttgatgcggagagaggggtgtgtgagaaggctttgggggtgttggatagcgtttgtgattgcaagcaaggggtggagatggcaaaggctaatgctttgactttgcctcttgtgattaagaagctcttgagggtgtctgagttgtgttcaagcttcgcggtttcggttctttggaagctttgtgacaagaatattgaagaaggggtgttgattgaggcgcttcaaatgggggtgtttcataaactacttgttttgttgcaagtgggttgtggtgagggaaccaaagagaaggctacggagttgttgaagttgttgaatagttgcaggagcaaagctgagtgtgttcatcattcttcgttggatttcaagcatttgaagaatcccttctaa

SEQ ID NO: 4141 - DNA, 2000 bp, Unknown
  Kingdom: Plantae, Phylum: Streptophyta
gcgtatttgcttagaagctccaacttgaaccactccactaacaaacataaactctcttctccttcaacttccttccttgtcctttttccttacggataagctccatctcctccatcgcttttttattcattcatatataaaaaaaaatatacttttcagattttgcgtttataattaaattcatgattccacagcgccttgactttcaaattccttgttcttcatgtgtgcataccctttgtcttgtaccccagtccacacgtctttcttttccttccctttaaattctcccattctctttctctcatacccatctccatttcctcttcacaaaactcagtttccaattcaccaaactcacaatggttgatctagattggcaaacaaagatggttcactccaacatcatgcctccaatgtcccccaaactctctctcccggatcataacattccaatcccaactttgcaactcccccttcgccaaaacgacatcaccgcagcgtcgtctcctatctgcgctgcatacgacaactaccttcgtctccctgagctcagagccctctgggcctccaaggacttccccaattgggccaacgagcccatcttaaagcccgccttacacgccctcgaaatcaccttccgcttactcgcaaccgttttctccgacccgagaccgtacatcaacaaacgcgagtggacccgacgcgtcgagtctctcgccacggcccaaatccagatcatagccatgttatgcgaagacgaagaagaaaaccccgagacacgtggcaaggcacccgtgactgacattaacggctttaccggtcaaagcagaagctacagcgaggaaagcctgctcccgcgcctcgccacgtggcagaaatccaaggacgtggcgcagaggattctcaattcggtggactacgagatggggaggtgcacctacaccttaggtttaggagaggcgaatatcgcgggaaagaagatatttctcttcgacgcggtttgcaggccgagggagattcactcgttggagacgacgccgtttgatgattacgtggggaaccacgagaacaagacgctgcacgccacgcagcagatcgccgagtgttggacgcgctcggtgaagaagctgctggagagagtaacggagtcggtggagaaaaaggcgttggagaaggccgcgagtgagtgccatgcggtggagcggatctggaagttgttaacggaggttggggacatgaacctcatgatggatccagaggatttcttgaggctgaagaaggagttagggatgatgagaactgcgggcgaaacggtggcgttttgcttcaggtcgagggagcttgtggaggtggcgagggtgtgtaggaatctgagggagaaggtgccggagatattggaggtggaggtggaccccaagggtgggcccgggatgatggaggcggcgatgaaggtttactcggagaaagagaaagggaaggttcatgttttgcaggggatgcaggggattgaggtggcgatgaagaggttcttctacgcgtataagcaggttgtgacggttatgatggggagctccgaggccgataatgggttcaccaagatattccttgaacccacttatttccctagcttggatgctgccaagacctttcttggttattacaaccaaaattaattcttttattcacttcaattccatcttactcacacaaagaaacaaaaaggattgaattttgtaaacaaatctttgtctgtaaaaatatatttatttgacttctttttggatcatattctttcgatcatatccccgcttttgaattttaaaagtggtggtgttttaaaatgcattacagcaaacaccttttttctttcaatgtgatttagctttcaaagctgtggcagttgtgctacagatggtggtgatgctgggtgctgacagtttctacttggcttcttaattatttcttgcaggatcaattaattatatctttgtagctag

SEQ ID NO: 4142 - DNA, 2503 bp, Unknown
  Kingdom: Plantae, Phylum: Streptophyta
gtcgggctcaacctttgacattaggcttccaagtctttctcattgttgttactaataaagtcacaccattgaaagctcagaggcacaccaccttacttctcaatccttctttcttccttctctcaccgtcaaaaacaattcctcatctgccaaatccaatgtttttgcctcaaaactcataagttcacattttttaaaatttccatttactttgcctatcctcatcttcattcattttcctcttgttttaaggttttgcttctgattgattgattgattgcctttgagagaaacttgtgaactcagttctttctttctttcaccctcttgggtaagctcagaaacttccataaagaaacagagtttctccctaaaattctgttaggtgtttgatctaggattttcattgggtccaagaaggaggatatcattgctatgattttgaaggtttctctcattgtggttctcctagtgatatgctcctgtgttgtggaagccatttctaggaatcacaatcaaaatcccaaccacaacaatatcaacaaaaatggatcttctctggctgcaataaagtttcctgattatccaagtttcaatgatgtctcttcttcaggggacgattgcagcttctcaaattctgagcaactcggacattctggacctaccatgacatcgggtgaagaaactgatgaagagagtgaagcttttccagcacaaaaaccacaccagaatttggtgaaattccacttgaaacacaggtcagggagcaaagatgctgagccgaaacaatctgtggttgatttcacactaagtgatttgaccagaattcagaaccttcacagaagggtcatagagaagaagaatcaaaacaccatttcaaggctgcagaagtcacagaaggagcaaccaaagcagtcctacaagccggtggttgctgctccggcagcttcacggacaacaagtccagtttccgggcagcttgtggcaaccttggaatccggggtgagtcttggctctggagagtacttcatggatgtgtttgtggggacacccccaaagcatttttctctgatacttgatactggtagtgaccttaattggattcaatgtgttccatgcattgcatgttttgagcaaagtgggccatattatgaccccaaagattctagctcttttaggaatataagctgtcatgatccccggtgccaattggtttcagcccccgatccacctaagccttgcaaggctgagaatcagagttgtccatacttttattggtatggtgatggttccaacacaactggggattttgcattggaaactttcactgttaatctcaccactcctaatgggacttccgagttgaagcatgtggagaatgtgatgtttggatgtggtcattggaatagaggcctatttcatggtgctgctggtttgttaggattagggaaaggaccattgtcatttgcttctcagatgcaatctctctatggtcaatccttttcctattgtcttgtggataggaatagcaatgcaagtgttagcagcaaattgatttttggtgaggacaaggagctgctcagccaccccaatttgaatttcacttcttttggtggtgggaaagatggttcagttgacacattttactatgtccagataaagtctgttatggttgatgatgaggtgctgaagatacctgaggagacttggcatttgtcttcagaaggtgctggtggtaccataattgattctggcaccacattaacatattttgcagagcctgcttatgagattatcaaggaggcttttgtgaggaaaattaagggctatcagcttgttgaaggccttcctcctctaaagccatgttacaatgtgtctggaattgaaaagatggagctacctgactttggaatcttgtttgctgatgaagcagtgtggaattttccagtggagaattattttatctggattgatcctgaggttgtttgtttggctattttggggaatcctcgatctgccctttcaataattggaaactatcagcagcagaatttccacatactgtatgatatgaagaaatccagacttggctatgcaccaatgaagtgtgctgatgtttaacatttttcttggggttgaaaggtgtctactgtatagtctcataattgtaaacatggtgagtcaggggtagattttttaggttttcccttaggtggaaattggaaagtgatatacacaaaaaaataaaacaaggttccaggtaattacagaaaactggatcattacaaacataaacatttgttttgtacacattttaactgcttcaatttttcatttaattttaatattttgttctttctattctatatatgatgttctgtcttactatcattctggacatgttattgttttttatattctcaaaggaaaattgctccgtgtatatattatacaagaaataaagaaacttggcaatgaagttctgtatcccgagtctctaagt

SEQ ID NO: 4143 - DNA, 2333 bp, Unknown
  Kingdom: Plantae, Phylum: Streptophyta
atggccaaccgggaccgaccagtaaacggaaagcgctccatgctttcccttctcaaaaccggtaacctcgtattaaccgacgctggccagtcaatagtgtggtccaccaacaccatcacctcatcgaaacaagtccagttacatttctacgacaccggcaacctcgttctcctagacaactccattgctgttgttctgtggcaaagcttcgatttcccaacggacacgcttcttcctggtcaaacactcagcaagaacaccaaccttgtttcgtccagaagccagaccaactattcctctggtttctacaagctcttcttcgactccgagaatgttctacgcctcatgtaccaaggccctcgagtttcaagcctttactggcccgatccttggcttcagagcaatgatttcggaagtggtaatggtagattatcttacaacgataccagggttgctgtacttgatcatttaggctacatggtttcttccgataatttcactttcagaacaagtgattacgggactgtgctccaacggagattgaccctcgatcacgatggtaatgttcgtgtgtatagcaagaaagacgtagaagaaaaatggtcaatgtcagggcaattcaattctcaaccatgttttattcatgggatttgtggacccaatagtatttgtagctatgatcctaaaagtggtagaaagtgttattgtattaaagggtatagctgggttgatagccaagactggtctcaaggttgcattctaaatttccaaatctttgggaatcgaacttatgaagaatgtgagaatctgtgcttgggattgtcccaatgcaaagggtttcagcacagattttggcagccagatggtgtgtttatctgtttcccgaagacgcagttgctaaatgggtatcatacaccaggtttcacaggatcaattttcttaagactgccaagaaatagtcctctgtcgctcagtgacagtgagaaccccatcaattataacaacggctttgtttgtgggggaagtaatggaggactgaaactactggatagaccatatgtggaagaagaggaaaatgaatcagtgaagctcttgctttgttttgtgactgccttgggaggaattgaggttgcgtgcatctttctggtgtggtgtttcttgtttaggaacaaaaataggaaattacactcgggtgttgacaaacccggctatgttcttgcagctgcaacggtatttaggaaattcagttactctgaactgaaaaaggcaaccaaaggtttcagtgaagccattggaaggggtggtggaggtactgtgtataagggtgtcttgtctgatagtcgagttgtggcaataaagagactgcatcaagtagcaaaccaaggagaaagtgagttcctggctgaagtaagcatcattggaaggcttaaccacatgaacctaatcgacatgttggggtattgtgcagagggaaagtatagattgttggtttatgagtacatggaaaatggttctttagctcaaaacctctcatcaagttcaaatgcacttgattggagtaaaacatataacattgctgttggaacagcaaagggtctggcctacttgcatgaagaatgcttggagtggattctgcattgtgatattaagccacaaaatatacttctcgactctgattataaacccaaggtagcagattttggcttgtctaagctacttaaccggaacagcaacctcgacaattcaagtttctcgaggataagaggaacaagaggctacatggcaccagaatgggttttcaacttgccaatcacttccaaggtggatgtttacagctatggaattgttgtcttggagatgataactggaaggagcgcaacagcaggtacccaaatcacagaattagaagcagagtcgtatcatcacgagaggttggtaacatgggtgagggagaaaaggaagaaaggatcagaagtgggatcatgctgggtggatcaaatcgttgaccctgctttggggtcaaactatgagagaaatgaaatggagatattggcaacggtggctttggaatgcgtagaggaagacaaaaacgcgagaccaagcatgagtcaagttgccgagaagctgcaaagatatgcacacacttcttgatggttggaacaaagaaaagccatctctcccatgacagcaaaatcactaccgttgtttatcatcctcctttcgagttcatattaataatacaattaatattttaagttcagttaggaagtgattttacttttattttcatttatttgttacctagttctcttgttaaattagtacgtaaaact

SEQ ID NO: 4144 - DNA, 1004 bp, Unknown
  Kingdom: Plantae, Phylum: Streptophyta
taaaccctcttcacctttcttctctccttacaacaaaccaaaccacttaaagttttaaacacacttacaaaatcatagttacaattacacactttcactagctattacactttttgagggttttttttttcttctactatatatatgggggcaagctcgggtacagtactagagatcacagttatatcatgcgaaaaccttcgtgtcacggaggatccgtacgttgtcgttagggcagagtccttaaagtgttgcaccacgaagatggcgaaagatagtgggagcaacaaaacgggtttgttttcgtggaacgagaagttgatgctgaacatgcccatgcatgcaaggtccatcacgttcgaggtgcaatgcaacaggttcaagggtcttcgacccgtcggggtggcaagaattgcggtttccgattttctcggcggcgctgccgtgtcggaaaattgcttgcatgagttgagttaccggctgagggactgggaagggaagggaaacggggtgattcatttcggggtgagggtggtgccgccggaggaacgttcgaatgctgccgtgaaaccggtgaagggaatgacggtgagtaaggattccggtgattataagtcaaatgaagttgttggtgtcccgttttggtggaactaccctaacgttatttgaatatttgtatttttctattattttttttatttgttgaattaatattggtaaaggaggtgtggaaattaaagtcaagtgaaaggtgaaaggttcatgttatttgagagaaattttgtcttgtacgtcaacttccagtaaaacaaagtattatatatatagcagatgatgtgcttgggagtcgtgttttagaattgaaggtgttttattttattttattttattttaataagtgatttttagttgtgtaaatatttaaaatataaaaaattgtatatttgtataaatttgattttttttcttcctttaaaattcaattcctaaacatactgagaact

SEQ ID NO: 4145 - DNA, 1204 bp, Unknown
  Kingdom: Plantae, Phylum: Streptophyta
atgtttgaggtccacacacacgttacgaaaaacactcaaaaattcgaaacaaagtcatcattttctcactcttataaacccccttcacccctcttctctccttacaacaaaccaaaccactttaaacacacttacaaaatcagttacaattacacactttcactagctattacactttttgagggttttttttttattctactatatatgggggcaagctcgggtatagtactagaaatcacagttatatcatgcgaaaaccttcgtgtcacggaggatccatacgttgtcgttagggctgagtcgttaaattgttgcacctcgaatatagcgaaggattgtgggagcaacaaaacgagtttgttttcgtggaacgagaagttgatgctgaacatgcccatgcatgcaaggtccatcacgttcgaggtgcaatgcaacaggttcaagggctttcgacctgctggggtggccagaatcgccgtgtcggattttctcggcggcgctgtgtcggaaaactgcatgcacgtgttgagttaccggctgagggactgggaagggaaagaaaacggggtgattcatttcacgatgagggtggcggcagcgccggtgaaggggacggtggtgagtaagggttccggtgatgggttcgtgggaatcaacgttggtggcaacaagtgcaacgaagttgttgttggtgtaccgttttgatatggaactattatccactggtatcctcaattagagttaatcatgttcgaattcgaattgagtaagacagtaaaattattttttcaagtatggaatatttgtgtgtgtacagaactcaaatttaaaatttttagttcaactgaaacaattttatattggttgtttggtggtatatatattatcctaaagttatttgtagataaatgttatttttgtaaattttatttatttgttgtgtattggtcattgggagtgtggaaactagaaactccaaagtcaaattcaattcacttatatattgtggcaaaacaaggttcatgttatttccaggaaatattgtcttgtaccgttgtacgtcaacctccttgtattttagtaacagaaagtgtgaatataaacgtgaaggttagacttagatgtggggtttggatagtctgtatatagtatataagattaagttttttgataagtaaacttttttataaagtgaccaaac

SEQ ID NO: 4146 - DNA, 1171 bp, Unknown
  Kingdom: Plantae, Phylum: Streptophyta
acagcgcattcgcgtacaaaagaagttgaagttcaattcaaagtggaaagtcaaaaagtcaacataaattttacaaaccttaagaacactgaaacaacaaaccaatttccttccttctttctttccctccttcacactcatttccaaaacccaaacaaaaccttatatataaccatattaaccacttcttctgcttcacacaaacccaacaacaaaacacaaaccaaatagtttcccacaagcaacacacattacttcattttctttatttcttttgtttatacggttttttccttggaagagaattattcgaacctttaaaacataaacatgggaataagcacacgtacgctggagatcacagttatctcctgcgaaaacctccacggcgtaaaggacgacgcgtacgtggttgttcgggcggagtccttaaactgctgcaccaccagaagggtcaaagtcgacgacggcaccaaaaaacttctctcgtggaaccagaagttcttgttggacatgcccatgcatgcaaggtccataaccttcgaagtgcaatgtaacaggttcaagggctcccggccactcggggttgcccgaatcgccgcctccgatttcctcggtggcgcagccctgccggagaatcggttgcaggtgctgagttacgggctgagggactgggaagggaagaggaatggggtcattcatttcgccgtgagggtggccgcatcgttgaagacgacggaggaggagtgtttgaatatgaagcccgccgtggaactggtggtggcgagaaagggttgcggtgatcgaatcaatgtcggtggcaagaggtccaatgaagttgctgttggtgttccgttttggtggaactaccccaacattatttagagattagttaattaatttacattatttatttttgtataacggtcaaggagcctaaaagatcaattttaatttcaattatatataaaattttcatttttttttaagtttttcttttcccttaaaatataagatatgtttggtgataaaagatgaagaaaaagaaatagatcacaagtttaaattctcccaattacatatatcattatgcataaaatgcatgccaattatatttccctaacttgcactttagagtttcaagaaagaaagagtatgacgtatgaacaag

SEQ ID NO: 4147 - DNA, 1762 bp, Unknown
  Kingdom: Plantae, Phylum: Streptophyta
ccggcaatatatttgaataaaaaaaaatcctctctaaaaaaaataaaagtctttttaaagagacaaacgaattcttaataaaataataaatgtcccaccttattccattctcatgcattggaaaaccgcgccccaatcacacactcttcacatctgaacatcgtgttgattcactactctaacctttgaccgttacaacacacgagctaacctccacaccctgtttcaacgaaccttcccagtctcttataaatattcctcaaatcttgcgccaacatcattggactcatgcaacttgttgttgtttttttttttttcttccttcttgatccttcacaccttcacttgattctttcattttcctcaaaactttcaaacacccacttccccattttcttcttctgcatcctcacaatcacttcttcaaatctcccttctacaaaaaactcatttttcatcacacagctttgggatctatcattcaatccacggtttctggaatgaaactccccgtgttaggtgttgttcatcatcatcatcatcatcatcatcatgtttaacataccttcatctctttctgaaatctgcctcacccactttcgccttgcaatctccaccgcggatccatggcccttctcatgaatctcaccacacgctaccgaaaacctgcaataaaaacctttttccactcttttttatacttctgaaaagtcccacattgtttagaaaactctaccgagaacagtttataaatcctccgctgagaaaagatactagtgatttttgtcaagacgatgcaattcagactcggcaagcgcgttgtaagggttgctaaatgtgtcttccgtcggatcagggtcagaacccgacccggatactaccaccgtctcggtggttcgacgacccattctaagaatcccataacaacaaggcttctcacgtgggggcaaaaactgaagagaggagcgaagaccctatgcgggaaaaatgggtcgggttaccttccaatagggtcggatccgctttgtgacagggctccggcggtgccgaaggggcacttggcggtgtacgttggggaggaggacggcggtttccggcgcgtattgattccggtgatctactgtaaccaccctctgttcagcgatttgctgagggaagcggaaaaagagttcgggtttgaacaccccggtgggatcacgataccgtgccgacttaccgagtttgaacgggttaagacccgtatcgcgtccgggtcgggtcaacgcgggaggacccggagattgggttggccgctacaacattattgaggacccggaggttggtcaattacacgatgacgacgataacgagttatggtgttttggaatttttgtttttttcttcttccttatattaggttgtagtttttgtttttgttgggaattcttagggtggtgttaggtttggctctttgggtagatctgatgggacatctggtgtaaatggtggtttgaacataaaagcagaattagggatacttatgtatagattaaattctagaaatggtttttattttccttcttttttctgaaaaataattcaggtgagtttttttttatcccgtggcacagataccataattgactagaagaattttcatacacgtaggaattagagataggaattagaaattaaagatgagattcctccactcgtcgataagatgagttgatttgagttttgtaggtgaataaatcttaaaatctggaaaatacttacaaat

SEQ ID NO: 4148 - DNA, 2069 bp, Unknown
  Kingdom: Plantae, Phylum: Streptophyta
ctcttatcatacataaaatgctccattccttctctcttctctcctcaatttcaaacccaacaaaacaacaacaccaacaccaacaccaacctttttcataccttaattcttgagtttgagcatgtctttcagtttcactgaccttctttctactaacaacaacaatagcttgaacatggatgatgatccctttggacttgaatttgctaataatttcaagtcagcttcactgcctctctctccttcttcaatctacccttcttcttatgctgagttccctcctggttttgtcccaacttcacagtcattgaattcacaccactttttttcttctcaaattgttcctgcatcttacacaactgagcaatcttctagcatgagctacaacatgagaaacacttcaactgagggtcaacaaggaaacaaggaggaagagagaaactactctgacctctctttcctaacaaaaacaaaccacgtgcctctctttcaatcttccacaaccatgtttcaagtggagccactaaagaaacaggacacaatgatatccagtgaagctgcaaagcaaacagatttctcatctgagaggacagaaacaaaacctgaatatccatctactcagggcttctcagcagcattagcctcaatcaaacctgaaatacaaagcaattctgctcctggttctgttcattttaactccacttatgctcctaagtctattagggaacaaaagagatcagaagatggttacaattggaggaagtatggagagaaacaagtgaaaggaagcgaaaatccgcgtagttattacaagtgcacgcacccgagttgtccaacaaagaagaaagttgagaggtctttggagggacatatcactgaaatagtatacaagggaagccacaatcatcccaagccacttggtagaaaaaatggttctcaatcaattcatcaaacttcttcgtcctgcactaactcagggatttctgatcaatctgtgggagaggaagatcttgagcaaacatcacagactagttattctggagggggtgatgatgaccttggaaatgaggccaaaagatggaagggggagaatgaaaatgatggccattcctattcttctgctgggagtagaactgttaaggaacctagagttgtagttcaaaccacaagtgaaattgacatacttgatgatggatataggtggaggaaatatggacagaaagtagttaaaggaaatccaaacccaaggagttactacaaatgtgtagccccaggttgtccagtgagaaaacatgttgagagagctgcacatgatatgaaagctgtgattacaacttatgaagggaaacatatccatgatgtacctttaggacgaggaaactcaagctatagcatgaacagaacttctctaaacaacaacaccaacaccagcaccagcaatgtaacagctcctgcccctattaggccctcagcagtgactaattattctaactcagcaagtttcacaaactcacttcatgacacaaagccaccaacatctgcaagccaagaaccttttccaatggacgtgttgctgagccccggaagtatcggatttgcggctaatgacctgttccttcagtcttttttgtcaaagaacttttaaatttggaaacagaagaacactagaacgttacacataaaaatatcactgatatgtttatgtatagaatataggaataagaaaatcatgagcttctactaactttggtgtactaaggttagagactagaactacaactttctaaagctagacaagagttaggcctagtttaaacttccaatttagtgataggagagacagaaaacgtgttgaccttgaattctattattcttttgttgcttttgttcaattgctttctaagattaattctagttgttggaaatttctactttggtatacaaatgtctactcttactagttatggttactttgggttgtgttgttgactataaatttttcaatcaaagtccttgtttgttcaaattatgaaatagtcagcgacttctgatttaatcaggaaaatatt

SEQ ID NO: 4149 - DNA, 890 bp, Unknown
  Kingdom: Plantae, Phylum: Streptophyta
acactactaggcttgctataataatcttccttacttgagttacttcctacacccatggctaattcaaaaactctctcgtccactttcttcaccttcctaacccttacctttcttttctccttcctagtcactgccaattactaccaaaatatccctccaacatacctaggtttccgtgaggagaagctcacccattttcacttctattttcatgaagttgttacgagccaaaagccttcccttgtcatagccaccgagcccctaaagggtaagtccaattgtccccttccatttgggtccatagtggtgatggaggacccattaacaattgggcccgaacttgactccaaactggtgggaaaggcccaaggattttacatatcttctgcccaaacggagggtttggagttggagttggtcatggggatgaccttggcgttcatagaaggggaatacaatggcagcacactaagtgtgttagggagaaacgccatcttctctcaagttagggaaatgccaattattggtggaacgggtgcttttcgctttgcacgtggctttgttcaagctaggagtgtcaaggttgattaccaaaaaggagatgctaccgtggaatacaacgtatacgtgctccattattcatctcacgaggactttaactaggcctatactatttccacccgtagtttcattgctataagagttttattcacgtgtgtgagttagcactataatttatagaatttgtatcatagtttattttataaatctgataaaatttttgtgagtttataaactacctcgtgcacataaataagttcataaattagaatacaaggggagaatagttccaaattcactccttttacaacttcgaatcgtaaataaac

SEQ ID NO: 4150 - DNA, 760 bp, Unknown
  Kingdom: Plantae, Phylum: Streptophyta
tactagtccatagcatagcatcataagcttgggaagaacctcactgaagaattaaggagagaaaaatcaacatcaaagttataacgatgaagcccattgacgataaacaagagacagtgacgatcagagcggtgagccacgacgaggaagggagaaagagggtggaaaaaatagagctcaacactcacaacatccacactataaagtacgtcgagaagaagctcatcaacaagggtgtgcagcgcaaggaccgccacccagccgacggcatcagaatcggccggccaccgccaaagtccggccacggcggcaaattcacgtgggagggcccggctagcgtggaggataacgagctcatgacggagccggcggccatggacgaaggagaccccaactacttggactgggaagagagaggagaagagacgtcggagttggtcgttggggaggttgaagtggccaaggttgctgaggaacacgatggggttgctagagttgaagttgatcctcgcttgcgtgttatcatgtctgatctatgttaattaatcttgtttaagtgtgggtggcttttcatgtggacttttacttcaaattgtaaatttgtaatagtacatcaaacgagtgtgatgtggaagttgttcttcttccaaaataaaatttgcagacttttcccttctgtatatgactttcttattagttggtgcagtttcagttgatacattgttcttccaaaataaattgcatactttttccttttgta

SEQ ID NO: 4151 - DNA, 624 bp, Unknown
  Kingdom: Plantae, Phylum: Streptophyta
atggcagattataagcaacaccacggaagaagctgcggctgctgctgcctctttggaatcttgtggaagattgtggttgcactcattgtcctcgttggtcttgtattcctcatattttggctggttgttcaaccccgctacttcaagttccacgtcacggaagcggacctaactcaatttgagtactatccaaacaacaacacccttcactacaacatggtcctcaatttcactgcacgcaaccccaacaagaagctcagcatatactacgacaaagttgaggcattagcattctacgaggatgccaggttcgccaattacgatgtcataactcacatgaactccttccgccagtacaagaagagcaccagtcccatgagcgccgttttctcggggcagaaggtgttgatgctcaacaacgaacaagtctctcagttcaaccaagacaagagtgttggagcttatgatatctatgtgaagctcaacttcaggattcggttcaggctcggggactcgatttcccgtcacttgaagcccaaggtcaaatgtgatctcaaggttcccttgaacaaaagtggcacctttactctgtttcagaccaccaagtgccatgtcaatgtctag

SEQ ID NO: 4152 - DNA, 1148 bp, Unknown
  Kingdom: Plantae, Phylum: Streptophyta
tatctcacaaccaaccaccatctctgctctccatcaagtcccctattacattacaattcaccattaatattctcttcatcatatactttcccttgataataatttcttggttacatcaaggtacatattttctgttcattcattaactcatctgcaaacatggccgataagcaaccccacttgaacggcgcttattacggtcccgccattcctccggcggagcaaccacgctaccgccctcacagtcaccgcggaagaagctgctgttgctgcctcttcggaatcttgtggaagattctggttgcactcattgtcctcgttggcctcgcggtcctcatcttctggctggtggttcaaccccgttccttcaagttccacgtcacggaagccgacctaacacaatttgattactataccaacaacaacacccttcactacaacatggtcctcaacttcactgcacgcaaccccaacaagaagctcaacatatactacgacaaagttgaggcattagcattctacgaggatgtcaggttcgcaagttacgatgtcataacacacatgaactccttccgccagtacaagaagagctccagccccatgagcgccgttttcacagggcaacaattgctgatgctgaacaatgatcaagtctcagagttcaaccaagacaggaatactggtgtttatgacatctatgtgaagctctacttcaggatgaggttcaggctcggggactttatatccaatgactacaagcccaaggtcaaatgtcacctcaaggttcctttcagtaaaaatggcacctttactctgtttcagaccaccaaatgtgatgtcgatttctagggactacactttttattagattggttttaatctggacttttctttctttaatctttattttaaatttttataattagttatgtaacttttgtgattattttattcattcttttacctatatgtttgtaatgtatatgatttcttgcaataatatttttgttactcctgtttatgcagtagtgtatatcacggataagcacttttgcgaatagccaaatacacaatttgattaccctactaattgaaattgttgccacgaaacatatgtatgtatgtaaattgttattgtttaaggtttt

SEQ ID NO: 4153 - DNA, 738 bp, Unknown
  Kingdom: Plantae, Phylum: Streptophyta
aaaaaaatcaaatacatctgtattattataaatgcagattgcaaagtctaccaattcagactagaccatggcgtttgagttttgacgattgtctactttcaaccaacacgcaccattactcattcatatagtcatactatatatacttgatgtaccaccgataagcctacaccacttctcaaattctaaagctcaagccttatcagcaattcaacatcttctttacatacagtaagatatgaattcccaagcaacaagcagacaaaagcagttgcagggtccaaagcctgcttctctaatgattaacagaaactccacaaagatcaataagaagcagaagcagcacctctcacatcattccccagttatagtgcatttgaaatctcccaaggtcattcacgtcaggcctgaagaatttatgagtctcgtgcagcagctaactaggaaccccgtatcagcagcttttgctgctcccaaaatggacaagagtagcaccgtggttgaaaacccaatagaggattttactggttgcataggtcacacttccaatgttcctgttgacttccaagctttaatgcactttgtagattttttttaatcgctccctcagtttttctagctagctgttttcatagttatttccaaatcaatatatctgtgcaaaaactaaattaacttctgtgtctattctaacccagacttcaaattaatcatgattacatgagctatttgcatctt

SEQ ID NO: 4154 - DNA, 1521 bp, Unknown
  Kingdom: Plantae, Phylum: Streptophyta
gctagttgacagtgaatagtagagatagagaggctgcgggtaattgaaatttatgaataaagaagaaagattggatcccggagacgtggaaggaagggaaagcaaagcaaaagatgttgttgaatactctgttactattatgggtcaaggccaagttagaccagtccattctggaggttctccaaccagactagtcctctccaacttggtttctttttatacaaccttcccactctcattcttcaatcaatccaacccaaaagaccctttctttcaatattcatagcatcatcatgggtgactcttccgcggctaatgaccatttgggtgaatccccggccgttgagttaaccggaaagataatgattgtggttattattatcatgttcttcgttattgtaattgctctctgccttcatctcttcgccagaaacttctggtggcgcagccctgctccccaatctcgcagccaccgccgccgccgctttgttttctcgtccggtccagacggtggaagcggactggatcccgcggtgctgagctccctaccggtgttggtattcgaaggccatgcccaagagtttaaggatggtttggaatgtgcggtttgcctctccgaggttgtcgaaggagaaaaggccaggcttttgcctaaatgcaatcatgggtttcacgttgcttgtattgacatgtggttccaatcccattctacttgccctctttgcaggaaccctgttgcatcctcagaagaatcttcagaatctcccacttttcccacaaacgtcttggtttgggggaatcaagctcaaataagttctactggtggtggtggtgcttctttggaggaaggttcatcctcatcctcttccgcttctacttgtgatgatcatggaatgttggtgattgatataccaagtgagatgacttcaacctctctgtcgcctgaagatgacgtcaaatcgcctatgacgggaagactcaggtcattgaagaggcttttgagcagggacaaaaggtttaatccttccagtcctacttcttctccagatgtacaacaaccaggatcagggagctgagttaggaattatttcccaatcatattcattattttttctttttttcttttctttcatgtgcacatattgcgcattcaggtgactgaagattgtatctaatgtttgcaagtacaccatgagggtgtttaatttttctgttcttcagaggtcagagctcctccagctctcatagatgtgctattattgtctttccgatacttgtgcatataatgccttagcagattcattgtttcattgtctttgttgtataaagtataggtttctttcaagtaatgcaatagaatgatcctctttcttttttattggagatgttttaattggacctttatttgcaatcagcatgaccaaacaattttagttccttgtgaagtgaaaatgatataatatgggattttgtctcaccgctatttgccagcagaaatttgaatatagtagttgcattgga

SEQ ID NO: 4155 - DNA, 1362 bp, Unknown
  Kingdom: Plantae, Phylum: Streptophyta
taatgcttggacgagaaaaaaagtttatttattattaagagagagagagagactctgcagtatcatagaccttttcaactttttcagttactatttctattcattcaaaatctatccattctttttttaattcccccccactataaatatgtatcctttcacaccaagctcttgccagacaactctgattctatgcctacgtcttcctccaaatcacaacacacccaattacaccctctgttctctgcaaatgcggtgaaggagaacacttggctttaatttggatctggatatggcgattgaagcacagttgtatcccaacaatgctcctccgtttccttttcacgtgtcaagggtagacaaatctccagcagcatatagtcatagtcacaggcaacaacaaccaggtggctggcagatgaatcagaacattcctcttgttcctcccaacttttcttgtttttccaattccaattccaattccaattccaatgtcctccaaaacgccttcaataagaatgttgttcagccttcagcctcatatcctcaatgcttggctattgagtttgatcaacagagggagattgatcaccatatcagatcacataacgaaaaattgaggattttgttgcaagagcaaaggaaacagcatgtggcagagttattgaagaaggtggaatcgaatgctcttcatttgttgagacagaaagatgaagaaatagcgcaggcaacaaagaaaagcaccgagttgaaagaatttatgacaaggttggaggtggagaaccaatcatggcgtaaggtagccgaggaaaacgaggctatggtattgtcccttcacaacaccttagaagatatgaaagaaagagctctgtatcgggtgacaaaagaggatgcagagtcgtgttgcgatgaaaacatgagaaacagggcaatggaagaaggaacaggagaaaacagactgtgcggtggtggtggcgctggtggggtagaagaggttgagcaaattaggaaaaggacaatggattgcaaatgttgtaattctcaaaattcgtgctttatgtttcttccttgcagacacctctgttcgtgtaaaacttgtgagccttttctgcaagtttgccctgtttgtagtatgcctaaaaagtctagcatagagacattaattgtataggctgaatgatctcttcaatatgacatcattttaatttttatacaaaaaattgcttaattgtcagtattaagatttccagtcagttgttatcaattttgtgtgttccaatacatgatttggtatcattgcaaaaaatgcactaatgcagataaactgttaattttggataacaatagttgactgaaaatcac

SEQ ID NO: 4156 - DNA, 1009 bp, Unknown
  Kingdom: Plantae, Phylum: Streptophyta
catatgtctaccctcaccactgattcttcctcgcgcttaatttcatctataaatacacatcatattctaaacttttttcacacaactcaagtgtgaaacacaacaacctctcccaagttctaaccaatacttctgtgatggctattcgtttgcctagtgttttgagtgctaaatacattcttcgccgatcaaatctgtttgcaaatcatgcagctacaacgtcactggatgtgcctaaagggcactttgctgtgtatgtaggagagggtgaaaagaggagatatgtgataccagtgtcatatttgaatcagccttcatttcaagaactgctaagtatagcggaggaagaatttggcttcagtcatccaatgggaggcctcataattccctgcacagaagaaaatttccttaacatcacctctggtttaataggctatgacatgatacaaccaaagtaaatctgaagaaagtttttgtttcatgttttttgcctttcaacatgtggtgttgagaaaagtttgcccgtgcagaaaggtttactatgcaaagaacatcagtacaaaatgaatggattaaaaacttgactatattccatgttgtttatagttcttttaccccttcttttattcctttttgtgtgtttcgctgctgttaattatatctggagtagaaattaagtatcaaagtaacttcgatatccttaaggaggtttaagtatataacttgtagaatgattcttgttgtcagaaaatgcgatagaggaccaaaccaaccaaaatcattgttatttaattctagtttcatgctctcctacactcgttcttcatgcattagcatattcttgctcctacccttggttcggttagtcttagacctagttcattagcttatgctattggtattttcttcatcatcaatagctagttctctttgttttctcttgtctttcatttcttttgtttaaaaaaacaataggttgaaaattattccattgtcggataatactaga

SEQ ID NO: 4157 - DNA, 792 bp, Unknown
  Kingdom: Plantae, Phylum: Streptophyta
atgactttacatacaaagatgaagagcaaaatcttgaaggcactaccaaaagcagttgcagcagtcaccgtgacatttcaaaaccatccattcagcccaggcagggatcacaaatcaaagcctatcgtatctatgattccccatgaagctagaagaaaaacccacgatagaggcaataacggcattgatgaaatttattcccaagaacccacttcaccaaaaatctcctgcatgggacagatcaagcacaagaagaaacaaatcaaaaaatcaaagtcaaagagcaagtccatgacaaaagaagcgaggaacgttgctagcaaaaaaacatcctcagcttccagagacatagaggtaaaaaagcacgtttccacgtttcacaagatgttattattccatggggcaaagccaaaatctgagggaaggaaatccaacgcttctgcgcctggagatattaacaaggatcttgctcttgcggacgcagcacgcgcaccgcgcgtgagtcagatgagaaggttttctagtggacgtgacgctcttgctgaatttgattggaaggtgtcgccagatgaagaggaaattgattactattcggatgaatacagagtggatagtgatggcgaagaagaggaagagattattatccctttctctgcaccccttttggttggtggtggagttggtcatactcgtgggggtgtgcttaatttgaagccacgaaaagaaattaacctgtggaagagaagaaccatggctccacccaggcctcttcaattggacagagcaaactga

SEQ ID NO: 4158 - DNA, 1793 bp, Unknown
  Kingdom: Plantae, Phylum: Streptophyta
acttgtcacgcaacttccctcaaatcctcacctccttataaatccccccaccccatttttcactctcacacttcacctccaaactcaagttcaccaaaagcaaccacaacaagcacttctcttatttcctatcacaccctattacagattcacaagcgcagacacttcaaatggctctggaagctcttcaatcacccagaactgccactccatcgtttagtccctttgaagaaaccaacctcagttacttggagacaccgtggaccaaaggaaagcgttctaagcgtagccgcatggagcagcaactgcaacactcttcatgcaccgaggaagagtacctcgctctctgtctcatcatgctcgctcacggcggcgccggcggtgtccccgccgccaagcctgctgtctccgacaacaattccgcgccgctacccgccgccaaactgagctacaaatgttcggtctgcaacaaagccttctcctcttaccaagcactcggtggacacaaggccagccaccggaagctcggcggcgagcaccactcgacctcctccgccgtgacaacgagttcggcgtcgaacggcggtgctaggacccacgagtgctccatctgccaaaagacgttcccaacaggacaggccttgggaggacacaaacgttgtcactacgaaggcggtaacagcgccgtaaccgcctctgagggagtggggtccactcacacaggaagccaccgcgatttcgatctgaacctcccggcttttccggacttttcaacaaggttcttcgttgatgacgaggttaccagtcctcatccatccaagaaatcccgtctcaatttgaccatacccaagattgaaatccctcaatactgatgatccatagatccaaaaaatattcagtgtttttttcttctttcttttttaaagttatttgagattaatttgttcttgtacatatatagtacttggaccttattcgctagttttagcttttagattgtagtcattgtacttttgacagtggcaattcaattcaattcaattcatttatttatatttgtaagaatgtaattgatttctctcagtttgctttatcatcatagcgtagtagtgtgattgatctagaatatgccgcggaatggaatagacatcatgaaacagcagaaccgcgtgaacggtgcggcaagtttgttttagttcagttgaggccacttgcgcgtgtttcttttctgtttcggcgtgtaaccgtttttactgttggtggtccacgattctaattttttgaatttttcttttacgaaaataaatgaccatttcaaactttgatgattaagattgggagtggatactgattaaatgagcaacttggtagctgggcctgggtggatgggatgtttcgtgtttgttgtgcggataagaacgaggatttggccttttacgcgctgtgatgataatgacacgtggattacttatccttacattgtatttgttttataggattgttgaagaaagcaacgtagctctttgaatttatagcattcctattgaatggtcctacgatcgctgaatgccaaagttggtgtgatacgttttacagtcgcatgaacagaaatgagtgttgaagcttcctttaatttgaaggtgtaagaagtagtagtatagaaaagcaattgaaattccttgccgtgtgattcgttttattgtacatgccagttagtattttaccatacttatcttttaagatggagttgacacacacaattcacatttgtcatgccgcaattacacgcggta

SEQ ID NO: 4159 - DNA, 2376 bp, Unknown
  Kingdom: Plantae, Phylum: Streptophyta
ctagaatatagaatatacatgaatgaagaatgagcctttgtttctcttccttaaactattttggttttggttctgtcctggcagcagttagaatagcagggaaatattgactcttcaacaaaacgcggagaatctgcaaagcttctttttcaaaaccttcacttacatcttccgccaagtcaatatgatgtggctcaataggcacaggcacaacattaatattctgctaccacctacaaaaggactagtacaaaagttgttggcagtgaccatgtcgagcacttcgttgaaggagatgaggaacggtggtgaggattatagcaatggtcatggtggtggtgtaagggacttgtatggagaggattgtgccacagaggaccagcttatcaccccatggactttctctgtggccagtggatgcagtttgctgagagatccacgctacaacaaaggactggcctttactgagggagagagagatgcccattacttgcgtggccttttgcctccagctgtcttcaatcaagaacttcaggaaaagaggttgatgcacaatcttcgccagtatgaggttcctctacataggtacatggccatgatggatcttcaggagaggaatgaaaggctgttttacaagcttctgatcgataatgttgaggaactgcttcctgttgtttacactccaactgttggagaagcatgccagaaatacggaagtatttttaggcgtcctcagggtctatatatcagtttgaaggagaaaggcaagatccttgaagtactgaaaaactggccagaaaagagtattcaagttattgttgtgactgatggtgagcgtatattaggacttggagatcttggttgccagggtatgggaattcctgttgggaaactttctctctatacggctttaggaggtgtccgcccttcatcttgcttgccaataaccattgatgttggcacaaacaatgagaagttgctgaatgatgagttttacattggacttaaacaaaagcgggcagctgggcaggaatatgcggagcttctagaggagttcatgcgcgcagttaagcagaattatggggagaaagttctcgtacagtttgaggattttgccaatcataatgcatttgatctgctggaaaaatacagctcatctcatcttgttttcaacgatgatatacagggtacagcatctgtggtattagcaggattgcttgcatccctgaaattagttggggggaccttagctgaccataccttcttattcctgggtgctggagaggctggaactggtatagctgagctgatagctcttgagatttcaaagcagactaaagctccagtggaaaagacccgcaagaagatatggctcgtggactcaaagggacttattgttagctctcgattggaatcacttcagcacttcaaaaagccttgggcccatgagcatgaacctgttaagactcttctagatgccgtcaaggcaatcaagccaaccgttttgattggatcatctggagcagggaagacatttaccaaggaggtggttgaaaccatggcatccctgaatgagaaaccactcattcttgctctctccaacccaacttcacaatctgagtgcacggctgaagaagcttatacatggagcaagggtaaagcaatctttgctagtggaagcccatttgatcctgttgaatatgaaggaaaagtttttgttcctggacaggccaacaatgcttacatatttcctggttttggcttgggtttgatcatttctggtgcaatccgcgtgcgtgatgagatgctcttggcagcctctgaagctttggctgcacaagtatcacaggagaactatgataaggggctgatttaccctccattctcaaacatcagaaagatatcagcccacattgctgctaaagtcgcaactaaggcatatgatctaggtctggcttctcatctgcctcgacctaaggatcttgtcaaatatgcagaaagttgcatgtacagcccaggctaccgtagctaccgttgagttttttgaacattatgaggtctacaccctacagtgatacacaaagagcttcttcttaggaacagatttattttattgcatgttagctttgtggtataaggcattgccatataaactttgaaaagttgctattctttcaaggtttttatttgtatttaggaggaatattattattactattccaattccaatttattccgaacgaaatgatttttgtagtagcatgagcttgtcattgagggccctttgcaccgaatatctcataactgcagtaggaagaaaacagatttataataaaatatgatgaaaaaaaaagcaaaagataatttctaatggtt

SEQ ID NO: 4160 - DNA, 1588 bp, Unknown
  Kingdom: Plantae, Phylum: Streptophyta
tgttagatgaaaatgtttatctttatttgaaaatgaaagaaaggggtttaccctaattaatatagttgttgaattagaaggaagggttgaaaaagaaagagtccatctctgcgacggcgcgtttttgactctctggagtctcttacgcggactagcttgtgttgctactatatataatctccaattcctcaccaaaacacattttctttctcttctctgaatccatttactttgtgttgaattcaatatgagtcttaagggatttttcgagggtggtgtcgcttccatcgtcgcaggctgcaccactcacccactcgacctcatcaaagttcgaatgcaacttcaagaaacccacactctccgcccagcctttgcctttcacgctcccactccaatgcctcctccgccgccctccggccccatctccgtcggcctccgcatcgttcagtcggagggactcgccgctcttttctccggcgtctccgccaccgtcctccgccagacgctctactccaccacccgcatgggcctctacgacgtcctcaagcgccactggaccgaccccgaccgcggaaccatgcccctcacaagaaaaatcacggccgggctcgtcgccggcgggatcggagccgccgtgggcaaccccgccgacgtggcgatggtgcgaatgcaggccgacgggcgcctcccgccggcggagcgtcgcaactacaacggcgtgttcgacgcgatacggcgcatgagtaaccaagaaggcgttggtagcctgtggcgcggttcagcgcttacggtgaaccgcgcgatgatcgttacggcttctcagttggcctcgtacgaccagtttaaggaaagcattttaggacgcggctggatggaggacgggcttgggacccacgtgttagcgagttttgcggcgggttttgtggcctcgattgcgtcgaaccccattgatgttataaagactagggtgatgaacatgaaggctgaggcttacaatggggccttggattgtgctctcaagactgttagggccgaaggacctcttgccctttataagggtttcatccctacaatttcaaggcagggtcctttcaccgttgtcctctttgtcaccctcgaacaagtcaggaagctcttcaaggacttttgaattttttattcattcggacaccttctcaccattcactaatcgatattcattctctaattggttgagatacatattcattctttttttttttttttagggattagttattgaggttttggaactttcgatgactaccttcttgagattcatatatgattattctaatttcatcaaatatatttaccaacaatgtaaaacattaaactggtatagaaattcagacttaatttcttcaatctacctgttatctcctttttatatttttttacattacccacatattttgtgtcaagtacctatattgccattttacagatatatatgatgttaccaattaggcagtgattcaccacattgggcaagtcataattctttctagtttctacttctcaacaatataaaagtatctatattttgtgggtatttctttttttcttt

SEQ ID NO: 4161 - DNA, 2065 bp, Unknown
  Kingdom: Plantae, Phylum: Streptophyta
aaaaaaattgacatgattaggatcggaaaagtaaaggaaattaatttgtttcttcgatgtggggccatttccttttgcgaaaaagtctataaattaattagttgccacgagctcttagtttatgtggttctcctctacacaagttagactgaactgtctaaatggccggagggggattagccgtcgttgatgcaccgccctgtggcttcgacggcaagataacactctcagttgtcatcacttgcatcgttgctgcatccagtggactcattttcggatatgacatcggtgtttcaggaggtgtcacaacgatggtaccgtttcttgaaaaattcttcccatcaatactgagaaatggagctggtgcgaagaacatgtactgtgtgtatgacagccaattgttgacgttattcacgtcttctttgtaccttgctgggttagtgtcatctcttgcggctagccgagtcacggcggcgttgggtcggagaaacaccatcatgttgggcggtgtcattttttttgctggtggcgctcttaatggaggtgcggaaaatattgctatgctcattttgggtcgtatccttctgggccttggggtcggtttcactaatcaagctgcgccactatacctctctgaaatcgcaccaccaaaatggcgaggggctttcaacacaggcttccaatttttcctaggagttggagtgcttgccgccggctgcataaactacgccaccgcgaagcacccgtgggggtggcgaatctcccttggcctcgccgtggtgcccgcaaccgttatgacagttggcgcattcctcataaccgacacccccagcagcttggttgagcgcgggaaaatagaccaagccagaaacgccttgagcaaagtcagagggtccaacatcgacgttgaacccgagttggaagagctaattaattggtcgcataatgcgaaatctatggtgcaggagtccttcatgaccatatttgagagacgctatcgaccccacttggtcatggcaattgctatcccactttttcagcagcttacgggcatcaacatcgtcgcattctattcacctaacctctttcagtctgtgggtatgggacacgatgctgctttactttcaactgtaatacttggaattgtcaaccttgcttctctcatcttatccactgctgttgttgatcgctttggtcgaaggttcttgttcattactggtggcattctcatgcttttctgtcagattgcggtgtctgctttgctagctatggtgactggtgttcatggtacaaaggacatatcaaagggtaacgcaatgttggtattggtcctactgtgcttttatgatgcaggttttggttggtcatggggccctctcacctggctaattccaagtgaaattttccccttgaaaatcagaaccaccgggcaaagcatagcagttggggtgcagtttatagcactatttgcgttatcccagacatttttgacaatgctgtgccacttcaagttcggcgccttcttgttctatactgtttggattgcagtgatgactctctttattatgtttttcttgcccgagacgaaaggaattccattggagtcaatgtacaccatatggggcaaacactggttttgggggaggtttgttggaggagcagttaagcaagataatcttccatgactacattttgggcactcccttcttaaccttctgtttgtaagtctcaaaagatgatcattaatcattggaactccctgcttacaactacgatgttttatttggacttgtactttacttttaccacaataatactatatcagaatatcctatgtaccagtagtagttttttgtaagttcgtatgttaaagtgtactacatatcactttaattttagtttatctagcaagtctattctccgagttagttagtagttagttacacacaattagtaatagctactctcctcactgaactcagattcagatataaaatttcatcgatcataaatacttgaaatgtcgtcttctcaatacaacaatatacaagttattctctcttct

SEQ ID NO: 4162 - DNA, 2173 bp, Unknown
  Kingdom: Plantae, Phylum: Streptophyta
agtcaaatcagcatatattgcgggctattgacaaaatggcatcagcaacagcatgttttctacttcaatattctatactttcatataatcaggagaacaatatacgcatgtatatatgtatgtgaattatgaaactgatactcaatcaacttaaggcagagtagttaacatggagtttggttattgtgcagtgtttctgatactgcttcttccaatctcatgtgcagcttctacgttagttgataagaagttcaaagaatgcttgttaacccaacttgatggcaattctgaatccattgaaaaaataaccttcacgtcctcctcctcattatatccccaagtcttggatttattggaacaaaatcctagatgggttaattccacaaggaagcctctcatcattctaacacctttccatgaatcagaaattcaagcagccattctatgcagcaaacaacttgggctgcagctaagagttagaagtggtggccatgattatgaggggctatcataccttagtaaggtcccatttgtgatggttgacctcatcaacatccgttccatcgaaattaaccttgatgatgaaactgcttgggttcaggctggggcatcattaggtgaactttactacaaaatttcaaaagcaagtaaagtgcatggattccctgcaggaatctgtccaagtatagggatagggggacatatcagtggaggggggcaaggtatgatgatgaggagacatggtctagcagcagaccatgttgttgatgcttacctcattgatgtaaatgggaagattcatgatagaaaatcaatgggagaagatgttttctgggccattagaggaggaagtgccactagttttggagtcatccttggatggaagatcaggttggtcagagttccacctattgttactgggttcaacattcccagaacaccggaggaaggagccaccaatctcattcacaggtggcaacacatagcacatgaattgcatgaggatcttttcattagagtaattgctcaaaatagtggagacaaatcaaaaaaattccaagcaaccttcaactctgtcttccttggaggaatagacagtttgatcccactgatgaatgagagtttcccagaattgggattgcaggccaaagactgcactgaaatgagctggattcaatcagttctgttcattgctggatacaaaaaggacgaccctctagaactcttgcttgacagaattaccacatttaaaagctttttcaaggcaaagtccgacttcgtgaaggagccaataccaaaatctggtctagacggagcttggaaaatgcttctagaagaggaaacattagcaatgctgatattggaaccttacggtggtagaatggatgaaatttcagaatctgacatcccttttccccacagaaagggtaacttgtacaacatacaatacttggtcaagtgggaagtgaatagcgacgaagaatccaggaggcatctacactgggctaaaatggtttacaaatacatgactccttatgtctcaaaatctccaagagctgcctatttcaactataaggatcttgatttaggcaaaaacaagcatgaaaacacaagctactcaaaagctagtgtttggggtgagaagtactttaagggaaactttaggagattggtacatattaagacaacgtttgacccccaaaattttttcaggaatgaacagagtattcctctcctaaattcccagcattcttaacataaaaggcatgatattatttggagcacctaagacatttgtgtagtgcttcaatatgatgttaatcttctgcttggtgttattgttatagacccaatcaggaacggaatgctgcttttgcagacatttcaaaggttggggatgcaatttcaaaatggatatgacgtattttcataatgggtgtggactggtgtaacacatcatgaagttacaaaatctcataagaatgtacccttaagttgcatattatgtcgtctaattacccttcgtatttctacatttcatttccttttcttccatgttacctttatatttttcttgatattttaaattatcattgaacagaagaactgtaacggtctgtgtttgatacaattccactccaaagataattaagctcaagaattttgtacaaga

SEQ ID NO: 4163 - DNA, 1937 bp, Unknown
  Kingdom: Plantae, Phylum: Streptophyta
gaaacatataaatacatggtgattcctaaattccggttagagttgtaaacatggagtttggttattgtgcagtgtttctgatactgcttcttccaatctcatgtggagcttctacctcacttgagaagaaattcaagaaatgcttgttaacccaactcaatggcaattctgaatccattgaaaacataaccttcacctcatcctcctcactatatccccaagtctgggattcatcagcacaaaatcttagatttgttaattcctcaaggaagcctttcatcattctaacacctttacatgaatcagaaattcaagcagccattctatgcagcaaacaacttgggctgcagattagagtcagaagtggtggccatgattgtgaagggctatcataccttagtctacgtaaggccccatttgtgatggttgacctcatcaacatccgttccattgaaatcaaccttgatgatgaaacagcttgggttcaggctggggcaacattaggtgaactgtactacaaaatttcaaatgcaagtgaagtgcatggattccctgcaggacccgttccaggtattgggataggtgggcatatcagtggaggggggcagggtatgatgatgaggaaacatggcctagcagcagaccatgttgttgatgcttacctcatagatgtaaatgggacggttcatgatagaaaatcaatgggagaagatgttttctgggccataagaggaggaagtgctactagttttggagtcatccttgcatggaagatcaggttggtcagagttccagctattgttactgtgtctgagagaccactggaggaaggagccaccaatctcattcacaggtggcaatacatagcacatgaattgcatgaggatcttttcattagagtaattgctcaaaacagtggtgataaatcgaaaacattcaaagcaaccttcggttctatcttccttggagaaacagacaggtttatcacactgatgaatgagagtttcccagaattggaattgaatgtcaattactgcactgaaatcagctggattcaatcagttctggttgatgccggatacgacagagacgaccctccagaagtcttgctcgacagaactaacgaatttaaaagctatttcaaggtcaagtctgactttgtgaagaagcctataccaaaatctggtctagaaggagcttggaaaatgcttctagaagaagaaatgtttgcctggctgataatggaaccatatggtggtagaatgaatgaaatttcagaatctgaaatcccttttccccacagaaagggaaacttgtacagcatagaatacgtggtcaagtgggaacagaatagcaaggaaacttccaagaagtatctacagtgggctaaaagggtttatagatacatgactccttatgtctcaaaatctccaagagctgcctttttcaactttaaggatcttgatttaggcaaaaacaagcatcacaacacaagctactcaaaagctagtgtttggggcaataagtactttaagggaaactttagaagattggcacaaattaagacaaagtttgaccctcaaaatttttttaggaatgaacagagtattcctcttctacatacccatccttcttagttctgaagagcgtgtgcatgacattttttggagcacctagaacatttgtgtaatatttcaatattatgttaatattgtgctttgtgtgattggtatagacccaaccctaaaacattatactgcttttgtatacatttctgaggtaggggatgcaaattcaaaatggatataatgtattttcataatgggtgtggagtgtggacttatgtaacactaagtgagatcccataagaatgtaccctcctgttgctaattatgttatctaatgacccttcctaattatgtctgctctagctttca

SEQ ID NO: 4164 - DNA, 1087 bp, Unknown
  Kingdom: Plantae, Phylum: Streptophyta
aaaattctcaagaaaagaaaaaaaggaatgattaaaatattcctataccaaaattgacttttgtattgtattgcatttatacctggtaaagcggtactaacacgtctttgatttcgttattccgttttcatctgacgctgtcctttgggcgcgttaagcccgtttcctttctccttcgtacctcgtatcttgaactttccgataccattacataacccgacatataaattcatcacccccacaagatgttacagacaattagctcacgaccacgcacctacataactaaataatcttatgcataacaatttcacaagtgttattttgcgttaattttcttcagttatgagggtgaacacagagtttgagcgtgttcttaagtattttgatgaggatggggatggtaagatttccccatctgagctcaggaaccggctaggcatgatgggtggtgtgttattgttcaaagacgctgaaaagttgattgaggaattggattctgacggtgatgggtttttgagtttggaagattttgtgaagataatggaggcagcaggggaagaagagaagttgaaggatttggcagaggcttttgagatgtaccatgactctgaaatgtttgggtttataacacccaaaagcttgcaaaagatgctaggtaggttaggagaatcaaaatccatggagcaatgcacagctatgattggccactttgatttgaatggagatggcctgcttagctttgatgaatttagagtcatgatgcagtgatgattatttatttatttgatttaattggggatggttggatttcattcatttgtttgtatatatttttagtctctacatcccctgttaggcttttgtaagattcagtgaggctgatttgctgagctttataagctacatatattatttggacacgatattctctgctacttttgatttgtaatctgattttttggacatttacactgtataaacatcttattaacacttttatttatttatttttatccttttctaacgtatcaaataaaattaacaaattaacatttattgataaaaaaatgttaataatttatat

SEQ ID NO: 4165 - DNA, 864 bp, Unknown
  Kingdom: Plantae, Phylum: Streptophyta
atgtcgtcccacagtcatctaagtttcgcctttggggttctaggtaacatcgcctccttcgtgtgctttctggcaccactaccgacattttatagagtttgtaagaagaaatcaaccgaagggttccaatcaattccatatgtggctgcactcttcagtgcaatgctttggatcttttatgcctatgtgaagaccggagaaatgcttcttatcaccatcaatgcattcggttgcgtgattgagaccatttaccttgccgtatttatcacttactgccccaagaaagctaggggccgtgtcaagcttctaggatggatttgcgtagtatttgctactagtgtttttgcagcacctttaagcattattagggtggttattcggaccaaaagcgtagagttccttcctttccctctttcacttctccttctgataagcgcaattatgtggctgttatacggtatttccctgaaggatatctatgttacgctcccgaacgttgtggggctaacatttggagtcattcagatcggtctctatgcaatgtacagaaacaacaagcccgtaaaggatcagaagctaccagaacacaaaggggatattgttgacaacaacaatgaaagcgttattgctccaacagtgaatggtgaaaaacaagaacaagaagtgaagcctcagggtggaattatagagactggggagaagaaggaagagaataataagcaagatcaacaacaacctgaggagaataagaagtttgaccaagttgttcatgaacaaacgaaactcaacaacaagaatacaaacaacatcaacgacgatgacaacaacaaaacaggggaaagggtgatcagttgcgaagtttga

SEQ ID NO: 4166 - DNA, 736 bp, Unknown
  Kingdom: Plantae, Phylum: Streptophyta
gaaaattcaattggaatcaaagttgggtaaccataacacgagtcaaacgaaggtgaagaaaaagggttgaacgagtaaatgattgaactaggcgtcagtgcaaagaaacttctagcaacccaaccaccggataagaagaaagaaactgacacaacaacctaagcagaagaatagcagacaaatcaacaaccactgccttcatcagtttttacaaatcctcacaacatgttcatgtctctcttcagccacttcgagatcgcacaggcccagaagtggaggttttctttgtcccccgtaaaaggtacgaattccaagcccaacgcggaagccacctcttcctccgcagagtccaaaaccgccggaaaagataagaatccatcacaacccggtgggcccaggtttgcgccggagttggatggactacactgcttcgaatccatcgtaccctgttagatgagatggattccttacacctccaatctaaattcgtttataataatcacatcatatcaaagatcataggttattcaattcaatttatttttactgtatagtttaatcaatttgttggggaagccatgtactatacccgagagatcaatttgtgtttccctgtaactcgaaatttgaaatagtaatattcttcttattgctgattaccttaattgcagttctttatactagcaaagtagccagcagtctcgatctatcaccgggtttaaaagatcgtttggct

SEQ ID NO: 4167 - DNA, 243 bp, Unknown
  Kingdom: Plantae, Phylum: Streptophyta
atgtctatcttcagccacttggagatcgcgcaagcccagaattggaggttttccttgggcacggggcccgtaaaaggagttaattcaaagcccaaaatggaagccacttcttcctccgccgccagaaaagatccgaatccatcatcaaccgctggatccaaacaaaacccgccccgtttgaggcccaggtttgcgccggagttggatgggttacactgctttgaatccatcgtaccctgttag

SEQ ID NO: 4168 - DNA, 725 bp, Unknown
  Kingdom: Plantae, Phylum: Streptophyta
tttctaagagatatccactatcttcatctatctctataaataccaatgcttagagtgataaacttccattctcaacttgcaattagccacacatatcatatacagattttgtattgttagaaatggccctcctcctcttccgtgcctccaaattgatgtcatttgctgctcttttagcaatacttttactgcttatgtcctccacaatgggaagtgctgctcagcctagttttaagctcgtgcgaaagcttctccaaactaaatacccgcctgcttatcctggatatcctggtggtggaggatatagcccaaaaacaccatgaaatcatcaaccatgccaagggggaaataattaccaataccacagaactgctctgttgctgaaatattggagatgttagcatcgttctttaatataagtgccagtactataagagtgctaaatttaaaattacttttatagcatgcatacatgtatgtatgtgccagtacaataggataataatatatgtatttaatttcgacgaaccatgtgtaccactactatcagtcacaaccaataagtggctagaccagttgaattgcaacgaataaatttgtcattcttctttcttgtctctaaaattatttagtgatatatagcaaaatgtaaacacctcgcttgcatgtgggaatctagagagtaccttcacgttgcttaaattacttttattattagagtgaga

SEQ ID NO: 4169 - DNA, 1925 bp, Unknown
  Kingdom: Plantae, Phylum: Streptophyta
ccccaccccttaaaaatcccatgcccataacataacacctcattcctaaccccccctttttgtcttaaacttattcttctgctaccaccaaaccgaaccatccttggttcatgtcctgttcaggccatcttttgcatgtgccacttggcctctgacacaaacttttctcttcggaaccaatcatttttcatcaacttcagcttttacacaacacttcatttacacttttgtgcttagcttcatcaacatggacaacatgggtgacccaaagagcatcatacatgagctgctacaaggtttggaattggcaaggcaactccaagtgtatctccacctgccaacttcgtcccaagaaacacgtgacctactgatccagaagatcatatcaacatttgaaaaagcacttgaaatggtaaattgtaaagggccagtgccagcgggtgagtcatcacattatcccctaggggctgcattaatccgagtgtcagattcacctttgagcagtagtccccgcagtgaagactctgatagagatttcaaggaccaggaccccaatgctttcaaaaagagaaacactttgccaagatggacaaaacatattcgagttaccccaggaatgggggtggaagggcctcttgacgatggatatagttggagaaaatatggccagaaagacatccttggagccttgtacccgaggggctattacagatgtacccacagaaatgttcaaggctgcatggcaacaaagcaagtgcaaagatccgatgaagaccccaccattttcgaaatcacttaccgaggaaaacacacctgcacaatggccaacaacgtgggttcttcttcatcaccaattccaccagaaaaccaagaaccaagtttgaacaacacaaatcctcagcagcagaatatcttgcaaaaccttgaacaacaacaaagcgacctacttttgagcctgcggaaagggttgagagtccaaacagagaacctagattcccctgaccaacaatcattggttccgttccgtttccctttgtccacaaacatcaaaattgaaagccaagttttcccttcccctgtgcttgaaaactttattagttctccttcttatatgtcctctgctgcttcaggaataagtcacttttcagtgtctccaagtggggtgaacagctttggagggaacccaaatttggcaaattctgagtctcagatcaatgacatgatcccagccactactacttcagctccaaactcatcaaccgttggcttagagttcccttttgaccagtttgaattcgatggccagaacttcacattcgataaccctccatttttctcttgaatatgctcaattctgagaagaagccgaataaaacacaaaaactaaattttgtttcttttttttaaaaaaaaaataatattagaactagaagcatatgatgaaagtttgtggcaacattctagaataatatgaccctttagaaaaagaggcaaaaacgtttcaatgtatgtcttagctacttgtgtcgtaggaatgtgcaaatctaaaattgcttagtcaataagaattttcctttatcattagagacaggtcaagttaacagtaggtttttcttttgtttgtttccccccctttttctcatttttggactttaatatcagggtttagttgtactcatagaaatgtacgtcgtgcttctcttcttccagtgttggtgaaaatgttcattttctcgagtcagaggaaaggggaaaaaagatatgacccattgtatttgtttccaaatctgtgtcaaataaacaatcaggtattcttagaactaagcgggttaaggtatttgatctttgaccgtggaaatgttcacgcggacagaaacaaaaaaacgagcagcattcatgatattttaattgaactgtgatttaag

SEQ ID NO: 4170 - DNA, 492 bp, Unknown
  Kingdom: Plantae, Phylum: Streptophyta
cattatcatgatcatcataattacttcatcataattctgaactcttcaaagctaagcatgccatccccattcaaatcaaacctacttatcatcactttgcactcatccatggacttagattctcccaacttcttgagcatcctcttcaaggcctttggggtaataaacccacacctctccatatcatacatattaaaggcttctctcaaatccttcaacttctcttcctctcccgcagcctccatcagcttcatcaaatcctccaaacacaacaacccgtcgcagtccgaatccaacgcctcgatcgccatctcagcctctttcaacataacctctccacccatcattgatattctgttccttagctccgagggtgaaatcttcccatcaccgtcttcatcaaagtaccttagcacacgctcgtattcctcacccctcatcattgttctcaacaaacaattgaataaacaagtatgtgtgtgtttgatttaa

SEQ ID NO: 4171 - DNA, 996 bp, Unknown
  Kingdom: Plantae, Phylum: Streptophyta
ctcaaactcaaaaaaaaaatctataaatacaacacactagtcagtctcagcttgtgatcgcaattacatataataaaattttcaggacttttcatcatggaagcctattctagttcttattcctcgtcatccaattcttcatacttgacccaaaacaaccatgaggactcaaaagggtacgtgaaacagcaagtgtaccctcttcaaaatcacaattcgtggctccgttccgtgagaaagacaccagcaaagccgtggaagaaggcaccagtggcaccaatgccaccaacaccgatcaaagtttacaaagtggacgctataaacttccgtgacgtggttcagcagctcacaggtgcacccgagcacgagtcccagcagcagcatctccaaatcaaaatcgcacgtgctgaatctgctgatgctcctaatgtgccaccgaagcaaaaccaatcaggcggagacacgtgcggtaaatggtaccaggagtttctcttaggaatgaattctccggagactaatactaataatgatggagcaatggcaccgggttttctaggaatgaatttgctctcaccaaattcgtatagtaatttctgtttctttcctcctttgagcccaagcggtgtcaccagtttggaaccagggaaggttctctaggcctttttacaagattctatatgctatattgatatgtacttctgttccattttctactttgttttttagtttgttactgttattacagttaaattattaatcggaaaaccttcaacttttattatcattttatgggtagtcaaatgccgacaaaacaacaaatttactaactgttgctacaaaattttattgtccctttaatgtaaacttgtccaaccgccttgattatctatatttttctcttctgtttcatgctaaatgttttgtcttatttccggtcgcaatttcgaaactaagttaaggagtcgttaattatcttgttctgattttgcttgttct

SEQ ID NO: 4172 - DNA, 1234 bp, Unknown
  Kingdom: Plantae, Phylum: Streptophyta
agcagttctgaatttttgattccactcccacaatttcacactcctcaattaaattcaaaccaccaaacacgaccaaaccatgtcctcattcacttcataattccacatataaatacgcattccattccactctttcttctcaccgtgggcaccaagaaaagcactaagttccaatataaccgcgacccatttctctcctcgttactccaagaaaaacccacaaagcaaaatcgcaacttgaatatcattagggacatggttgaaaagaacaagagatcatcatggttctccaagaggctgaagagagagtcgcagaggtggaaatacctgggcgctgcaatattcaagtggaagagcctttcttctttccctgtttccttcttcaaccacgtcgctttcaagattctctctctctttgaagccattttcctcgttctcactgcttgctttttctacctcatgtgtggatgccgcttttgaattcgcacacaagcaaccctttcgtgtaattcatttttcctcccttcttgagcctgtaatcaactttccagctgtgtgtgtatttttaatgtctataacggaaatgaagaggattgtgtcagattcatgcataatccttaaaaaccattaagcactcttctcaactcttttcaaattttaagatttttgttttttgtgttatttaaatttgttctttttattaattttattcaatataactcttccatatgaaacgtacgtacgtaagcctaaaacttttcaacaactgaaattgattcgaactcgatcgcttgcgtggatggaacagaaatgtgaggtgtaacgtaagaaaattgatcgctgttggtgggttaatgttgataatgatattgcggacaaagtaatccagtgctttctaaattccaaacttaagagacaagtaattctttttattttttttacagttttcactgcttgatgaagatttttttttttttgactgaattgcttggtgaagatataatgtgggtttactttacacgcttctaatataattttcctatagttaaatgtttgagttggaatactcttggttctgtataataataactaggtttaataatttctacatttctaagttttctccgcgtctagtttcttgtgttagagtgcaattgtgatgagttaaacgtctccttggcgtgttcgagtattaccttcctttcctgtagctacagtgcttgtttgacagttg

SEQ ID NO: 4173 - DNA, 864 bp, Unknown
  Kingdom: Plantae, Phylum: Streptophyta
tactagaaaaaataacagcgacaccgacagcatcaagcaaccaacacaaactgatttctcatttcgtagcatcaaccgctaactatccagatactaattttcgctttggtttggttcaattctgtccgcagacatggttttcaggccaatgagtggtaattggttagcactgttaagaaacagttatggaggtaaagccgcgtacgcaacctcaacagcaccaaagatgaaagcgtatgcagctgcggctgattacggacacaagcaacaacatgggaagtcggccaaacgggactttgtggcaatttacgtggcgattgggatgatagctctgtccacagggctgggtctccacactgcgtggcagcaactgaggaattccccgacggtgagcgtgaagaagcagaggagggagaccctccccgaagtggtggaacccgaccacgtggcggaggaggctgagaaattcatgaagaaatccttcttcaggaaggtggcgcacgtgcaagagcgtagctaccctgatcaccaccaaatccttagtcccattcacggagatgcctatacttatacccctcgtgtcgagaccctcaagtccgttggggtcgatccctcgcacgtgtgactagataattactctagtttttgcttttcttacaggttgtaaatagaactcttaagtgtctatctatgtgacttgtgctctgccttttaatatctcagttttgtgttagtaagttaaatgtgaaaatttcatgccaggcctctctgcgggtatttttacaattagtaagaatcaagggaattatcaaaaagtgcttccatataaaatatccttgcaatacaaaagaattttgtacatta

SEQ ID NO: 4174 - DNA, 2062 bp, Unknown
  Kingdom: Plantae, Phylum: Streptophyta
ttaatatgcacatcaccttcttctcctactcctcattaagctagttagctatctatctaggtgcaaccttttcatcgatctatcaccctctttcatatattcctaacttgtcccccaaaatcaaatggctgcgaaacggttttttgatgattctgatcaagacaataataagccaccaggcgataaacggatgagaactacaccaagaccttcttttgcttcggtaataggagaagtggtgatggtgaaaaacttgcagaaccttttctcaggcttggagcccttgcttagaagagtggtgaatgaagaggtggagcgagtgatgaggcattgtactgtgccacgtacaataagtaggtccccttcgttgaggatcgaagcagcatcattggagaaaccatcgaactatgaactcatgttcagcaagaagctattggtccctatattcacaggaagcagaatagtggacatagatgggaacccaatccaggtgattctggttgacaaaagtggcggtgatggtgaattagtagcggttcccacgagtgtgccccagcccataaagctagagatagtggtgcttgatggagattttcctaacaacaaggaatcatggacgactgaggagttcaacaacaacatagtgaaggagagaacggggaagaggccattgctcacaggagaattgaatctgaccatgagggatgggattgcaccaattgaagagattgagttcactgataactctagttggatacgaagcaggaagttcagagttgctgttagggtggctccagggagtaatcacactctcccaattcgtcaaggaatgactgagccatttgttgttaaggatcaccgtggtgaattgtacaagaaacattacccacctaagctcaatgacgaagtgtggcgcctagagaagattggtaaagacggagctttccacaaaaaattgtccaaagaggggataaacagcgtccaagactttctcaagttatccgttgttgatgtccataggctcagaaagattttgggcgttgggatgtcagaaaaaatgtgggaagtgacaatgaagcatgcaaagacttgcgagaagggcaacaagtactacgtgtaccgtgggcctaattttagcgtctttctgaattccatatgccagctggttagagctgatatcaacggccaaagttttccgagtagagagcgaagcaacatgaccaggagctatatggagaaattggtgagagaagcatatgttagatggaatgacttggaggaaattgatgcggctttcttaacccaaggtgaaactttggagcaatttccaaacaatcatcaagcatcactaatagcatatgatcagaacgactattttggtgataaatctgccgaagttggtaactatgtaccaacccataatgcacaaattggatgcagcgagtgggcagtgaatggaacatttggcacaacatcatttgtgaatggcataccttacagcttcttagattcacaatcggacagtgacataagcccctcagttgatggtgccgcaaggtggccttagaacaaaaatttagtactttgactttcagccgtaaatacgaattaacaattgaagaatcaaattaggtttcagtgacttagtgtgaagtagtgttggcccattacataaactctgccccgcctgtcttggctcgtattgggctttcctttttctctttctggttaggcgtagtgtattgtgaggcccatttcaaggatctgtgcaaagatgaggcctggctcttctccaaaaaatgcaacctgcctttgctgggctagtgttgctatgttttaccataatttcagcaatcacgaaacatcaatgatgttttataaatggtgataatgatctaatcctttcattatacttgtatgcattcaggatttgggttaagagccccattctgcttttagcttgcaaatgttctgggagtattttattcacacataacaacaaatgaaaattgatccaaagaaaactatcgttaatgaaaattttattcacaaataacgaaga

SEQ ID NO: 4175 - DNA, 1377 bp, Unknown
  Kingdom: Plantae, Phylum: Streptophyta
atgccaccttttgccggatccgaaccagttggattccctaagccagattccgacatagtttccattgacgttggtggccaactgttccaaaccacgaaacagacactaacctcggcgggtccgaaaaccttcttctccagaattgcggcggaatcttctggactccacacgcccttcctagacagagacccagatctgttctcgctccttctctctcttctcagaaccggtaaccttccctcaaaggccaaaactttcgatctccaagacctaactattgagtctaaattctacggcatcgaatccctcctcgtcaattccctctccaacccttctcaattggaaccctttaatctccaaaagtcgcttcttttacccttgaacggacgcgattccccatccgccctcgccaccaccgcctccggctccctccacgtcgcgcacggcagcaagatcacctccttcgactggtccctccgccgcaaatccaccgtcctgacgcaattcaccgccgtggactccctcctcgcgctctcgccgtcgctcgccgccgccggcgccaacgacttctccggcctccagatcctcgacctcgataaggggcgcgtcagggaaaccctaaattgggaaaacgtcaccaaatccggctccaccgtccaagccatcggatcctcgccggaaaacatgtttgtcagcttcgaatcctctcggagaaactcgaattcaataatggtctacgatttgcacaccctgacacccgttacggagatcggtcacaacgagatcttcggcgcggacatcgattcggcgattccgacgacgaaattgcaatggattgagggttacaatttgttaatggcttctgggtcccacagtgggccctccggcgtgagcgggaacatacggttgtgggatgttcggtccggcaacgttgtttgggaggtttccgagaaagtggattgttttgctgacgtggcggtttgtgatgcgctgtcggttatatttaaggttggggtgaattcgggggaggcatcctacgtggacttgaggaatttgagtagcggtgagagcgcgtgggtatgtctcggagataaaagaaaaattttgaatgggaagaaggaagggtttggttgcaagattgaaacgcaggggaatcaagtgttttgcaccaagggtggtgatatggagttgtggtcggaggttgttatggggtctgggaacagtgggaggatcttcaagaagaacttgatggggagagtgagggatatgggtggggccaagattaccaatttggcctttggagggagcaccatgttcttgactaggaaggatcaacaatgtgttgaggtgtggcagagttcttctagggagttttga

SEQ ID NO: 4176 - DNA, 798 bp, Unknown
  Kingdom: Plantae, Phylum: Streptophyta
atgcatgctgcttataggatgaagagcaaaatcttgaaggcactgccaaaagcagtttcagcagtcacggtgacatttcaaaaccatccattcagcccaggcagggaccacaaatcaaagcctatcgtatccatgattccccatgaagctagaagaaaaacccatgatagaggcaataataacgacattgatgaaatttattctcaagaacccacttcaccgaaaatctcctgcatgggacagatcaagcacaagaagaaacaaatcgaaaaatcaaagtccaagagcaagtccatgacaaaagaagcgaggaatgttgctagcaaacaaacatcctcagcttccagagacatagaggtaaaaaatcacgtttcgacgtttcaaaagatgttattattccatgggacaaagccaaagtctgatggaaggaaatccaacgcttctgcgcctggagatattaacaaggatcgtgctcttgctgacgcagcacgtgcaccgcgcgtgagtcagatgagaaggttttcaagtggacgtgacgctcttggtgattttgattggaaggtggctcaggtggcgccagatgaagaggaaattgattactattcggatcattacagagtggatagtgatggcgatgaagaggaacagattattatccctttttctgcaccccttttggttggtgttggagttggtcatgggggtgtgcttaatttgaagccacgaatagaaattaacctgtggaagagaagaaccatggctccacctaggcctcttcaattggacagagcaaactga

SEQ ID NO: 4177 - DNA, 1931 bp, Unknown
  Kingdom: Plantae, Phylum: Streptophyta
atatatataccagccagcgaatgtgactaagttttgtaaatggtcaaattaaattttaaaaaaaagtctattttatgtacataataatcaatcataataattaataagtaacagtattttcaatctagttgagagaaaaggaaattagtttccttgcccgcgtgaacaagagaaggaaaacgcggggaagcagataatgaaattattatatatggtctgaatttcatttccctcattagtcattaccctacatctaaatatctaattattatcataaagtcttaaaaacgacgtggtttcttttacaacgaataaataataattttagctagaccgtatgcgtgtcagagcaaaaacacaaccctttatatatgcttccaaattctccaccacggatcgtaacatacttcagcaatggcccagcaaaagcggttaagaggtctggctcaaaacctcaaagacaaagcctcggtgatcgccgcagcgctatccaccaagcgtcacctctcttccgtccgtgtccacgtgctccgcgccaccacgcacgccctcgcggcaccaccctccgaggaaacaatttctgctgtcctcgcggtcgggcacggcggctcccaccgtcatccacgcgcgtgcatcgacactctcatggaccgcctccacaccacgcgcagtgccaccgtggcactcaaatgcctctacactctccacaacgtcgtcgtaaagggacccttcgtattgaaagaccaactatcttgttacccttcttacggtggccacaattttcttaacctctccaccttccgagacgtctcggacttggaatcgctcgaactcagttcgtgggtgcgctggtacgccgccgtactggaacagaccttaaccgtttcaagaatcttaggttattacttgaacgattcttgtgaatcccaagaaaaaaagaagactttggttgtttcgaacgcgtcgaatgcggatttgttgtataagttggaggttctcgtgggtttcgtcgaacaaataagccacgtgcctgattcgttgcaccttcagaggaacgagttggtgtacgaggttgtgagattggtcggggagaattataggagcgttcaaggtgagatttttttgcgtgttgaggagcttggggaaagaataatggaggattttgatgtgggtgagttgaacgagttggtggggtatttggggagattggaagagagtcgtgaaaagttgttgcttttgtttgtgaatagaagaaagaataatgggttttgggaattggttgagaagacgaaggggaagggtgtggcgaagaagaaggagattgaagggaagtggctcgcggtggtggtgagtggcaacgccgccgagttgactcggtccacgaacccgtttcttgacccggggcaacaactcagtccggtcccccggttaagttttgcaacggtaaggtgaaatacggcaacggtcattttcagtgagaatttgtcaaaaataaaaatagtaaaaacactcattctttttatttttttcccgtttattttgtgggaatccgcagtctgcgccttccagttggaggtgtggtgctctatactttttcagtactttttttatttttctttgatgtggggctgtggggctcgatgcttgccgtcgtgtgcatgattaaagtgtaaaaaacagatcttataatgtatatcaagataacaaagagatttctgtaaaaaaaagaaattaaagaagagatttagtggacttttttgattgatttttgaactttttatgttcctctcttctggtccttctggatgtattaggcgtggtttagagtttatttcattaaaaataaaataaacaatgttaagtgaaaaataatgttataaagagaacaatatctaagataaaaataagattctaaaaagagacgatacaag

SEQ ID NO: 4178 - DNA, 1180 bp, Unknown
  Kingdom: Plantae, Phylum: Streptophyta
ggaaagtgaaacacaccctcatcacccccttccttccttcccttcacacatctctctctctctatatcaaccatatcgatccctcacattccaaacgacaatgttgcctccaacgttattactatctctacgtctcttcctagctttttcataagaaacaacttatttatagtattatggcaagccttagaattcgaccacctttgaaggacaaggacatcattgggaggttcatgcctgatggtcgttgttgcaagaagcaccccaaacaccgccaatcacccggcgtatgttctctttgtttgagagacaagctttctcaactatcttcggcatgctcatcttcttcttcttcgcgtaaaacaacattcatttcttcgtgtcattcgtcttcctcctcttcttctttaacctcctattgctcctcttccgcctcttcttgcgcctctccaacgcttcctttcccttttcataaagattcaaagagtggctccaattcggtttccatctttttgttgagcgcaaaacctggtggaatactcaaaagtaggtcaatgagcgttgttgcaacaaggagaagaacaaaaggtcaagatgaaggtgatgatcgtaataagaagactggcatgaaaagtgggttttggtccaagttgcttcatcccagaaccaaaagcaagagaatggaggagatcaaaggcactaagcagctggttcatactaggtctctaatacaaactgtgacatagctagtgatgcatgatcatttgttcgatcgtctctaattataattagtgattctttctttcattttttaatcccaccctttaatttttgagtggattatatttatgtcgttgaatattaattagttcgtgtgtacaatttcccttctgcaaaagcaggaaacaaaaatagagatcttgtattgcatgatatgcttgtaattgtttttgtatataaatgaacactttttggatcattaattaatagggagggaataactaaaggcaaatataagaattaatttacataaccagatgtacgtacagtacgtatatatattaaattgtacacggatcaatatgctagagattgttccttttagatctgattctatcaaaattatttgtatgttatcactggcggttatagatgtaattattgacaagaggagaggtcg

SEQ ID NO: 4179 - DNA, 1916 bp, Unknown
  Kingdom: Plantae, Phylum: Streptophyta
ccttaaaatcacatactcgtcataacacataacatttcattcctaacccctcttcttcttttttttattttttatcttctcttatcttaaacttattcttctgctacaccaatcccatccttggtccatgtccagttcaagccatctttggcatgtgccacttggcctctgacacaaaaacttttcttttcggaaccaatcatttttcatcaaacttcaacatttacataactcttaattttaatcacttttgttcgtagctacatcaacatggaccacatgggagacccgaagagcatcatacatgagctgctacaaggtttagagttggcaaggcaactccaagtgcatctccacatgccatcttcgtcccaagaaacacgtgacctattgatccagaagatcatatcaacattcgaaaaggtgcttgaaatggtaaaatggaaagggccagtgccagcgggtgagtcatcacaacatcccctaggggctgcattaatccgaatgtcagattcacctttgagcagtgaagactccgatagagatttgaaggaccaggaccccaatgctttcaaaaagagaaacactttgccaagatggacgaaacagattcgagttacaccaggaatgggagtggaaggacctcttgatgatggatatagttggagaaaatatggccagaaagatatccttggagccttgtacccgaggggctattacagatgtacccacagaaatgttcaaggctgtatggcaacaaagcaagtgcaaagatccgatgaagaccccaccattttcgaaatcacttaccgaggaaaacacacctgcacagtggccaacaacgtgggttcttcatcaccaattccactagaaaaccaggaaccaagtttgaacaacacaaatattcctcagcatcagcatcagcagaatatcctgcaaagccatgaacaacaacaaaacgaactacttctgagcctgcggaaagggttgagagtccaaacagaaaacctagattcccccgaacaaccattagttccattccgtttccctttgtccacaaacataaaaaacgaaagccatgtttttccttcccctgtgcttgaaaacttcacttctccttcttatgtttcccctgctgcatcaggaataggccacttttctgtgtctccaagtggagtagtgaacagctttgaagggaacccaaatttggcaaattctgagtctcagatcaatgatatgatccctgccactactacaacttcagcagctccaaactcatcaaccgttggcttagagtttccctttgaccagtttgaatttgatggccagaacttcacattcgataacccacggtttttctcttgaatatgctcaattcagagaagaagccaaataaatcataaaaactaattaattttttttaaaaatgaactagaagcatatggtgaaagtttgtggtaacattctagaataatatgaccctttagaaaaagaggcaaaaacatttcaatgtatgtcttagtcagctacttgtgtcgtaggaagaatgtgcaattctaaaattgcttagtcaataagaattttcctttatcattagagacatgtcaagttaatatctcgtaggtttttcttttgtttgttttctcccctttttctcgtttttggactttaaaagtagaagggcttcttccacagtgcaaactggatgatgaaaatggtcattttatcgagtcagaggaaaggggaaaaaaagatataacccattattgtatttgtttcctattctctatcaaataaacaatctgatttctcgaagaacaaagcggggtaaggtatttgatctttgaccgtggaaatgttaacacggacaaagacaaaaaacgagtaacattcgtgatattttgtttgaactgtga

SEQ ID NO: 4180 - DNA, 942 bp, Unknown
  Kingdom: Plantae, Phylum: Streptophyta
ccgcgactctttctttccaccaattcttctaattcaatataaatactggtcattggtattgtatcgttgcagacacgaataacacacaaatcattaatcaaccaccaccttaacacaacaacacgatgatgtccatcttcagccacttcgagatcgcgcaggcccagaactggagcttttctttgctcccagtaaaaagcacgaattcgaagcccaacacagaagccacttcctcctccgctgagtccaaaaccgccagaaaagtttccaatctatcacaacccggtggatccaagcaaaacccgccccgtttgaggcccagatttgcgccggagttggacgggttacactgctttgaatccattgtaccctgctagatggatttcttcagtctccaatctcaattcagatggcataaaaatcatacgcgattcaattcaatttatttttactgaatagtttaattagtagttgagaaagctatgtactgtacgcgaaagatgaaatgaagaataacaaaaattgaaattacaatctcccagctgagaatagggtctttgaattacctcaatttggatttttatagattggttttatcaaatggactgactagataatttaacaattttcttgaatcgtataatcacgcagtctattttagttttaaaatttatctcacgtgaattcggatgtgtcctaagctatggcattgttaggagtccaaagtacacaatgataaaaattaaatgaacggtaacgaagttaataacattttattggagtattcttaaaaaaaacattttattggtgtagatccttaattccacacagtcatgcttttgttccattaaagtaaaagtcataattaaaagtacattatttttactataagatgtcaattgacaaaagcattacacatccattcaattttaggagatttac

SEQ ID NO: 4181 - DNA, 1086 bp, Unknown
  Kingdom: Plantae, Phylum: Streptophyta
cacatttataaagcagaacaacacttgcaaattgcaaatacaaacctaaaccaaaacccgtgtctgtgtttgtttccactttgcaaatcagtgtgtacccaggaatctcttgattgagaaagtgtgttagggtaagagttgtgtcgtgtccacgagacactgggagaaagaaagtgtgtgtgagttgttgtaaactgaattttcatttttctttagccatgagcacacttgttcgcaacaccaccctcaccttcagccgcagaaacagatacgagcttcttggtttgcagggcaaagacaagatggtcaagtccatcagctacagacgcagaagggcaaagcaaaggcaaatctttctcacaacctacaagttatcttctttgaatagtaacacttttggggagccgacacaaaagcctaagctgaagctgaagaaggttgctgttaaggttaagaagattgtggcctcggttttgatgttcatgcgagttggttcttttaggtcatgcagttctaggtctcagatttctgccacctcaccaaataggaagaactcttgaggatgttgttctgacgtgggtttaggatggtttataattctctctataatctttggttctttcacactcaggagttttagtgtgtgtttgtgaaagcgaacgcaggcgtttttgtattggaacgcggaatttttccgttttcaaacacatccttattagtatatttatatggttgatgatgaaggatgggaaaggggtatttaatattctgtatataaagcttaatctaatgtctacttgactactttcaccactttagctaaataatatgccctgtttcaactttctattattttagcagttccatgactatctgaagtttcattggatttcactgattatatttctccttcaattattcaccttttagtgttgatatcaaagcttaattttgatgtcagaaatgaaaataggctctttacccctatattcaacgtcaattcctaaagattgtttttttccataagataaaaatattactgacatcaaaaagtgtttggagaaataatatgttttccatagtgca

SEQ ID NO: 4182 - DNA, 1968 bp, Unknown
  Kingdom: Plantae, Phylum: Streptophyta
attttatactaaaaaactatacgatagaagaatggcataatctatcaatcaataacaaagtttataatctatcaatattaatgtatatttgaaaactgtaagatagaagagtggcattggactgagtcactttccaataccatgccagattttgtataaaatcaaaatctggctgaaattcatgaaagctgcattacacggttgatgtgtccttacattaccaataatgttgttctaaagcataacacaagctttatgtgttctgatctgcaccacacactgatccatcacatagcatcatagcttctcaataattcaattgcacgttcctggaaacctgtgatgtgaatctcaaccgcacattccctgctaccttatcaattcgtgcattcaactgaagcaatcaaccacacacgtcatgctacttatcatctttattaaccgttcatttccaagccagtttcactcaccccgctgaactcatcacttactggaagccttgttgtgagtaagagaaaaggcttcctgcaccgagcacaccaacttgatacctctgattctttctttgcttagaattccacagaatatggagactgttcttttcaatcactccccacctttggaattcaagggtttgagcaaggaggaggaagactcattgctagggcaagtggaaatatggaggtacatgacatgcttcacggactccgtggccttgaaagctgtcatagagcttcgtatagcggacatactagaccgttatggtaaaccactatccttgtcgcaaattgtggagaacatagaagacgcaccctccccagatgcctctcttctccagagagtcctgagagtgatggtgcgcagaaagatcttcagtgcacaagaatcagagacaggagaaaccctcttcggcttgacacgagcctcgaagtggatccttcgcgacacgaaaatgaccctagcacccatgttgctgctggagaaccacccaattcacctgaaccctgcgcactacatcagtgagattattagagaaggcacaaaaaatggcactgctttctttaagtgccatggacatgagcaatttgagatgacgggtttggatcctgagtataataggttgttcaatgagggcatggtgtgcactgctagggttgtgtccaaggctgtgatcactggctacaaagatgggttcaaccagattaagtccttggttgatgttggaggtggcattggagggtctctttcggagattgttagggcttatcctcatatcaatgccatcaactttgacttgcctcatgtggttgccactgctcctaagttcgatgggatcacccatgttggaggtgacatgttcgtgtccattcctagtgctgatgctatttacatgaaggtatatcaaaaactgatcaataccatatcttcttaaaatgcatgtgctaatggcttataacactctaacacactacttttgcaaaagtgatattcgtacactcataatattagctagttaacatttagtgagtgagagagaaaaataataaaaaatatataaatataacaagtgatatcatgtaattataaaatgagaaaaacaatgcatattaatttagtattttaaaaaataattctagttttcatacataaacataattaaatttaatgtaatgaaattttatatcgttgtattactagtttgaactagtttgagttataatgagtcataaatgcataattatgtacatcttttaaaaaaattgaaagaaaggtataaataactattacccaaggtaatccaaatggttaatataatgatgtaagattttattgtatatatatataagtaatatatttaataaaagaatttgtatttgattttgatcatgtataaagaaattttatatcaacaaaaattatatattataaataaaattagtctctaatccgataactaataacacagac

SEQ ID NO: 4183 - DNA, 2010 bp, Unknown
  Kingdom: Plantae, Phylum: Streptophyta
agaaaacttgcttgttttggaggcagtcaaatccacctctttttccttctcttttcccacccttaaatcccccccttcctctcaccttctttcttaagaaagccattctcttccctatttgattcacacctccgcactctctctatcaccaatcccttatatcccccctccacttagctgaacataattcaccacttcaccatcaatttcccctccaatttcccatttatgatccatttggcatttcatcatatttcaccacttgtcctactccacttggatgatttcctaacgtattgttttcacaaatccttgttcttcatcagctaatagtttgagtccaacgaattcagcaacactatagatatatgctatatcttcctttccctatacattttccttccaaagtatctctagttctctacaaatcaacgtggcacattttttagcctaagaaaagctttagctgcaactcaaattcaaagtgtaagcctttcttgtttttattagtttatcttcaccaatggaagagaactttaagtgtgaacaagttggtctcattgatgagctaatgcaagggaaggagctagcaaagcagctctgtgaccatcttctagtctcatcatcatcatcatcatcttctcatgaaacaaatgaagtcctaattgagaaaatactttccacctatgagaaagcacttgccatgctgaattgcaaggctgatgtaggagaaagtaaggccaagaatggcagcatgatggattcccattgtcctctcacaaatggtagccccaaaagtgaggtcttggagcctgaggttaagaacaaaaatgtctttaagaaaagaaagaccatgtcaaagttgacagaacaagtgaaggtgcgcttgggaacagcacatgaaggatccctggatgatggctatagctggagaaaatatggacagaaggacattcttggagctaagtttccaagaggatattacagatgcacgtatagaaatgtacaaggatgtctggccacaaagcaggtgcagaagtcagatgaagacccaatgatatgtgagataacctacaaaggaaggcacacatgcagccaagcaggtcacttaaacaagacagtggcacccccatcaaagagaaaggtgaattttttgggagcaaataagcaccaaacccatcaaattaagaatcaaatacagcaagagaaaatagaacaaccaccagagacatttttcacttttggatcctcaggccttgaagttaaaatagaggacatggaccacaaggaggacatgttcccatcattttgcttttcttctccattaaaagaagggtcagaaaatggggacaacaacagccttttctcatataccatgatggagaacaacttaatggaaaacttctctcctacattcatatctccaacaagttcagatatagaatcaaacattttctaccactgggggagcactggaataggccaaagtgtgcaaagctcagagtctgatatcactgatatagtttcagcaccaacttcagtcaccaattctccaataatggaccttgatttcttcgataagatcgatttcgacacagatttccctttgatcccctcggaactttgcacttgataaattgtcccactgcaaagttaacaccaagtatataatttgtatgcggattaacagtgagttttgtagatcctgactaccagcataaccgagggaaggaagtctataataatcatagatcatgtcaataaatgaagactgtgaaacttctctctcgtgctagttaagagagttttcatttacctaggctgaaatgtgaaaataatttgtaggttgtagcttaatttagtctcttgtggtttctcacttcagttgtagtattgtcatttgtcgtgcttcaaacagaacaacaaattgtgaaataaatgaattttgtctaaaattatggtcaagattttgaaaattggcccacgatcacgatttcagccaacatgtca

SEQ ID NO: 4184 - DNA, 1314 bp, Unknown
  Kingdom: Plantae, Phylum: Streptophyta
atggtgttggggtggaggagaaggaagggctgcaacaataaccgccgaaaaggtggcaaatccatcacggagttggtgattcccaaccacttcaggtgtccaatttcccttgacttgatgaaggatcctgtgacattgtcaacagggataacctatgatagggagagtgtggagaggtggtttgatgaagggaacatcacatgtcctgttacaaaccaggttgtgagaaactttgacatgattccaaaccattccctcaggataatgattcaagattggtgtgtggagaataggcaacatggggtggagaggattccaacaccaaggataccaattagcccaaatgaggttgctgagcttctgatgcaagtgaaggcctcagcaaggggtttggaccaatatggttgccttaaattggtgcagaaattgaagaggtggggtggtgagagtgagaggaacaagaggtgcatagtggacaatggagcacctgtggcattggcttcatcatttgatgcatttgccaatgattctgttgagagaaatgtggtggttcttgaggagattttgtcagcactcaattggatgtttccacttcaattggaggcacacaagtctttggggtctttggcttctctaagatgcatggtttggttcttgaagcaccaagatctctcagggaaagagaagtccattgtggcattgaaagagcttctttcctttggtgatgtgcagcatgtggaggccttgtcacaaattgaaggggtcaatgtgctcttggagttcatcaacaagaggattagtccaaccatcacaaaggcctcattgagggtggtttggtacttggtctcatcctcttccaaatcaagtgagaagatgaggttggcatttgttgaattgggtttggtttcttctttgcttgacattctcattgactcagacaagagcctgtgtgagaaggctgcggccattttggactctctatgcagctctgaagaaggaaggaacaaagcctgcgggaatgatctaacaattcctcttttggtgaagaaaattctcagagtttcaccactgaccacagactattctgtttctgccatttggaagctgtgcaagtttggagaaaaagatgaagggagaacccttgttgaggcccttcaagttggtgcctttcagaagctcttgttggtgttgcaagttggatgtggtgatgagactaaggagaaagcaactgaacttctcaaattcctcaatccttacagggctgaattggaatgcatagactcagattacaagaatgttaagagatcattttaa

SEQ ID NO: 4185 - DNA, 718 bp, Unknown
  Kingdom: Plantae, Phylum: Streptophyta
aaactcgttctagtgtatgtgattgttgtgactcgttcttcttcgtcgttatcttcttcttttgttgtttgtgtgtttgttttttctctcacctgaaaatgtcttgctgcggtggtaactgtggttgcggaagcgcctgcaagtgcggcaacggctgcggaggctgcaagatgtacccagacttgagctacaccgagtcaaccaccaccgagaccttggtcatgggagtggcaccagttaaggctcaattcgagagtgctgaaatgggtgttcccgctgagaacgatggctgcaaatgtggagctaactgcacctgcaacccctgcacttgcaagtgaggtgttggagagctaaagcttcaagcagaaatggcccttagaaataatgataaaaactatatgtagtttcaaaacttcaaaattatgtagtatgtattatgttgcactctggtgttttgtgtctaaacaaacacccttagaataaagtggtcatttcttgcccttgagcaagttcaagtgttttggacttgtgatgggtgtgttaaggtcatggttgccttttttttatatatatatatatatataaatgtttggtaattggtcgcttctgtataaagttcggctagttaatctgaattatgaatctctgcttataatattaaactagtactattgctggaataaagtgtctagtttttctgtttgttttctttgccata

SEQ ID NO: 4186 - DNA, 973 bp, Unknown
  Kingdom: Plantae, Phylum: Streptophyta
gagccttttctcttcaaccccacaagaccacaacccattttttctcccttaacctcaattttctcatcctataacaaacttttttatttcacgttgtttttaatttataatttctcgtgatgggcaattacatttcttgcactttggctcctcctttgatgaagaacacaagggcaaagcgcgtgatcttccctacgggcgaagtgaagcaatacaaggagcaagtgatcaatgccgcggaactcatgctggagtgccctactcacttcttaaccaattccaagtctctacacatcggacgccggttttcgcctcttggcgctgacgaggagttggagtgtggcaacgtctacatcttcttccccatgagaagactcaattccatggtcaccgccgctgacgtggcggtgctcttcatggccgccaacatggccacaaagcgaatatctagtcgagaagatttaatatcacgtgatcactcaattgatgttattggaataaatgatgaagtcccaaggttgagcttggaagggcttgaggttgagtcagggtttcggaataggttaagttattgtaggtcaaggaagcctgtgttggaaaccatcaacgaggaacccatttggttaaagtgaagaaaagtgaaaggaaatagatagaggagtccaaaacatcaatgtaggtacgttagtagtagatctttgttgatgatcatatatacaattgaattgttatgtgatatttaattgaaagactttagaaatagagagctattgtagattaatgtatttatatatatacaacacttttgatcctttatagaaaagtttgatctaggaggtgcacggtggatttgtacaaaattcatcagaaagaataaaaattatatgggtgtatattgacttaatttcttctctcttttttttccttggagtgggatgatctagatcttttattgttttttctctttttcttg

SEQ ID NO: 4187 - DNA, 2422 bp, Unknown
  Kingdom: Plantae, Phylum: Streptophyta
ttatttctagtttctacaatattttaatacatcttcatgacataagtttgtaacattcgatctgctgactatatgactataattatttacaaaaaaaaaatctataaattattcattctgcagtcaaatagcaacttatctctgtctcatttcgcccctttgataacacaaataacaataataatcgaaaacttgggcaccaaatttgacccagcaaaaagagaaaacgtgcggcaatacccaaggaaagtagaaagatactcgccgcaatggtctgaatatttgagtcaattctgaatgtggttcatgttctgaatgcggtccatctgggccggctaatttttgaaagagaaaaagaaaaccacgttgttgatgatactctagaaggctggaccaaccttgcattgaccaaacccgagacttttgtgcattgcaccttctagagaacctccactcgtggtcatggcataacaaaaccaccctttttctcacctgtcacagatcacaaatactccctatatatataaaagcctctcacttcccttcatcctcacaacaacccccatttcccaaccactgctacaacaccacaaacttttctcttctctcttttcttgttttcaaatctcagacggaagaaataacaaacaagaaatcataggaaaaatgccaccttttgccggctccgaaccagttgggttcccgaagccagattccaacatagtttccattgacgtgggaggccaactgttccaaaccacgaaacagacactaacctcggcgggtccgaaaaccttcttctccagaattgcggcggaatcttctggactccacacccccttcgtagacagagacccagaactcttctcgctccttctctctcttctcagaaccggtaaccttccctcaaaggccaaagctttcgatctccaagacctaatcatcgagtctaaattctacggcatcgagtccctcctcgtcaattccctttccaacccttctcaattggaaccttttaatctccaaaaatcgcttcttttacccttgaacggacgcgattccccctccgccctcgccgccaccgcttccggcgccctccacgtcgcgcacggcagcaagatcacctccttcgactggtccctccgccgcaaatccaccgtcctgactcaatttaccgccgtggattccctcctcgccctctcgccggccctcgccgccgccggcgccaacgacttctccggcctccagatcctcgacctcgagaaggggcgcgtcagggaaaccataaattgggaaaacgtcaccaaatccggctccaccgtccaagccatcggatcctcgccggaaaacatgttcgtgagcttcgaatcttcccgcagaaactcgaattcgataatggtttacgatttgcataccctaacacccgtcacggagatcagtcacaacgagatcttcggcgcgaacatcgattcggcgattccggcgacgaagttgcaatggattgagggatataatttgctaatggcttctggatcccacagtgggccctcgggcgtgaacgggaacatacggttgtgggatgttaggtccggcaacgttgtttgggaggtttctgagaaggtagattgttttgctgacgtggcggtttgtgattcgttgtcggttatttttaaggttggggtgaattcgggggaggcatcctacgtggacttgcggaatttgagtagcggcggtgagaacgcgtgggtttgtctcggagacaataaaaggaaaattttgaatgggaagaaggaagggtttggttgcaaggttgaaacgcaggggaatcaagtgttttgcaccaagggtggtgaagtggagttatggtcggaggttgtaatggggtctgggaacagcagtgggaggatcttcaagaagaacttgatggggagagtcagggatatgggtggggccaagattaccaatttggcctttggagggagcaccatgttcttgactaggaaggatcagcaatgtgttgaggtgtggcagagttcttctagggaattttgatgactttgttattttcttcaatttttttaagaaagatggttggttgcattctgtaaatgaatttggcccgcctgtagattttttgaaaagtttggtgaggtaccaactaccaactttgacattattttccttttgtttgacaaattgttttaatctttttctaagatatcaattacactgcagtctatcatgattcatgaaccttactgtccatattctctaattcttgtcatccaataaaagatgtggccttcaacttgttttataaattttttattttctacatcgacaaaatctatggtcctatagtttggtgcatccatgctccaagctaaatggggtgggttgcagaatcgttcagggatgaaac

SEQ ID NO: 4188 - DNA, 2012 bp, Unknown
  Kingdom: Plantae, Phylum: Streptophyta
tggccttcattcagcaaaaaacacaccttacctttcactagcctaattcgctctcttctaccacaaaccactcaatcctaagaaatccatttgaaatttcaagtctcgttctggctaagtccatgttcattgtttactatacctcaccactccaaggttctcgtaattttcttcagcagaaaacgaaactattgcttccagagaagagcatcatctacgaccattttggcaatattataaaacaagacaaaaatggagagtgacttgagctgggagcggaacacactcatcaatgagctaattcaggggatggaggtagcaaggaagttgaaggctgacttgaagttgccgtattcagttgacacaagagatctgcttctgcagaggatattatcttcttacgaaaaggctctactgattctaagatgcagcaatgcatcaacttccgagttgcagggcatgaatcaagcaacaccaactttgctacccgagtccccattatctgtccatggaagtcctctgcgcgaggacgttcatggggccatcaaggatcaccataattcaaagaaaagaaagataacgcccaaatggatggatcgtgtaagagtgagctgtgagagtggtcttgaaggaccacatgaagatggttacaactggagaaaatatggtcagaaagacatccttggagccaaatatcccagaagttactataggtgcaccttccgcagcactcagggctgttgggcaacaaagcaagtgcagagatcagatgaagatcccacaatgtttgacataacttacagaggaaatcatacctgttctcagggaaacaatgccgttctgccacccaagtcaccagaaaaacatgagaaaccagcacacagtcataacattgacattcaccatgcacaggcatcacaagaaagccttgcaaagttcagaagtatcttgtctgtcaacacagataatctggacaatggagatatggcatatgctttcactttcccttccacttcatttggatgcatgaaacaagacaaccacagcttgattcctttggccctggagaatgactccttcttaagcgacctataccaaacacacctgttatccccaacaacaccagaatcaaattatttcccatctccaactttccagatgaatgagtttgatgggatctacaacaggtcacattcgaaatccgatatcaatgagatcatttccaccaacacatcagcaaccaattctccaattcctgatttcaatttctcacttgatccggtggaaattgatccaaatttccctttcaataccccaggatttttgtgctgattgcactataaatggaatactataagaatgtagtcttcataaaacgggacaatttcagacagcagtagaattgtagaataaagaatgagcaactgcagcacttatgaacgtccttgtagtcaatatcagaattgcaattttggctccgtgttagcaattagcagtatgcactttcaaataaaatagtttctgcaaatttgcattggtacaacctacaagacacgtctttagtagaagggcattaaagggagcagataaaaaattacacatcaaaattggatacgctggccaaaactctgtaatttcattccaattgatgacttagttacacaaatatccatatttatttacagcagccccagagcctgaaatgatacaaatatataatgatagtgacaaagtgacaatagaatggcttgtaacatgaaatctgcatcctaggattcttgttgttgttgttctactcgtccaagactgagttaggagtggaagcattttgatcttgtgaattttgagcttttctgagagcctctctgagacccaagacaatgaacaagttagtgagagtgaggagtgactcagccccaccacgttggacaaagaagtcccataatgcaccttcgctgtgtaacataaaaacaaaaatcaaacatccatccatcttctttaaatttatcatc

SEQ ID NO: 4189 - DNA, 1296 bp, Unknown
  Kingdom: Plantae, Phylum: Streptophyta
atcccttcaaagatgtcacactcaagcactctctttctcttcctcatagttctattcttcactccagcactctcagaactatgcaacccacaagacaaagaagccctccttcaaatcaagaaagagttcggtaaccctaccactctctcttcctggctcccaacctctgattgctgcaacaacaactgggtaggtgtctcatgcgccaacaagacccaatcttaccgcgtcaaccacctcgacctcaacgaccttaacctccccaaaccctaccctatccccccctccgtaggtaaccttccctacctcaattttctttccatcaccaacaccaacaacctcgttggcacaataccccctaccatcaccaaactcaccatgctccgtgaactccaaatcagattcaccaacgtgtccggcgagataccccattttttgtcccaaatcaaaaccctagaatcaatcatcttccactacaacaacttctccggcaacctccctccctggctcccttctctccccaacctctacagagtctccttagacggaaaccgcatctccggcaccatcccggactccttcggctccttctcggattcactgaagttgatgaccttctccgacaaccgcctcaccggggagattccggcgacgttggcgaagctggactttgatttcgtggacttgtctcagaacatgctggagggtgatgcgtcggtgctgttcgggtcggagaaacacacgctgcagataaatctggcgaacaactcgtttgcttttgatttcggaaaagtaagggtgtcaaagaccttgttgattttgtatcttagtcacaatcgtttatatggggcgctgcctgagggacttacgtcgcttaagaatctgggcacgtttgatgtgagctacaatgaattgtgtggtaagattccacggggtggtaggttgcaaaaaattgatgtttcttcctattctcataacaagtgcttgtgcggatctccgcttccaaagtgcaagcacttatagagctcaacactacatagttcacttgcccttacgagaaagggtataagaataagagaaattcttacgagaaattctttgtcctcttaagcttaatgttaagctactttgctatcaatttaacgcgtcacgtaattgtgtatgtgacactatgtaattgtatcgcacttttattttatcataaattaatcttgaaagttttttttatacataatacttgtatatcttaaaagttgtagacgttttctttcatttgaaagagacgaaagaataaaa

SEQ ID NO: 4190 - DNA, 783 bp, Unknown
  Kingdom: Plantae, Phylum: Streptophyta
gttaagttctaacacttaggcttagtcagttagtccccttcttataaattgaacccatttgtagttcattcccatcatcaacaatcaaaccaatttcagcacaacttgaaagaaatcctagtacttttctatctatttagctttctgtttgttcccaaaaaacactttcacaaaaatggcaaattctcgcattgctaggttcttcatggaagtagcaccaccacagtatgttactgtgatgaggcacagaacatcgaagatgttggacactattactgaagatgagagggagattagtaccaatgattctgtcatgttacctcctaaaaccaaatcaacagtggcagttgcagcttcttcagcttcatctgctgcttctgttaccaatgttaaggggaggcattttcttaaggaagttcatagatccctttcaattttgaatcagtgaaggcaaagcttgaggcagggcaatgaaacaacatgcaaccttggaccttggtggggttttttttttttttttttgagtcatgtaaagctgcaagctagtatctttttgttcatgtattgtccctcttgtttaggtaattattatatcctttcaatgggtttgatgaacaataatagtttgggacttgggagtgtaaagaggctcatggattgggaattcttgcaccttgaattttgttgtacaggttcatatttttctatcgaataaacttaaaactgttttttattttgtcatgagtttttcttattgataaatattaattatcattattatta

SEQ ID NO: 4191 - DNA, 649 bp, Unknown
  Kingdom: Plantae, Phylum: Streptophyta
tgattttttccacaacaaacaacaatctctctcctacctttctcgtgtctcttttattcttgtaacacaccttctcttttctcctagaaattctgagagggtgagtggtttttttgagttttgatagagagcaatagaatagctacatggggaagctcgtcgagattcttgaccaaggggtcaggattgctgcaaggtttcactctaattgcccccaaacgggccgcaagtactaccaccctccatccctctccgacaaccacggccaccactaccacgctggtgccaccaccaccagcgccggcggagtcaaagaggccgtggcggctaggagcattgacataattctttattctgtttgacagaaccatattttttttgtattttttgttcgattcgatcattgcgaggccattcatacatgtaattttgagctcaagttgataccaattttaaattttacaaacacttttctatgttatatggattgcttatttatacatgttgattttaattccgtatcaaaaacattagtcgaacgttcctaccagatctctatagatatgtagattttacgcgtatgaaaaaaatcaatgagaactttgttgactagatgtcttcaaggcatacaaaccctaatgtgggaggt

SEQ ID NO: 4192 - DNA, 1013 bp, Unknown
  Kingdom: Plantae, Phylum: Streptophyta
acactcttcacgcgtattcacacacgttaatctctggataacagcgaaatttccacctcaactcctacgttttcaacgtgaaacactaggtcaaaaatccaaatcgcatgctattctatatactttacttttccaatgactggtcctacatatcctttcacgcgttaaaaactataaaaaggacgtgtgcatgccacttttctcttcacaattcattcatcaatccattgttcactttcaaatcaactcaagagattcaaccaagaaatatagaagctagggttttgttacatttgtgttagcacgcaatactttgcaaatatggagagcagcttaggagacatgttggttaaggttgtggtgttcattctagttcaagccttggtttaccttatcctctccaattcatcaaacgtgttcaacaagaacatgaagaaatctaacagcttcaggccggcacgttcggtgagcattcgccggatgctcgctttgatctctgattttcctccagaagaagaaccctctccttcaccgaagggtgctaaaacaacatcacttcatcaaagtgatcaataattgtaaggatttaattaaattgtggctgcaattacaaattggagacaatttcagcttatcgggtggccatattaaggctcagaaacctccaaatgttgcggctgctgtggtggttacaaactgcaatttagactagacccatgccaagtagaatgtaattaaattatttctctctctgtttccttgtgtagaggctatggtattgcaaaatttgttaaaagagtccaaaattattggtatgtaggtattgaattcttttgttcatttattcttttatgatgaatattgtaatatatttatgagtggaatattaatgttgacattaatttacttttacctctgcttttaattagttaagaactcaatgattgtggtacatgcttgcttgttagaatatgtaattgcaatgttgcaggtaaaaaagatgtacgtcctcg

SEQ ID NO: 4193 - DNA, 1447 bp, Unknown
  Kingdom: Plantae, Phylum: Streptophyta
agtccttgtttgtgaagctagcaatatttgcattgatccactaatctctctttctctctctcattctctcttaaaacccacgtccgtgcccttgaagctaagaaacagtgcaaccaaagactcctccaatctgtctgtgttttcctgtgtagttgttctttgtctgctttcctttgtccttagagagggtttcattttttgcgtatcacaaaaggtagcagagtcaaaaacactgcagagtacaaaatgatgccaggcaatggacagttaacagttcctccgggcttcaggttccaccctactgatgaggagcttctctactattacctgaggaagaaagtttcttatgaagccattgatcttgatgtcataagagaagtagatctcaacaaacttgagccttgggacctcaatgataagtgtaggattgggtcagggcctcagaatgagtggtatttcttcagccacaaggacaagaagtacccaacaggaaccagaacaaaccgagcaactacagctgggttttggaaagcaactgggagggacaaggccatataccacactaattccaagaggattggcatgaggaaaaccctagttttctacactggtcgtgctcctcatggccaaaagactgattggatcatgcatgagtatcgccttgatgaagatgatgctgatattcaagaagatgggtgggtggtatgcagggtgttcaaaaagaaaagccaaaaccgaggtttccagcaagaaattgaagaagaagagcacttaaccacccatatgagagcaagtggtcattgccaggtcctagagccaaagcatcatcacatgcaacaaggactctatgatcactacaacttcgatgggacaatgcatctcccacagttgttcagtcaagaatcagcagttgcaccacccacaaattcttccttggcctcatctatgaatgccatggacatccttcagtgctctcaaaacctcctgaggctcacaaccactactggctgtggacttaatctcatgcagcagcaacaacaacaaggagagaggttcagtggtgactggtctttcttggacaagctactagcatcacaccatggcatggatcaaagcaaatgtaaccctcctactcatcatcaaggtgcaagtgtgggaacttcagctcagaaattcccatttcattaccttggctgtgacaccacccatgatatcatgaaattttccaagtaggaagggatattgcatttgaatgtgttattatacctaatgtgatcatgaggtgagaaatatttggttgctaagtatgtgtaatatgtaacatcttgttagatactcattattgagattcaactcattaatttatcttttacttgggtatcaattgtatatatatatggctatgatctttttcgtttaattaggtatttaatagcatgctagctat

SEQ ID NO: 4194 - DNA, 1280 bp, Unknown
  Kingdom: Plantae, Phylum: Streptophyta
ctggttttgaggtacattttaattaaattggatcaaaatcagtctgaatttggggcaggcccatcatgccaatatttcaggaccggaaattcttcatggccagatcgggctacgaataaaaaagaactgagacattaagatactcacattatagttctttcctgttctggaacactcttgtgaaatcatgtaatgtctgagaaggaacaagaactctccattcatctcacttttctcaaattattattacatgtgcatccattttgtgacgtgtccttaacatcctagaatctctaggacacttctccaagcatccaaagccaaataaataaccaacaccaattaccccatgttatatatatatttaagttgtcttcagttcctttcaaccatcagcaaaaacaaacagacaaactaagggaaaccatcaatagttcaacatcaagctcatccatcatatggctttggcacgtttggctttgaaaaacttgcaacaaagggtgtgtgcttcctctttcttgagtggcaatgttcacaagcagaggtggaacaatgagttgctgagaaggtttggtactgcagctggggacaagggaaaatctgaaggcactgaagttgctgtcactgaagggaaaaagtctaataggatgttcccaaggaggaggggcagaagatgggcttggagaaatgaggatcatgatgacttccctcctgctctttatgagttgtttccttcagggcttgggagtgcactgatgcaggcaagtaataacatcaacaggctgtttgagaacatgaatctgacaccttggtctctgactagtgggcgtgtgaaagagaaggatgaccattacaaactacggtacgagatgccggggatcgccaaagaggacgtgaagatcaccattgatgatgatggggtgttgacaataaagggagagcacaaggaagagaaagatgatgatgagcaatattggtcatcaagtagctatggatactataacacaagcctgattttgcctgatgatgctaaagctgatgacattaaggcagagttgaaggatggtgtcctaactctaatcattcctaagactcagaacccccaaaaggatgtgaaacaagtcacaatagaatgatgttggagattttttttatttatttataggactatggtgaggctatgaactttgtgactcttgttgtgtgtggtttttggacataatgtaagaaaacaaataaataaaacttcagacctgttctgtgaaaattttcagttgaat

SEQ ID NO: 4195 - DNA, 2012 bp, Unknown
  Kingdom: Plantae, Phylum: Streptophyta
ttcatcgtcagctatgacataaaaatataccttgaagaaaacaaacaagtgattttataatttgaacttcagcccttcgatttcatatttcgttgcaaaacaactacatcgcaataggagaccgtggcaatccgagtaggagacggtatagtttgaacaaagttagaatgaaaatcaaataagaaaaaaaagtcaaagctacacatccagtcaatagtttccatatctgaccctttcttttttatccctgcgtgttcacacataaccccctatatattacaacccctcgctgatcctttcaccaacaacaacaacatcaaatccacaacatagacctaaagcaaaagcactatggcatccttacaaatttcatctttgctttctaacaccttttgttcaacatcaccatcaagaataaaatcctctatccacatcccagaaaaactccctatacctttttccatagctccaaactcaaaaccaagtagaaagctgtttgaggaattaaacggtttctcgcacacaatccaaatactccaagacaactcatgcagcagcagcaacaacaacaacaacataacctcaaaagctaccattcaactttatgcaattctagaagccgtagacgatagagtggagatgcatcacaacataggcgagcaacgtgacaactggaacacccttctcttaaactcaatcaacatgctcactctcaccgcaaccgccatggcaggtgtcgccgccaccatcgccaccggtgacgcgccacttctggctctaaaactatcctccatgctcttattctccgcctccacggggatgctgatggtgatgaacaaaatccagccctcacaactggccgaggaacaaagaaacgctaggaggttgttcaagcaaattaagtcccacatcgaaacaacactagccattggaaaccctaccgaggaagatgtcaaggacgcaatggagaaggttttagcacttgacaaagcctacccacttcctttgttaggagccatgattgaaaaattccctaaaaaatttgagccagcagtttggtggccttcaaagagaaacaattccaaatatcatgaaacaaatcagcaacaacaacatggtaagaacaatgggtggaatgaagggttagaaatggaaattagagatgttttgaaagtggtgaaggaaaaggacatgaaggactatgagaggttagggaacttagttttgaagatcaacaagagtttggccattgcagggcctttactcactggcgttgcggctgtgggatctgcatgtttgagccaagattcatcatggggagcaatagtgtcggttttgggaggggcattagcgaccgctgttaatgcttttgagcatggtggacaagtggggatggtgtccgaaatgtacagaaactgtggtggattcttccaaatgttagagaattcgatccaagagactatggaggaagatgaagaacaaagggaaaatggagagttgtttgaaatgaagttggcgttgaaattgggaagaagtttgtcacaactcagagatcttgcaagaaaatcggcttattctcgggtagagggaataaccaccgatgaatttgctagcaagctcttctaattgattttttaaattgtaatctaattagctaacaattaatcaattcttttattcaattctaatttttcatcttcatttacttcttgctgtttttgggggcgcgcgtctaaagaaactaatctgctttgactcaccaaataaagaaaaaaaaatgcgtggacaatttctcgtcaaattattacaacttcattgtcatcttttaccaaactgacaaccaccgtgtagacttttcagtttactgatgggagatcatcataaattcagaattaacaaagagacaaacatgtttatacgtcaggataattcaggtttgggagaaaatgaaattttaatcaattaattttaattgatttggatttttattttttttctaattcaaatcaaat

SEQ ID NO: 4196 - DNA, 597 bp, Unknown
  Kingdom: Plantae, Phylum: Streptophyta
tcacagattgttctttcataacccaacatatagacatatatattagtgattgtgatgtatatatatacaagttgaatgctacgcatggccattgtgaagtgccatatgtacggtgacgattgatgctcattgtgttgtgataataagggtgtggttaattggttatggaggcacgtaaagagaggatggagcaagtaaagaaagaagagatcaaaggatcaaggaatactagtaaagaagagaatgcaacaaagggtgatacagtgagcaaaagggtgattcgtgagtccttagtatcgggtggtgacaaagaaagagctcaaaaacccgatgatgtcttgttgctcattggaattcactcttgctactgccagagctagtgacttcgtctaccacacttggatccttattattagagtaatacactaacttgcagttattcaactgcaactgtctagttagatttaaccatagtggttagatgtcagtttacaattacaaagttagttaggattttgttattgtaaatctatctataaatatagatctgtaatctcagactcacttgcctattgaaaatcattatttcctttatta

SEQ ID NO: 4197 - DNA, 1813 bp, Unknown
  Kingdom: Plantae, Phylum: Streptophyta
tcaacgattaagtaaatatcgcttgcagtagtaatggataaccaaaatgccatcgagttctttgaaggccaaaaccttttgtacatgcagatatttggtaacctaagacctgtgtgtcttatgtgggcttgcgaactaggtattccagacataatatccaaccatgggaaacccattactcttcttgagttggtctcagccctgcaaattccaccatctaaggtgggttttgtgaagcgattcatgcgctttttggcacacaatagaatctttgatatccatgagagccaggaagatcatcatgaattagcgtatgctctaactcctgcatcaaagcttctagtcaatgacagtatccattgtttatctccaatgcttcagttcatgactgatccgtttttaacgaatgcataccatcacttgggggaatggatgcgcggcgatgaccccacattatgtgagacagcctttgggacaaccctttggggacttcttgagaaaaaaccttcatacaatagtcttttcaatcaggttatggcaagtgattcccggatggtagacttggtactaaaaaattgcacttcgatttttgaggagctagattccatcgtggatgtaggtggtggaactggaaccacagccagaattatttgtgagacatttcctaagttgaaatgtgttgtgcttgaccttcctcatgttgtagcaaacttgacgggaagcaatcgtttaagttttgtcggaggcgatatgttcaaatctatccctcaagccgatgcagtcctactaaagtgggttttacatgattggaatgaagaaaattgcataaagatcctgaaaaggtgtaaagattctatttcaagcaaaggcaacagagggaaaataataatcatagatgcagtaataaatgaaaagctagatgaccaggataagactcaaacaaagctctgtatggatatagctatgatgatcgcttttaatggaaaagagcgaactgaagaagaatggaaacaactcttcattggagcaggattccaacactacaaaatatatcatacttttggttttagatctcttattgaggtctatccttaatgcttaggcactatatatctcatattaaattattttttttcctctaatttattatttaggtttaatttaatttttaaatttagaaaattgattattttgatcctttaatttttaaagtcaatttatttttttagaaaagtatgtattttataacggtttcaaaccacttagtaatagtttcaaatcgtcgtaaaatatgatgttttacaatttaaattgaaaaattaaattgaattattttaaaaaaaattaaaggatcaaattaaattaaaaaattaaaaagttagtttaaatctaaaaaataaattagaggacaaaatattaatttaatgtatatgttatggtgtatgtttctcaacgtcacaagatattgtggtgatgtgtcaaacaattcatatgttgtgtgttgtagttgaataaagatgtcataggaatgtagctaggcagctagctagcactgtaagcatggtggatcttattggttaagtgattaaatgtattacgtctgaatttctcctttcctatttagcaaaaataaattgaataaacttgtaatgggtttaatactttagttttagatgtgaagtgaataagtttacaatgttatggtgtgacttttcatctttagttatgagggggtgctatttggtacaagaagcataggtacacattcttaagaatttaaaaatcgccaatcatattattgcttgaccattca

SEQ ID NO: 4198 - DNA, 330 bp, Unknown
  Kingdom: Plantae, Phylum: Streptophyta
ctttcttttcacaaaaaactatgcaatctactcttcttacaattagctagatatatcatatatttcttatgcatgcatctatccttgacaagtgcaactaaggacaaaaattatagtaatcatctgggaatgaagctttgctgtatttgtaagggctaagcttgttgtgacatgaagagggtccagatggtggcactggccctttgggtaattggcttccaaacaagctttcgaagtcccttaagtctcttgtgcactcacctgtacttgaagcccccaagagtaccaaaacaaagagaatcaaacaagatctccccaaacacggcataa

SEQ ID NO: 4199 - DNA, 1831 bp, Unknown
  Kingdom: Plantae, Phylum: Streptophyta
ttctctcttagaataatagtattttctttgggggtggtctaactttgaacacattcatatgtatgaaaccaaggaccctgatcatgaccctgtacttatataacacagcacacacacgagacatgatatatctatgtgtgtctgattctctataaatatattcatatttatattgtacatacacgaacaaacccaattgaattgaagaaaatatttctcatcaaattgttccaaacttgatcaccaaaaagcacaattcaccttacaaaaaacacaaattttggttaattgctatagaagagatggtgttgggatggaggagaaggaagggcagcaacaaaaaccgtcgcaaaggtggcaaatccatcgctgagttggtgactcccaatcacttcagatgtccaatttctcttgacttgatgaaggatcctgtgacattgtcaacagggataacctacgatagggagagtgtggagatgtggtttgatgaagggaacatcacatgtcctgtcacaaaccaggttgtgaggaactttgacatgattccaaaccattcccttagggtaatgattcaagattggtgtgtggagaataggcaacatggggtggagaggattccaacaccaaggataccaattggctcaattgaggttgctgagcttctgatgctagtgaaggcctcgtcaacggatttggaccaatatggttgccttgaattggtgcagaaactgaagaggtggggtggtgagagtgagaggaacaagaggtgcatagtggacaatggagcacctgtggcattggcttcatcatttgatgcatttgccaatgattccattgagaggaatgtggtgcttcttgaggagattttgtcagcactcaattggatgtttccacttcaattggaggcacacaagtctttggggtctttggcttctctaagatgcatggtttggttcttgaagcaccaagatctctcagggaaagagaagtccattgtggcattgaaagagcttctgaaatttggtgatgtgaagcatttggaggccttgtcacaaattgaaggggtcaatgaactcttggtggagttcatcaacaagaggattagtccaaccatcacaaaggcctcattgagtgcggtttggtacttggtttcatcctcttccaattcaagtgataagatgaggttgaaatttgttgaattgggtttggtttcttctttgcttgacattctcattgactcagacaagagcatgtgtgagaaggctgtgaccattttggactctctatgcagctctgaagaaggaaggaacaaggcttgtgggaatgatctaacaattcctcttttggtgaagaaaattctgagagtttcacctttgacaacagactattctgtttccgcgatttggaaactgtgcaagtttggagaaaaagatgaagggagaacccttgttgaggcccttcaagttggtgcctttcagaagctcttgttggtgttgcaagttggatgtggtgatgagactaaggagaaagcaactgaacttctcaaattgctcaatccttacagggctgaattggaatgcatagactcagattacaagaatgttaagagatcattttaactttttggctgcttaattattagtatttttctattagaagtaattttgtgctgtaaattttttttggcccaacgaatggatctctgcaatctttgtcatgggattcaacgaatggagcatattgaattgtattcttttttgtatattacagtaagagtacgaatgacatattgatatcttcgtttatcacattaactatatatcttatctca

SEQ ID NO: 4200 - DNA, 1430 bp, Unknown
  Kingdom: Plantae, Phylum: Streptophyta
acaggatataaaagcagaagcaggtgttttgaatagagagagcaaggcaggactcaatttaattcagtcagtgagtgatacttgatagacatttggtgcatcaatggaaagcaaactattgcttcacatgaatagtggcaagggagaaaggagttatgcaaacaactccatgctacaaagaaaattaatgattaaaggcaaacatatactagaagaaactataacgagattttatagcaattattctccaagctgcatgaaagtggcagatttaggttgttctgtaggaccaaatacacttcttgtgatatcaaatatcattgacattgttgataccacatgcacccgcttgaatcaagaaccacccacgttccaattttatctcaatgatttgtttggaaatgatttcaataccaccttcaagtctcttcctgatttctataaaagattggatgaagataagggacacaagtttggttcatgctttattaatgctaccccgggatccttccatgggaggctctttcccaataattccataaacctttttcattccgccaacagtttacactggctttctcaggatccattattggagtttactaaggaggcagaatcatttaacaagggacactgtcatatagttagcacaagccctccagctgtataccaagcttaccttaagcaatttcaacaagactttaaattttttttgaaatcacgttcggaggaacttgtgccaggaggagcaatggtcttattgtttcttggcaaaaataaaactcatagaagaactggttgggaaataattagcctagtactcaatgacatgctcttggagggtttgattgaagaagaaaaattggactcctttaacataccagtgtatgaacctacagttgaagaaattaggcatgtgattgaggaagaaggatcattctttgttcaacgatttgagattttaaccttgccttgggttgaaggcctaaatgaaggtggtgataattcatttcttgatggaaatataaaagccagataaatggccaagcacgtaggagcagcaatggagcctctcttgtccacaaagtttggtgaagaagttataaacgaagtattcatcatgtatcaaaagaaagttgtgcaattaatggaggtggagaaattggagtgtgctacttctatgatatccatgaccaaaaatgcttgaagaaatgtggctaaatagaatatcttctcagttaataatacccaattaagttagtttggttgttaaaaactgttttctattagtcagtcgggggttattagcttttcctgtatataaacattcatgtattgccacaacagtcctaataatgtaaaagtttgtttctctttcatgtaccggcttaatgtttattcctaactcacaagtcgcaacaacaaatctc

SEQ ID NO: 4201 - DNA, 2008 bp, Unknown
  Kingdom: Plantae, Phylum: Streptophyta
gacaggaactcgatccaataacacatcccatcctatgtttgcaaggcgcccttctctttctatcagatttttgcttctcctactactgaggctttggttggccagagcttcaactggaggaacggttcgggcgaagaacaacagcgtggcaaggaggatgagaaaaactactccgacttctctttccaaacccaaattcaatcttcctcaaacatgtttcaagtggaaccgcttaagaaacaagacatgtggaaattcaatgaacctacaaaacaaactgatttttcacctgagcggacagcaacaaaatctgaattcccttcaattcagagcttttcctcagagatggcagaaggaaaaccagaaatacaaagtagctcagttcccgggtctggttattttgactacacaagtgcatctcagtctgtaagagaacaaaagagaacagaagatgggttcaactggataaaatatggacagaaacaagtgaaagggagtgaaaatcctcgtagttattacaagtgcacacatccaaattgctcagtgaagaagaaagtggagaagtctttggatggacatatcactgaaatagtatataagggccaacatagccacccaaaaccgcagtctactagaagaacaaactctcaatcaattcatcaaccttcttcgtcttgcacaaactcagggataactgatcattcagtggtgactctaggaaatccacaaatggatcatttctccatacaagaagattcttcagcttctgttggagaggaagagtttgagcaaacaccgcaaaccagttattccggaggagacggagataatcttggacctgatgccaaaagatggaagggagataacgaaaacgatggctattcagtctcagcaagcagatctgttagagagcctagagttgttgttgaaaccacaagcgaaattgatatacttgatgatggctttaggtggaggaaatatggacagaaagtagtcaaaggaaactcaaatgcaaggagctattacaaatgcaccgcccctggttgttcagtgagaaaacacgttgagcgagccgcacatgacatcaaagctgtgatcacaacttatgaagggaagcacaaccatgatgtgcctgctgcacgtggtagcggaaaatataactcgaacagaaattctcagaacagcaacatatcagcgcctataagaccctcggcagtgaattgttattctaactcatcaagtttcacaaattctctctataataatactaggcttccagcaactggaaatcaagaatcattttcactggacaagttcaagaatcctggaagttttggctattcagatcttaacagaccaatgggttcacataccaatcatgcacaatacacagatgctgcatactcaagggccaaggatgagaggaaggatgattcattccttcagtcatttctctcaaaggacttctaaatttggagtggaccacaactttacatattatcctggatatgtttttgtatagcatgtaggattttagttattcacagcagaatatagacaaaaaaattgcaaatgtttacttatttacctcttttagattagtgactggcactacagccatagtgacagaaaattgctgctatacctgtctgccaagttcttgtccaaattgaaacttcaactttatcataggattgactgatgaattctgttattcttttgttgtatttgtagggaaaaaaggttcttctggaagaatcttacgatatttcattaatcagtagcaagtgtgcttgtgttggctatttctactatgctctttctaattttagtttttatcaaatgatttgtgatgaatatcaggaggtccaggacttccataatttgtaccaatatcaacaccgggatttgataaattttcaattcatagtccttgatgtgaatcatacatagtccttaatgcaatttttgttgataacgatatgttaactgacatctgatttaatta

SEQ ID NO: 4202 - DNA, 1457 bp, Unknown
  Kingdom: Plantae, Phylum: Streptophyta
ctttagtataattcatctattcatttttatattaattacatttatttatccattatccatccatctttttggtcatcatgtttccttcttttcaatgagtatataaaggaggcaagcaccccaaacatttcttcaagcccacaaaagcataccacagagccacgcacataagaggagagggaaagaaaacaaaaacaaaacagctgaattttggtgtcagtctacattaagatttcaagagatggattttgattcatctttcttccaataccaaaactttaactcttcctttgtaaattcctctgtttgtgcagaaccattcccttgggaagactttcttttcttcaatgaagaaaacaccaccaccaccaccaccgcccttgattccttcaccatcactgaccactcctcacaatcacaaatcaaggaatcatcatcctcagattattccaactcttcaggctccttggtcagcagcactgagtcatcacaactagaagtgtcatccaatttaactcatgcaagccatcaactcaaagaaacacatgcatcaccacaaccacaaccaccaaaggaaactaacaaagacaagagaccctttagaggagtgaggagaaggccatgggggaaatttgctgcagaaataagagactcaacgagaaatggtgttagagtttggattggcacatttgacactgctgaagcagcagcactggcttatgatcaagctgctttgtccacaagagggtccatggcagtgctaaatttcccagaagaagtggtgagggaatcactcaaagacatgcagagtaataataagccaatatcattggaagatggttcctctccagtgttggcactcaagagaaaacacaccatgagaagaaaatccaaggctaccaacaaaaaaaacaaaagggaccatggaatggaatcacaaaatgtgaatattatttcacaaaatgtgctggtgttggaggatttgggttctgagtacttggagcaacttctcagcttgacttcttcttctgatgatgattatttcctatgctagtaataactgattagtttaatttaattaattaggtaatttcctgcatattgaattttgttcattaattaatttaatttggtaaatttgttgttgttggcatttgggattcgccacttttcatcgttatctctctcttggtggtgatttgttttttccggtgtcgtcataaagtaatgagagagagaagaatgagtaaggaatccgccaattgtataaacaaatgccatcaagaaaagagaaaaaaaattcaaacattgatgttgaaatttctgtccatggtttcttgtactcgatggaattcttaaatgaggaggacagagggatggaatggtgatcgatgacattgaatgccacgtttcattttttttcccttaattcaaaacttggtaattaaaatgccggc

SEQ ID NO: 4203 - DNA, 1248 bp, Unknown
  Kingdom: Plantae, Phylum: Streptophyta
atggccaaggaaatagtgaaaacacatgatgtttcttttcttcagagaccccatcttgtttttggtcaaatgatatcctacgggggattgggcattgcttttgctccatatggtgatcactggagacaaatgaggaaaatgtgtgccacggagcttctgagcaccaaaagagttcagtcttttgcttccattagagaagacgaggcagcaaagtttatcgactccattcgcgaatctgctggttcgcctatcaatctcaccagtagaattttctcattgatatgtgcctctatttccagggtagcattcggtggcatatacaaggagcaagatgagtttgttgtgtctttgatccgaaaaatcgtagaatccgggggaggattcgaccttgctgatgtctttccttcaattccattcttatatttcctaactggaaagatgaccagattgaagaagttgcacaagcaggttgacaaggtcctggaaaacatcatcagagagcatcaagaaaagaacaaaattgcaaaagaagatggagctgaattagaggaccaagattttattgatcttctcagaatccaacaagatgacactctcgacatccaaatgacgactaacaacatcaaagctttgatattggacatatttgctgctggaactgatacttcagcatcaacactagagtgggctatggcagaaatgatgagaaatccaagagtgagggagaaagcacaagctgaattgagacaagcttttcgagaaaaggaaataattcatgaaagtgatcaagagcaacttacttatttgaagttggtgatcaaagagacattcaaggtacacccacctactcctttattgctccctagagaatgctctcaaccaaccatcattgatggctatgaaatacctgccaaaactaaagtcatggtaaatgcatacgcaatttgtaaggattcccaatattggattgatgctgataggtttgtccctgaaaggttcgagggtagttctatcgatttcaaagggaataaatttaactatctcccttttgggggaggacgaagaatatgcccaggcatgacattgggtttagctagcattatgcttccactagctctactactgtatcacttcaactgggaactcccaaacaagatgaaacctgaggaaatgaatatggatgaacacttcggattggctattgggaggaaaaatgaattgcatttgattcccaatgttaatttataa

SEQ ID NO: 4204 - DNA, 1679 bp, Unknown
  Kingdom: Plantae, Phylum: Streptophyta
atggagttttttctagggctatgtggggttcttgttgccttctcagcagcactttgcctcttgttgctcttgatattaacattttattgggttgttttccctaatcaaacacttaagaagcttaagaaatgtgggttgggaggtccaaccccaagttttccacttggaaacattgaagaaatgaaacgaaagaataacattcaatcttcaattgtatcctcaaatttctcgcacgatatacactcgagcgttttcccctacttttcaagctggcagaaatcacatggtaaggttttcgtgtactggttggggacggagccatttctgtacgttgctgagccagagttcttgaagaaaatgtccacagtggtaatggctaagaaatggggaaaaccaagtgtgtttagaactgacagagaccccatgtttgggagtggtttggttatggttgagggtaacgattgggttcgtcacaggcacattgttgccccagcgttcaatccaattaacttgaaggccatggcaaatatgatggttgaatccacgaatcaaatgatagatagatgggctaaccaaataaacaccggcaaccccgaattcgatgtggagagggagatcacagcaacagctggagagatcatagcaagaacaagttttggcatgaaagacggcaatgcaagagatgccattgctaaattaagagccttgcaaatgactctcttcaagactaatcgttatgtaggtgttccctttggcaagtatttcaatgtgaagaaaaccttggaggccaagaaactcgggaaagaaatcgatgagctcttgttatccatcatagaatcccggaagaattcacccacaaagaattctcaacaagatttgttaggtttgttgcttcagggaaaccatcaggttgatggccggtcaggaaagacactatcatcacgagaagtggttgatgaatgcaagacattcttcttcggaggccatgaaaccacagcacttgctatcacatggaccttgttgcttctagccatgcatgaagattggcaaaatcagttgagagatgagataagacaagtggtgggtggatatgaaaagcttgatatcacctcgctctctggtttaaagaagatgaagtgcgtaatgaatgaagttctaagactatacccaccagcaccaaatgttcaaaggcaagcaagagaagacattaaagttgatgatataacagtgcctaatgggaccaacttgtggatcgatgtggtagcaatgcaccatgaccccgaagtatggggaaacgacgcaaatgagttcagaccagagaggttcatggatgatgtgaatggtgggtgcaaccacaagatggggtacttgccttttgggtttggagggagaatgtgtgtaggaaggaatttgaccttcatggagtacaagattgtcttaaccctacttctctctaggtttacttttaagctttcaccaggttacaatcattcaccttctatcatgctctccctaaggccaagtcatggacttccactcatagttcagcccctttagaatatattcaactcaattttacaaaaacaacatgtgtaggctctcatatatagttcagtcttcatggacttactattcaattgtagatagtaaaagtccagtagaatgggattgtattcatt

SEQ ID NO: 4205 - DNA, 3122 bp, Unknown
  Kingdom: Plantae, Phylum: Streptophyta
atggctcttgttgtttcctctaggaaggattcctttgtttgttgtctccttttcataatcgtatctgaagccagcgcacagtataacaccgtattctgtgataacaacaaagggaaccacacagtcaatagcacctacaacaacaaccttaacacccttttatccactctctcttcccacacagaaattaactatggtttctacaacttgtcgtatggtgaaaatgaagacaaagtaaacgccattgggctctgcagaggagatcttaagccagatgagtgccgcagttgcctcaacgatgccagaggcaatctgacccagcgttgtccaaatcagaaagaggcaattatatattatgacgaatgcttgttgcgctactcagaccggtcaatatttggcgtaatggaaacttctcctgattatgtgctatttaacatacaaaatgcaacgaacgtgggccagttcaatcaagtcctgaggaacttgatgaggatgctaacaggaatagctgcatcaggtgactctcgacgcaagtacgccgccgccagcgcaaccgccacaaatattcaagcaatatatggtctggtgcagtgcactccagacttgtctcagccagagtgcaaacactgcttgattggggctatctcagaaatcccaagatgttgtaacggcaagataggtggtagagttcttagacccagttgtaatatcagatacgaaaactaccccttctatgatgaacctacggcatatgcaccagctccatctccatctctattcaatactctgctcgttattctggttggcgcaaggacgatcaggatggctgccatttcttgcaaacttttctttcattgttgtttatttctaaaattcatatatgaagccaacgctcagtcagccgaatgcgatgacagcatagggaactacacagccaatagcacttataacaccaacctaaacacccttttaaccactctctcttcccacacagaaattaactatggtttctacaacttttcatatggccaaaacactgacaaagtaaacgcaattgggctgtgtagaggagatgttgagccagatgagtgccgcagttgcctcaacgatgccagaggcaatctcacacagcgttgtccaaaccagaaaaaggcaattatatattatgacaattgcatgttacgctactccaacaccacaatttttggcgtcatggaaacttctcctgctcttttcctggggaacacagtcaatgcaacggacgtggaacagtttaatcaagtgctccaaaccttgatgagcaatctaacggacagagctgcatcaggtgactctcgtcgtaagtatgctacagacgatacaactgcggcaagttttcaaagaatatacggtttggtgcagtgcacacctgatttgtctgggctagactgcagtagctgcttggttggagctatagaaaatatccaagattgttgtagtggtaagagaggaggtagagttattagacccagttgtaatgtgagatttgaactcggacccttctacggacaaacgacaacaatagacccagtcccagaggtatcaccacctcctcctccgcccaccaataacacttcccaacaagaaagtagcaacacaacattgattgtcattgctgtaattgtgcctactgttgttgttttgctcatttgtctctgcctatatttaaggaggagtaaggcaaggaaaaatcttacagttaaaggagaagaagatgcaattgaagatgatgatgaaattaaaattgctgagtcattacaattcaacttggacacaatacgagttgctacagaagacttctctgaatctaataaactaggacaaggtggatttggagctgtttattggggtaagctctctaatggacagatgattgcagtcaaaaggttgtcaagagattctgggcagggggatacggaatttaaaaatgaagtgcttttagtggccaagcttcagcaccgaaatttagttaggcttcttggtttctgcttggaaggaagagaaaggctactcgtctatgaatatgttcataataaaagccttgattatttcatattcgattcaaccatgaaagcacaactggattgggaaagacgctacaaaatcattagaggtattgctcgaggccttctctaccttcacgaagattctcgactgcgtattatccatcgtgatctcaaagcaagcaacattctcttagatgaagagatgaatcctaagatagcagattttggcatggcaagactggtattagtggatcaaactcaagcaaatacaagtagaattgtgggaacctatggatatatggcgccagagtatgcaatgcatggacaattttcagtgaaatcagatgtcttcagttttggtgtattagttcttgagattgtaagtggccagaaaaacagtggcattagtaatggggagaatatggaggatctactaagcttcgcatggagaaactggaaggaggggacagctataaatattgtagatccatcactaaacaacaattcacgaaatgaaatgatgagaagcatccatattggtttactttgtgttcaagaaaatttagctgacagaccaaccatggctaacattatactgatgcttaatagctattctctcagtctcccaattccggccgaacctgcattttatatgaacagtagaactcaaagccgtccagacatgcaatcatgggagtataattcaagggaaacaggaacaagtgaaccgatacttaaatcagctcaagaatcagaaaatgaagcttcaattactgagctataccctcgctagatttttgtcatggggatgagattcattcatcgtcaatgcttctagctagtcttaaaccagaatacaacgtcttagaagtcatgtaatttgttcctgcaatgtcctgtttaaatacaacacgcatcctttgtctaaaattgtgacatgacctttagttggtctcgaagcctttgtttgttcttagtgatttgagagatgttccatttccttcctccacactccacagccgtggttttgaatggaaattcagactttatgttgcaggtacttgttgctatacgtgt

SEQ ID NO: 4206 - DNA, 1346 bp, Unknown
  Kingdom: Plantae, Phylum: Streptophyta
agaaaaaaaaaaatttaacacgaacctcttataaagcgggcaacgaatcctcatcacaacgcacactcatagtttgctttgaccatggccttaaattctccaaactccagcaactttagcactgccctctctcttgggttggcttccaacaccaacgaagccttaacggtgaaaggaatgggccaactagggttgaaccaaaggatcactaaggtgagaaaatcctcattgaccgcaaaagaaagatcgtgtctggttcatggtggcagtgaaaacaacactgagagtatcataagagcaagtcagattgtaagagcccaactggtgcatgcagtatcatcaacaccatccccagtttccagtaataatgttgtggttgttgttgcggacaaaaagaaagccatcgagattctgcaggccaaacttctctgcgcctcagcatttgctcctaaaactagtcccacatcgctcaggccaattagccttagccaccgtttaacttcaacgcccccactcaaaacgcgtcgtggttttcttaatgacgatgattttgcttattctctttgtccctctccgctgtctgtttgttttccccatgaaaccagtaccttgcagaatcatgttcgtggcggcgacaccaagtacgatggtcggatgcatagctatccgtacaagaaaaatgggccctacacgtgtcccaagtgcgggcacgtgtttgagacgtcgcagcggtttgcggcgcacgtgagttcgagtcactacaagtacgagaccaagagtgagagaaagaagagactcatggccaaaatccgaaagagaaatctccgtatagaatgggtaagtggtggactcactgttgttcctgacgatgctcctcctactagtgcttttgcttattcggcacgaaacaacaacaacgttgctcctccacctcctgttagggtggtgaaggttgaaggtcagagtggtatggagcttcagcttgctcctcctcctggatgggaaaaattaactgctggaggtggagctgttaaaatcaaattggagcctgtagctagctagggtcttaatctcttatcaagggtccagtagttttagtactctgtttaattgttattcatagggtcagattcaatcttcaattgtgtttatggaccacttatacggtctatagtgcttaattaattgggtcttgtcttcattgttcgccttctctcgttgaataaatactggattttatcttcgaatttcatgattcaccacaatgtagctctcacaagtgacttgtgtcatactcctatatagcttgacacagaattttggtcattcattctctatgaaattag

SEQ ID NO: 4207 - DNA, 1731 bp, Unknown
  Kingdom: Plantae, Phylum: Streptophyta
cctaggaccagttgattctatttcccataaagccatggaacattctcaactgtccattgtcattaccttctttgttttcttgctcttgcttaggctagttaaaaatcacaagccaaaatcgagtcacaagttgccccctggtccatggaagttacctatcattggtaaccttcatcaggtagcactagcagcttcacttccacatcatgctctccaaaaacttgcccgtaaatatggacctctcatgcacctccaacttggtgaaatttcaacactggttgtgtcctcccccaagatggccatggagataatgaaaacacatgatcttgcttttgttcagaggccccaacttctggctcctcaatatatggcatatggggcaacagatattgcttttgctccatacggtgaatattggaggcaaatgagaaaaatatgtacgttggagcttctaagtgccaagagggtccaatctttctctcatatcagacaagatgagaacagaaaactcatacaatcaattcaatcatctgcaggctcaccaatcgatcttagtagcaaacttttctcgttgttgggcaccactgtttctagggcagcgtttggaaacaaaaatgatgaccaagatgagtttatgtctttggtcagaaaagctgtagcaatgacaggaggatttgaactggatgatatgtttccttcattgaagccgttacacttactaactgggcagaaagccaaagtggaggaaattcacaagcgggcagacagaatcctggaagacattctgagaaagcatgttgaaaaacgaacaagagcaaaagaagaaggcaacaacagtgaagcacagcaagaagatcttgttgatgttcttttgagaatccaacaaagtgggagcctcgaggtccaaatgacaaccggacacgtcaaagctgtcatatgggacatatttgctgctggaactgatacctcagcatcaacgttggagtgggcaatggcagaaatgatgaaaaatccaagagtgagggaaaaggcacaagctgtaataagacaagcattcaaaggaaaggaaacaatacgtgaaactgatctagaagaacttagttacctaaagtcagtgatcaaagaaacgttaaggttacaccctccttctcagttgatccctagagaatgcatcaaatcaaccaacattgatgggtacgaaataccaataaagagtaaagtcatgataaacacatgggcaattggaagagatccccaatattggagtgatgctgagaggtttatcccagagagattcgatggtagttatatcgatttcaaagggaatagctatgagtatataccttttggggcaggaaggagaatgtgtccaggcatgacatttggtttggctagcattacgcttccattggctttattactctatcactttaattgggaactcccaaataagatgaaacctgaagatttggatatgaatgaacactttggaatgacagttggcaggaaaaacaaattgtgtttgattcccaccgtttaccaagctacatgatacttatattttttaataggcaaaaaaagatttaataaaagtaccaatgttaccagtgataatgtttgtagtacctgttgatatctctaccctttgcggagtcttgtctaatgtaatttattgtttgttactgaatctataatatataatccaatatttttaaatttgaattgatgagt

SEQ ID NO: 4208 - DNA, 825 bp, Unknown
  Kingdom: Plantae, Phylum: Streptophyta
taacacatgtacttgttccctttgtctgactataaaatggcaccatttgttgctccccaacaccaccaacaagccacaacacaaccacaaaagctttctttcattgttcctagcaattaattcacaataacccttttttttctagctttttcaccaaactttccaaaaatgaattcctcaaaggcatgcacccttttgaatttgatcatgcttgttgttatgttggttgcaatttttattagccaaagtagggtggaggcaagggttttatctcattcggaggagtttgcatttgcaagagctaataaccttcaaacatacagttcatcagcctatgaacaagccaagaaaaccatggggttttggatgcagcgtttggcttctggacctagtcctaaaggccctggtcattgatacttcaccctaatacacacgttcacatgtagctagaatagctcaattattttatcactttcgtcaatttattaaaagattctttaggtcaagatatatacaatatgatctatcggtgagcacagacctatctatccacataaataatggatgtatgtagaaaaaatgaacatggatctaacaagtgcaaagatccatgtgtattgaaataggattctttaatttatatatatacgtcattttttaatttattagtctctctctttatatctcttttcagctactttttatggatttaatattgatgtgaatatcgttttggctaacgattgtcatacaaaagccatcaactacctccttgctcttcctgacctcttccactacataccttgacttgatcaagttccaaac

SEQ ID NO: 4209 - DNA, 1987 bp, Unknown
  Kingdom: Plantae, Phylum: Streptophyta
aaaccggaaagcatctgcagagacaacatcaaacgactaagcaaaatacatcataagatatggcattcgacgcttatttccttttgggcctcatagctcttgttcttgttagcacttccaaagttacatgcgaattagaagcagatacagtttcacctgttattgacatttcactcaaccggaacagtttcccagaagggttcatctttggggcgggatcttcctcgtaccagttcgaaggtgcagcaaatgatggtggtagaggaccaagcgtatgggataccttcacccataattatcctggtaagatcattgatagaagcaacggagacgtggcaattgactcatatcaccactacaaggaagatgttgggatgatgaaggatatgaatttggattcatatagattttccatttcttggtcaagaattctcccaaaaggaaagctaagtggaggtataaatcaagaaggaatcaactattacaacaaccttattaatgagctaatggctaatggtatacaaccacttgttactctttttcactgggatcttccccaagcattagaggatgagtacggtggcttcttaagtccacgcatagtgaaagattttcgagactatgcggatctttgtttcaaggaatttggtgatagggtgaagcattgggttactttgaacgagccatggagttacagccaaaatggctatgcaaatggacgaatggcaccgggtcgttgttctgcatggatgaatttgaattgtactggtggcgattcttcaacggagccttatttggttacacaccatcaacttcttgctcatgcaaccgctgttcgtgtgtataagaccaagtatcaggcatctcaaaaaggtttgattggtataaccttagtagctaattggtttttgccgttgagagataccaaatctgatcaaaaggctaccgaaagagcaattgacttcatgtatggatggtttatggatccgttaatatctggagactatccaaaaagcatgcgatctttagtcagaacaagattgccaaagtttactacagagcaatcgaaactacttatcagttcatttgattttattggtctaaactattactctacaacatatgcttctgattcacctcaactaagcaatgccaggcctagctacttaacagattctcttgtcactcctgcatatgaacgtgatgggaaacctataggaataaagattgcttctgattggctatatgtttatccaagaggaattcgtgaccttttattgtataccaaagaaaaatacaacaatcctttgatttacatcactgaaaatggtataaatgagtatgatgaaccaatattatcacttgaagaatctcttatggataccttcagaattgattatcattatcgtcatctcttttatcttcaatctgcaattaggaatggcgcaaatgttaaaggatattatgtatggtctttgttcgacaactttgagtggtcttcaggctatacatcgcgatttggaatgatttttgtggactacaaaaatgaattaaagagataccaaaaactctctgcattatggtttaagaattttctgaagagaaaaaccagactttatgcctctagtaaatagtattgtgaagttagtttatcaaatgattatattggtaaattgattattgatttttatttattattcttttattcaaaagaggtcctattggacttattggggaaatagagatttgttagattttttttttctctaaagaggtcctatcggacttagaaggaaatagagatatatttgatcattctttcattctaaagaggtcctattagacttagaagggaaatagagatgtagatttgttgatagttgctgctaatgttacagtaataagaaggaaagaaacgttatgaatgttatgataaatatgtcatttacaattgattatatttgtttatttgctgcatcagtgcatc

SEQ ID NO: 4210 - DNA, 2023 bp, Unknown
  Kingdom: Plantae, Phylum: Streptophyta
aagaaaaacatatcacacaatatggcattcaaaggttatttccttctcggcctcatagctcttgttattgttaggtcttccaaagttatatgcgaagaagcagctaatacagtttcacctattattgacatttcactcagtcggaagagcttcccagaagggttcatatttggggcgggatcttcctcttaccagttcgaaggggcagcaaaggaaggtggtagaggaccaagcgtatgggataccttcacccataattatccaggaaagatcatggatagaagcaatggagacgtggcaattgactcatatcacaactacaagaaagatgttgggatgatgaaggatatgaatttggattcatatagattttccatttcttggtcaagaattctcccaaaaggaaagcgaagtggaggcataaatcaagaaggaatcaactattacaacaaccttatcaacgaactagtggctaatggtatacaaccacttgtgactctctttcattgggatcttccccaagcattagaagacgagtatggtggctttttaagtccgcgcatagtgaatgattttcgagactatgcggaactttgcttcagggaatttggtgatagggtgaagtattgggttacattgaatgagccatggagttacagccaaaatggctacgcaaatggacgaatggcaccaggtcgttgttctgcatggatgaatctgaattgcactggtggtgactcttcaacggagccttatttggttacacatcaccaacttcttgctcatgcagcaactgctcgtgtgtacaagaccaagtatcaggcatctcaaaatggtgtgataggcataaccttggtagctaattggtttttgccgctcagagataccaaatctgatcaaaaggctacagaaagagcaattgatttcatgtatggatggtttatggatccattaacatctggagactatccaaaaagcatgagatcacttgtgaggacacgattgccaaaatttactgtagaacaatccaaactacttattggttcatttgattttattggcctaaactattactctacaacatatgcctctgatgcacctcagctaagcaatgctaggcctagctacttaacagattctcttgtcactcctgcatatgaacgtgatggaaaacctataggaataaagattgcttcagactggttatacgtttatccaagaggaattagtgatcttttattgtataccaaggaaaagtacaataatcctttgatttacatcactgaaaatggtataaatgaatatgatgaaccaacgctatcacttgaagaatctcttatagataccttcagaattgattatcattatcgtcatctcttttatcttcaatcagcaattaggaatggcgcaaatgttaaaggatattatgtatggtctttgattgataattttgagtggtcttcgggctatacatcgcgatttggaatgatcttcgtggattacaaaaatgatttgaagagataccaaaaattgtctgcactatggttcaaggattttctcaaaaaagaaaccaaactttatggctccaataaatagtgttgtgaactttgtttatcaaataattatattttgtaaataattatttgatatatatttgttattcttttattctaaaaaggtcccattggacttacaggggaaatagctagagatttattagattgttcttttttttttacaagcttttaaagaggtcctattggattagaggggctatagagatttatttgaccattcttttattctaaagaggtcctattggacttataagggaaatagagatgctgattaatttggtgataattgctactaatgttacaataagaaggaaaaaaacgttatgataaagatgtcactaatttacaattgattgtatttgataatttattgaatcttatgttcggggattttgtgaaagttaatgatagtaaagcttactttcactctaatcccatcgagtggc

SEQ ID NO: 4211 - DNA, 1345 bp, Unknown
  Kingdom: Plantae, Phylum: Streptophyta
gatcaatccaaacaaaacctcaaaatctatataatataataaccgcagaaacttgataacataatcatttagtctagcgtacacaactaaactttttgaaacatttcttctgaattttagttgtcaacaccacccatttttaaagctttgaagcatcatcatcgctgtgttctagttagcttccaataactaatggtacttttgacagagaaacttgcaaaacgttacttcaacttcaagctggagaatcgccaccatgccattacacatcctcaaccagaggagttatcatcttcacttcttgcgtttaaatcctatgtgtccaaatcaattgaccaattagcattggatttgaaacctggatcagagaccttgtccttgacatggtttggaaggtgttttgacctcttgcccttaatcaacaaggcttttgcaaagcttgttgcggatattgactacccaatgagtaaatgggagattttttccattgaagggtactacttgagctacaccttgagtttgctagagcttctgaattccatttcttcttgtttttctcatcttggccaagctagcctttctctggttcatggtttgaccctagtggagaattcaccttctttggctacaaagccatatctgaaagcaattcaacttcaacaagggtgtttcagcaccaactttggtcaagatcatgatgacgaaaaaagggtttttttctctggcaaggagtggatggttcatgaggctgtaaaggaaatgaggagtattggattctgggtatgtggggttatgttgtcttgtttatatggtgatggtaagccatacatggagctgagaaaaattgctggagggtttgatggtggttctctagttgccacgcttgattccaaaatcggtgaacagttgatgaagcaaaggccaatcttcagtgagatcaaagaggtaaacaatgctgtttctaaccttcttgttgcttctgatgaagtgagacatgatgcagccaaggaattgcagacaaagctgagtgtgttggagaagctatctgatgatataaggaaggaggtggataatctgtttgccaatgtaatgactcagagatccgaattaattgatggctttcggctacagaaacagccacaaaaataaagtgtctgaccatatatattatgtatagatcaatagtttttaattgcttttgtattgtttataaattgtatccagtcatgtaactagtaatacctagtcctagtgattatttgcacaattaggaacatatataatgaataataaaattatggttcttcatattttcagttgacaacctattcatgattcaaaatta

SEQ ID NO: 4212 - DNA, 2870 bp, Unknown
  Kingdom: Plantae, Phylum: Streptophyta
attcaacatgagagaatttgttgtcttgttattgggatgtcggtccaaaaatgcagcctcaatgttagtttgaagacttttcaattgtacacagcaaggtcatgccacgagcttggactcacccttttcattcaaatgaattttgattaaatgaactttggaggcctgttgtaaccatggcaaaacaatcataaacacgaatgttaataatggtccgatttttcttcttctgcttcttcatttccacgttattaatacaaggcaccctcgctataattactccaaatgagtcaatccaaggcaataggaccctagtttcttctgctggaacttttgaagcaggattcttcaactttggaaattcacaaggccaatactttggtatatggtacaagaacatatcaccaaagactattgtgtgggttgccaacaaagatgccccagttaaagactcaacagcatttctcacactaacacatcaaggagatcctgttattcttgatggctcaaggagtactactgtgtggttctccaattcatcaagaattgctgagaaaccaattatgcagcttctagactcgggaaatcttgttgtgaaagatggaaacagcaaaaaagagaattttttgtgggaaagttttgattaccctggtaacacttttcttgcaggaatgaaacttaggacaaacttagtttctggtccttataggtctctcacatcttggaaaaacgcagaagatcccggttctggtgagttttcatatcacatagatgctcatggatttcctcaactggttactacaaagggagaaattttatttagcagagcagggtcatggactggctttgttttcagtggagtttcttggcgaagaatgcttagccttgtaactttttcgctagcgattaatgacaaggaagtcacttaccaatatgaaaccctgaaggctggaactgttactatgttagtgatcaatccatcaggctttgtgcaacgtttgttatggtccgaacggactgggaattgggagattttatcaactcgtcccatggatcagtgtgaatactatgccttttgtgatgtgaattctttgtgtaatgttactaactctccaaaaacatgtacatgcttggaaggttttgtacccaagttttatgagaaatggagtgcattagattggtctggtgggtgtgttagaagaataaacttgagttgtgaaggtgatgtgtttcaaaagtacgcaggaatgaaattgccagatacttcttcttcttggtatgacaagagtttgaaccttgagaaatgtgagaaattgtgtttgaaaaactgctcttgtacagcatatgcaaatgtagatgttgatgggagagggtgtttgctttggtttgataacattgtggatttgacaagacacacagaccaaggacaagatatttacatacggcttgcagcttcagagttagatcatagagggaatgaccagagctttgataacaagaagcttgtagggatagtagtaggcattgttgcattcatcatggtacttggatcggtcacattcacatatatgaagagaaagaagctcgcaaagagagagatgctaaaaatatttcactggaaatacaaaagggagaaggaagatgtggagttatcaacaatatttgatttttcaaccatctctaatgctacagatcaattttcacccagtaaaaagttaggagaaggtggctttggaccagtatacaagggtttattgaaagatggacaagagattgcagtcaagaggcttgcaaaaacttctgagcaaggagcagagcagttcaaaaatgaagtcatgttgatggcaaaacttcagcaccgcaatcttgtaaaacttcttggatgttctattcaccaaaaagaaaggctcttgatctatgaatacatgtccaacagaagcttggattacttcatttttgattcaacacaaagtaaacaactagatctgacaaagcgccttcaaatcatcgatggtattgctcgagggctactctatcttcatcaagactctagattaagaatcatccacagagatctcaaagttagcaacattcttctagataatgatatgaatccaaagatatcagattttggtttggctagaacatttggaggagatcaagctgaggctaatacaaatagagtgatgggaacatatggttatatgcctcctgaatatgcacttcatggacgtttttcaatcaaatctgatgtatttagctttggtgtaattgtgctggagataataagtgggagaaagaatcggaatttccaagactctgagcatcatcttaatcttcttagtcatgcatggagactgtggattgaagaaaagccacttgagctaatagatgacctattagatgatccagtctctccacatgaaatactgagatgtattcatgtgggtctgctatgtgtgcaacaaacacctgaaaatagacccaacatgtcatctgtggttttaatgttgaatggtgaaaagttgttgcctgatccaagccaacctgggttctacacaggaacaattcagtatccaattcagctagaatcttcttcgagaagtgttggagcatgttcacaaaatgaagctacagtgtccttgttagaggcacgatagaagaatactagtgtgttgatgatacaaggaataaggattttaggaagaactttatttacaaattaattggaatataaagcacttgtaaatatttgggatagaactcagaaaataacttatgatacgattaaagagataaatgaaagcatacaaatatgatataaatataacaataatataattataacaacaatataggtataacaaggc

SEQ ID NO: 4213 - DNA, 426 bp, Unknown
  Kingdom: Plantae, Phylum: Streptophyta
atgagggtgaacacagagtttgagcgtgttcttaagtattttgatgaggatggggatggtaagatttctccatgtgagcttaggaaccggctaggcatgattggtggtgagttgttgaccaaagatgctgaaaagttgattgaggagttggattctgatggtgatgggtttttgagtttggaagattttgtgaaacttatggaggcagctggggaagacgagaagttgaaggatttggaagaagcttttgagatgtacaatgacactgaaatgtttgggtttattactcccaaaagcttgcaaaggatgctgggtaggttaggagaatcaaaatccatggagcaatgcacaactatgattggccactttgatttgaatggagatggcctgctttgctttgatgaatttagagtaatgatgcagtga

SEQ ID NO: 4214 - DNA, 1906 bp, Unknown
  Kingdom: Plantae, Phylum: Streptophyta
cactcatctcaccaagctaactactttgacccatcctcatctcctccgcacacccatctatatatataccaaccacgcaaccttcttttcctcatatcatattctctcattcacctcacaacttcatcaaaccaaaaaacacaacaaaagaaagaaagaaagaaacaaagagttccttgctttgtagtaagatatatcatcaaaaatggttttgtcttggactagaagaaacgttttccgccgtgcaaagaaggagaaggaacaaagtcaactattagaagttgaggttgtgattcccaaccactttcgctgtccggtgagtttggagctgatgacagatccggtgactttatcaaccggcattacctacgaccgtgtgagcatcgagaagtggatcgagggagaaaacagaacctgccccgtcaccaaccaggtgctgacaaccttcgacctcatccccaaccatgccattcgcatgatgattcaggattggtgcgtccaaaacagttcttatgggattgaaagaatccccactcctcgtattcccatctccagctacgaggtatccgacacttgtacgaggatcttgtcggcttgccagcgtggggacaatgagaggtgtcaggagttggttggaaagattaaggtttggggtagagagagtgagaggaacaagaggtgcatagttggtgctggtgctggtgctgttcttgcatatgcctttgattgtttctcaagtaactctattgataagcatgtggttgttttggaggaggttttggaggtgatgacatggatgatcccatttggggaagagggtgtttctaaattgagttcaagagcttctttgaattcattggtttggtttctagaagggaaagaccttgcatcaaggcaaagtgctgctttgttgcttaaagaagtgtgtgtgcaagaattggccaaggttggaaatgttgttgaggctttggttaagatgcttagggagcctattgggagtagtacttccacaaaggcttgtttggcaacaatttttaacttggtttcttcagcggctgcgaatagagaggggattgttcaaagatttgtggagttgggtttggtttcacttttgcttgaggctattgttgatggagaaaaaggggtgtgtgagaaggcacttggggtgttggattgcatttgtgattgccaaaaggggaaggaggttgttgaaagcaatgctcttgccttgcctcttgttgttaagaagcttttgagggtgtcaccattggcttcaagttttgctgtgtctattctaaggaagatttgtgacaagagggaggaaggggttctggttgaggcacttcaagttggggtttttcagaagctcttggttatgctgcaggttgggtgtgatgagagcaccaaggagaatgctacccggttgttgaaactgttgaatggttacaggaacaaagcggagtgcactgactcatcatcattggatttcaagcatcttaagaagccattctaatttgtgatgaatggcaactagattcatttattctttatttttattatttgtataggtcaatttattgatacaaaattctttgctgtaaaaagatacacacatcaattgattctttgaattcattttggataattgattcgatgtaattagttagactactaataagtaataaccatggttgtggcaaatagccaaatacagagaagcatctttttatatcattgtcttccatatggtgtatagtatttgttttccgattgattttgaagcaagttcaataaaccaacaagcacttgaataaaaaaaaccaaacgtacaaaaggacgtagtgatgagaaaaatcacatcattcaatgacactgctaaagccaatttaagcttgaagaaagaaga

SEQ ID NO: 4215 - DNA, 3149 bp, Unknown
  Kingdom: Plantae, Phylum: Streptophyta
tttattttaaatattataataaattaatataacaaaaaggtgatgcactatgaaattgctgttatgcttatgatcaacatagcgtggagaaaaaatgacattccagcgcatgcatcatggtagaattttaaaatggatgtttcttatggggcaatttttttagcgagtgaaatgaccgagtcagagtacgtagataattagacttggtcttgcctaggctggtcatagcaatagcaacgatagcgtcactgttgtgaaaccgcgtattgcctttatttattttttgcataagataaaacctcttcagtctcttctctaatgaatcagtagtcacaccatgaaattattgaatcctttcattcattcccaattccatggcaccttttctcattaatcacctctttgttttccttttttgtcttcgagccataaacacactttccaccactgtttccatctctgaaacttccaattccaaccaaacacttatctgtgtcctgcaacatccaaaccaacaaggacaatcaaatctcaactgtaccagcttccctcaggctcaggctattacacttgatgtcaatcccaatgtttcttactctcagattgtgggcggcaacgggttcgtgtgtgctttaggaccgttgtcttcttccatctccgtcatgggctgttggagattctctgccaatgctacatacaatgttccgtacaaacgcatctaccgtggacccatcgtggaagatatcgacagtggcaactctcacgtttgcggtcttgtaagaaaaggaaataagaacaatagccttgagctggagtgttggcaatggcatgggttcaattcaagcatgtccatgcccatgtcaagcgttgcagttggagagaatttcgtgtgtggcttatcagagagaggggacgttaattgcagggaaagaggaaggggtaatgggagtagggtaagagttgtggttgatgcccctgcgcctggtgggaattacagttatatcgcagctgggtttaggcatgcctgtgtcatatctggtgatggtagcttgcattgttggggagacatggaggagggtcagaaaccaccgcaagctgggagcttcatttctctggcgttgggagagaagcgaagctgtgcacttggggacgacagaagagttgtgtgttgggggtccaataatttcagcatgccacgcagattgcaagacacttacttcgaatcaattgtggcaaagcgaaccgttttctgcggagtcttgtcttctgactattccttgctctgttggggttccaaaatatttgagtcaaacaacaaggtgtttgacgacgtcctcccaggaccttgtcggaacgagtgcccgtgtgggccccagtcaaattcagccaaactatgtaactctcctggaggagtcatttgtcaaccctgttcccccagagtggttcaatctccctcgcctccatcgaaccaaagtggtggttggagcagccaaatggtggcgtttctggtggttggttgtgtgggatgcagttctctattgctagtcacggccttcttccttaacaggtactgcaactccaaacgcagaggaagccgcgtccatgactctggccgcttggatgacgatccacaggcacaggatggatctcgtgttcttcagaagcgcttgagccacgccataagcatgggaaatgggagccctttggaggagttctccctggagacactgcttcaagtcaccaacaatttctgtgaggacaagagaattgggcttggtagcttcggtgcagtgtaccattccaccctggaggacggcaaggaggttgctataaaaagagccgaagcctcatcctcaacctacacagttttgggtgggcaagggcaagtggacaaagacaatgcctttgtgaacgagctggaatcactctcaagactccaccacaagaacctggtccggttgttggggttctatgaagacagcaaagaacgcattttggtgtacgattacatggacaatgggagcctgagtgatcatctccacaagctccaaagttcagctctcatgtcatgggcagtgagaatcaaggtggctctagatgctgcaaggggcatagagtacttgcaccaatacgccactccaccaatcattcaccgtgacattaagtctgccaacatattattggatgccaagtggacagcaaaagtgtctgattttggactctctctcatgggccctgaccctgaagatgaggatgcccacctttcacttctggccgctggcactgttggctacatggaccctgaatactataggcttcaacatttgacccccaagagtgacgtctacagctttggggtggttttgcttgagttgctctccggctacaaggccatccataaaaacgagaatggggtgccacgaaatgttgttgattttgtggtgccattcattttccaagatgagattcacagagtgttggacagaagagtggccccacccacgccctttgagatagaggcagtggcctacgtcggttatttggctgctgattgtgttaggcttgaaggtcgagatagaccaactatgtctcaagttgtaaataacttggaaagagcattggctgcatgtttagccaagccaatactctctaggtccaccaccgattctatttcttcacaatagctcatctttcgctcccttgaatggattctcaaaagaaattgtcaacttttgtacatttctccaccttttttttttaaaaaaaaaaaatctaatttcgacgtcaccagacgagtcaattatactaacccggtccaatttttgttttattttgtaatggatgactccaataagtgtattatcataaatttgattcttgcaccaaccagcaaggaaaaaaaaatatacaccatgttgaatcagtgcattttaagcaaaaccaacacggttcacaactctccttttctttttctttttttaactactactcgccactaggtcaacgtttcttttctctcttcccgagacaaaaccaaatagacggaaatttttcaaataggagactagtagcatagtcttaagatctctaacaaatcaataaaatatatatgtgcttttcaacttcaatcttcacaaacccgtgtggcg

SEQ ID NO: 4216 - DNA, 3026 bp, Unknown
  Kingdom: Plantae, Phylum: Streptophyta
tcaagttgttatttttcataattcatgtccataagcagtactatagaatagtttgatttccaatttttatccaaaaatcccacctgtccttctatgttgccacaatatatctatatatatgtatttattccatctctttaatttgcttctttctccgtgtttgctctccactctccagttagattggaaccaccaatccaacttctcccataccatatcattataatcggttatccatattcaattatacactttcctttttttttttttctgtgaaagtttcattttgtcatttctgctcattaacaatatagctagtatagacactcaacgagaaaataacaagctataggccgccatgaaccctgatcttgagcatgctccgcaaattcccttgctgaatcctccaacaggggaaagtggaaggagaacgcaaaagggtacccttgttttcattgtcctgatgtcattgtttgcacttattatcgtaaaccttcagagccatgagcccagcttagaaaacaatatcacattaatacctaaagctagaggggttgctgagggtgtatcagccaagtcaaaccaatatctgtcacacaaagcttcatataactggacaaatgcaatgttatcttggcaaagaacagctttccattttcaacctcaaaggaactggatgaacgatcctaacggtccattgttttacatggggtggtaccatgtattttaccaatacaatccggattcagccgtgtggggcaacataacatggggccacgctgtatccagagacttgattcactggctctaccttcccattgccttgtttccagataagtggtttgacgtcaacggtgtatggtcaggttcagcaacccttttgccagatggcaaaatcctaatgctctacacgggtagcaccgatcaaaacgtgcaagtccaaaatcttgcctaccccgccaacctatctgatcccctcctccttgattgggtcaaatatgctgataaccctgtcttggcccctccaccaggcattgggccaaaggattttcgtgacccaaccactgcatggtttgggccagatgaaaagtggaggatcaccattggctcaaagctcaacgggacaggtctttcattggtttataaaacccaagatttcatccactacgagcaaaatgatcactatttgcaccaagtcccgggaacgggtatgtgggagtgcgtggacttttacccggtttcagtaaacgggcctaacgatgtgaaacatgtgttgaaggctagtttggatgacaccaaggtggatcattatgcaattgggacatacttcattgaaaatgatacatgggtgcccgataacccgcatgaggatgtgggtatcgggttcaaattggactatggcagatactatgcgtcaaagacattctatgaccaacacaaaaacagaaggatcctgtggggttggattaatgaatcagatagtgaaaccgctgacttgaaaaagggttgggcatctctccagactattccaagaacagtagtgtttgacaagaagactagaactaatttggttcactggccagtggaagaagtagaaagcttaagacttggcagttccgaatttgaaggagttgtggttaaacctggctcagttgtgccactggacataggcccagccacacagttggacgtatttgctgaatttgaaatcgaatttttagcatccaaagggagtggcaaggacaatataggatgtggaaatggagctgttgatagaagtgctttgggaccattcggtattctggctattgcagatgaccatctttctgaactaacaccaatttatttccatctttctagtactactaaagatggcagttcaaccacttccttctgtgttgatgaaactaggtcatcaaaggctcctgatgtttcaaagctcgtttttggaagcaaagttcctgttctcagtgatgaaaaattatcaatgagggtattggtggaccattcaatcattgagagctttgctcagggagggagaacagtgatctcatctagagtttatccaacagaagcaatatatggagctgcaagattgtttctgttcaacaacgcaacggacataaacatcaaggtctcgctcaagatttggcaattgaactcagctttcatacgcccctttccctttgaccagaagttgtgaaagtcaaagctatggatgcacatttgcattttattattttgcaaacggttatcattattgccccagcgaagtaaggaaaacaaaacaaatcaaaacaacaaagtcttgtggcatcaacatgtataaattacagctttgtaggcataccgatgccatggatatccatattatttggaatttgtcaagagtaattaaagtctaccactagagtaattatatacggagacccttctattgtatttttttttctttttcttcctatcattttatagtacatatcattcttacacttctctctcattctttgaaatggcatatgggtgtcattgtgtccatgtatcattgtttttcctgttattgatgcaattcctagattcatatttatccatttgctactattatggtatttctaatcagcatatatttattcttgaatataaacactgtcctgacaattgtttctccagcgtcaagttaatttatcgtgctttaacttgatactttttgtttataaagtgacaagcaagagccaatggccaatggcaatgaataagaattattaaaaaataattttggtcaattacattatacttaatggcactcagctttctttggaagaattccttgctcaattttaatttaagctatgctataccccccaattctattattcactttgaattattggacccaattgtgatacaagaaaattcggatgttgactatatattgatattaatatgatatgattcctcgttctgtagttcagtgcagagtgcatcatgattaatgtgaccaggaaaacagataatcagcctatcag

SEQ ID NO: 4217 - DNA, 3539 bp, Unknown
  Kingdom: Plantae, Phylum: Streptophyta
aaagtgcttacattgatctttgtgatatataggtttctctacactaaatattagttacttgtaaaagcaactcaaaagaaaaagcgtaggaaagtgcatatattttttattctattttattgcatttccatctaacaacggcgaaagaaaccggaaggtgcaatgcaatcaaactatatgcaactaaatgttgtaccattataaggaaatgaggaggaaggtgcaattatgcattaaacgcgaaggttcagttgaactttgtgcatggttgacgcagagtcaatgaaaaaaaaaaaaggaatcttgaccccaagtcttggtaaaaaaattattgtaactagtttgcatactatataattccgattggttagtatgtgcattcaaggtccaaagcaagcaatctagtgcgttactaaatccgttgttcctctcttacacacacatccctgctgtaatggcggacagcgtggtttcctttgttttagatcacttgtcccagctattggcacgtgaagctaagttgttgtgtggcgtggaagacaggatcttgtccctccaaaatgagctcgaaatgatcaacgagttcctcaacacctcaaagagcaagaaggggatcgaaaaaatagtggtgagccaaatcagagatgtggcccacttagctgaggatgtcatcgacacattccttgccaaagttgttgtgcacaagaggagaagcatgttgggaaggatgctccatggcgtggaccatgcaaagttgctccacgatctatccgagaaaatagacaagatcaaaatcaccctgaacgagatacgcgacaacaagatcaaatacgtcgagttccaagaaagcaacaatcaatccacaataaaagaggaggaaaaggcggagtcattgcacgagcgtagaagaaatgttgaggtagagaatgtagtgggttttgtccatgactccaaagtagtcatcaagcagcttgtggaaggaggttcattgcgtaacgccgtctccatcattggcatgggtggattgggcaagaccactcttgctcgaaaggtctataacagcagtcaggtaaaacaatactttgggtgccgcgcttgggtttacgtctcaaatgagtgcagagttagggagcttttgcttggtcttcttgagcagttgatgccaaaccctgaatacgaatatgcaggcaaaaagaaaggcaagaaacacactcaagacgtttctaacttgagcgaggaagagctgaagaaattggtgtggaaacgcttagagaggaaaaggtatctggtggtcctagatgacatgtggaaaagacgagattgggatgaggtgcaagatgcttttccagacaacaacgaaggcagcagaatattgatcactagtcgtttgaaagagttggcctcacatactagccatcatcctccttactatcttaaattcctcaacgaagaagaaagttgggagctcttttgcaggaaagtgtttagaggtgaagaatacccttttgatttggagcctctgggcaaacaaatagttcaaagctgtcgcggtttgcccctctcaatcattgtcttggcagggctgctagccaacaaggaaaagtcatacaaagaatggtctaaagtggttggtcatgtcaattggtatcttacccaagatgagacccaagtaaaggatatagttctcaaactcagttacaacaacttgccaaggagattgaaaccatgctttctgtaccttgggatattccctgaagactttgaaatcccagttaggccattattgcaacgttgggttgccgaaggatttatacaagaaacagggaatagagacccagatgatgtggcagaagactacttgtacgagctcattgatcgtagtttagtccaagtagcaagagtgaaggctagtggaggtgtcaaaatgtgtcgcatacatgatcttctccgagatctttgtatatcagagagcaaagaggacaaagtgtttgaagtttgcacagataacaacattctaatctcaacaaaacctcgtagactgtccatccattgtaacatgggtcactacgtttcttcaagcaacaacgaccattcatgtgcccgttctttgttcatagttggctcaggtaactttttcagtccaagtgaattgaaattgcttttaaaaggtttcaaattggttcgggtgttagacattggaacagaccgtcttgtacgaaagatccctttcaatttagggaactttatccacttaaggtacttgagaatggacacctggggtgttaaatttattccagcttctatacttacccttgaaaatctacaaatcatagacttaggtcattttcgggtttttcatttcccaatttcgttctctgatccaatttctttccctgctggaatatggaaactcaatcatttaagacatttgtatgcatttggacctatcatgctacgaggccactgttcaggttcaaatgaggttatgttgaatcttcaaaccatctctgccattgtactcgatcgacaaacaatatctctgataaagaaaggaaggtttcccaatcttaaaaaattagggttgcaagtgtcttcaaggtgcaaagaccaagtacctgagttgttgcagagcctacaccaattatgtcatttgaagaacttacgcatttacctcgaaggtaagggtgcttcaggtaccccaaaccatgagagcatggaatggaacattggttgtaagccacaagaactattacaaagcctaggtcaattgagttgtctaactattttaagaattatgaatgtcttcgaccttctaacctgtggggttgtcacatttcctccaaatgttacaaaattaacgttggcaggtattaagtgcatcactgacgaggggatgaaagcgttgggaaatctcaccaaacttggaattttgaaacttctaggatcttcagatgattctttcgacctaaattgcgttgaaggtgggttcccacaattgcaagtgcttgagatgagttttttgggagttggaaattggaaattaggcaatggtacaatgttacgccttcaaagtttggaaatcaactactgtgaagggttaaatgatctcccaaatgaactgtggtcgttgactgacttaagagaagtgcgagtacggcgaccctcggaaccaatggctcacatgctaaggaatttgaaaataaagaatgcggttgaactcgtaatcggggacattagaacttgagtttgttgactcaatgtatggattacaaaggtttttgtgtgtgtttgattgcaaacaagtccatagttatgttgggtttgattagttttcttcaagattttagaataatgaagtttaacgagttgacaaactcgtccaagcatgtatatcaaaaagttgatgaatttaattatgaaaaacctttgttagtttttggatgtaagagttagactatctgaccttttctatttgtttaacaccactttaaaattaaagttaattaaaaagattaaaaataaagtaaaaaaatttgatg

SEQ ID NO: 4218 - DNA, 2377 bp, Unknown
  Kingdom: Plantae, Phylum: Streptophyta
atttctgacatgttatatatgttccattccatcaagtgggttccaattgggatgtggtggggcatattagcctaagaagcacaaagaactgtggacgtgttcaaacttaagctaaacatcaacatgatggtacgtgattggtgtaaggtttgagtcctgagtatatagatatatagagacaacaaatatttaaagtaattaagcacatgcatgggatagttttggagtataaaatgagtgtgatggcacatagtgttgacacagaaaatggactcgaacggctacttggtagttggagtggtagcttttgctctactttgctcattcagagtttctttgacagattcagttccattattttcgcctgttcatgacgctgcttctttgactcgcaactctttccctgctggcttcatctttggggctggatcctcagcctaccagttcgaaggagcagcaaaggaaggtggaagaggaccaagcatatgggataccttcacacataaccatccagaaaagataagagatggagccaatggagatgtcgccgttgaccaatatcaccgctacaaggaagatgttaagatcatgaaggatatgaatttggattcatacagattctcaatctcttggcctagaatactacccaaaggaaagctcagtggtggtgtaaatcaagaaggaatcaattattacaacaacctcatcaatgagctattggctaatggtgtactgccatatgtgactctttttcattgggatcttccccaagctttggaagatgagtatggtggtttcttaagctcccatatagtagatgattttcaagactatgcggatctttgctttaaggaatttggagatagggtgaagttttggactactttgaatgaaccatggttgttcagccagggtggctatgcaaccggagcgacggcaccaggaagatgtaccggtccacaatgcctcggtggtgatgctggcactgaaccttacatagttacacacaatcaaattcttgctcatgcagctgctgttcatgtgtacaagactaagtatcaggcacatcagaaaggcaagataggtataacgttggtaagtaactggttcataccgcttgcagagaatagcacatcagacataaaggctgcgagaagggcaattgactttcaatatggatggtatatggaaccattaacaaaaggagagtatcctaaaaacatgcgagccctggtgggaagtagattgcctaagttcaccaaatggcaagccaagctagtgaatggatcatttgattttattggcttaaactattactcctctggttatattaatggtgtccctccaagcaacgacaaacccaattttctaacagattctcgcaccaacacttcatttgaacgcaatggaagacccctaggtctaagggccgcttcagtttggatatacttttatccaaggggacttctagatcttctgttatataccaaggaaaaatacaataaccctttgatttacatcaccgaaaatggtaaatacgctaattcattatgttcccccgccccccttggatcttatattgagatttaaatctagataaaatatatgagaatatatattgaacaattgattatatattatataaatgcatggttatatttaatttctctttttctaatctttttaaaagactatgtatgatattttgtattacatttgtatactttatttaacttgcaggtatgaacgaattcaatgatccaaccctttccgtggaagaagctctcatggatatttatcgaattgattattattatcgtcatttcttttatcttcgatcagcaattaaggctggcgcaaacgttaagggattttttgcatggtcatttttggactgtaatgaatggtttgcagggttcactgttcggtttggattaaactttgtagattacaaagatggcttaaaaaggtaccctaagctttctgctcaatggtacaagaactttctgaaaagaaactagtgttagacccaccgtttgaaagctatgcagcacctaaaaacggttaggttaagctcaatgtttgtagttgtagctaattccacgtataagtcattaggttgttgttttctgttagaataatttcatggcacactactaagtgtcctgcaccagcacagctataaattaatatgttatagctgatccttcatgtatcggtttgattttgaatgttatctcagaattaagattcagtttcagtttcaacaattataatcttcgcgtgatgattcaaaataaacaatgatgtatatattcaatcgtaattggtcaactggtcacggtagaaataaattgtgatcagtagaaataatata

SEQ ID NO: 4219 - DNA, 1953 bp, Unknown
  Kingdom: Plantae, Phylum: Streptophyta
ctatataaagaagccggaaagcatttgcagagacaatacatcaaacgactaagaaaaatatatacataacaagatatggcattcaacggttatttccttttgggcctcatagttcttgttcttgttaggtcttccaaagttacatgcgaattagaaacagatacagtttcacctattattgacatttcactgagtcggaagagtttcccagaagggttcatctttggggcgggatcttcctcgtaccagttcgaaggtgcagcaaaggaaggtggtagagaaccaagtgtatgggataccttcacccataattatccagaaaagatcatggatagaagcaacggagacgtggccattgactcatatcaccactacaaggaagatgttggaatgatgaaggatatgaatttggattcatatagattttccatttcttggtcaaggattctcccaaaaggaaaactaagtggaggtataaatcgagaaggaataaactattacaacaatcttatcaatgagctagtggctaatggtatacaaccacttgtgactctatttcattgggatcttccccaagccttagaagatgagtatggcggattcttaagtccacgcatagtgaaagattttcgggactatgcggaactttgcttcaaggaatttggtgatagggtgaagcattgggttactttgaatgagccatggagttacagccaaaatggctatgcaaatggacgaatggcaccaggacgttgttctgcttggatgaatttgaactgtactggtggtgattcttcaacggagccttatttggttacacaccatcaacttcttgctcatgcagcagttgttcgtgtgtacaagaccaagtatcaggcctttcaaaaaggtgtgataggcataaccttggtagctaattggtttttgccgctcagagataccaaatctgatcaaaaggctacagaaagagcaattgacttcatgtatggatggtttatggatccattaacatccggagactatccaaaaagcatgcgatctcttgtgagaacaagattgccaaagtttacaacagagcaatccaaactacttatcggttcatttgattttattggcttaaactattactctacaacatatgcctctgattcacctcagctaagcaatgccagacctagctacttgacagattctcttgtcactcctgcatatgaacgtgatgggaaacctataggaataaagattgcttctgattggttgtatgtttatccaagaggaattcgtgaccttttattatataccaaggaaaagtacaacaatcctttgatttacatcactgaaaatggtataaatgagtataatgaaccaacattatcacttgaagaatctcttatggataccttcagaattgattatcattatcgtcatctcttttatcttcaatctgcaattaagaatggcgtaaatgtgaagggatattatgtgtggtctttgttcgacaattttgagtggtcttcaggctatacatcacgttttggaatgatttttgtggattacaaaaataatttgaagagatatgagaagctctctgcacagtggttcaaaaattttctcaagaaagaaacaagactttatagctctactaaataatattatgaaattcttttatccaatggttatattttgtaaataattatttgatttttttatattcttttattctaaagaggccctattagacttagagggtaaatagttattttattattcttttattctaaagaggtcccattggacttagaggtgaaacaaagatgtagatcgatctgttgacaattgctactactttggtaataagaatgaaaaagtcttttagttgcgatgaagatgtcatttacaattgtgcaacttaattcaaattatcaatggaatgttttcacctttgattttatt

SEQ ID NO: 4220 - DNA, 1845 bp, Unknown
  Kingdom: Plantae, Phylum: Streptophyta
atgccgagaaaaggaatgagaagcattttcttcaaaccatcaacttccacctcatcgctaccaccacctccttcccctcaacgcactttctcagactccttaatggacgaaaacatagaaaccgcagagaagctaataaccaaatgggacgattccaaagtcccgacgacaaccgcgcttttcagcggcacccgccaggaagccaaacaatacctaaacgcggtgaagggactacagtccgctatgcagtacctcgtcgcacaggattccacctccagcaccctcgtgcgcgcgcagctcctcatgcaactcgccatgaagacgctccagaaagagttctaccagattctatcctccaacagggaacacttggaccccgaaaccgtcaccacgcgctcctccgtcgacctccgcagcgtctccgattacgtctccgattacgacgacgaaatctcaatcaccgaggacgagttccgcgtctccgagaccgagcgagtttccatgctcgccatggaggatttgaaagccatagccgaatccatgatttcctccggctacggcaaggagtgcgtcaaggtttacatcatcatgagaaaatcgatcgtcgacgaagcgctgtaccatctcggagtggaaaaattgagcctctctcaggttcagaaactggattgggaggttctcgagttgaagatcaagagctggttacaggtagttaaagtcgccgtcggaactctgttccacggcgaaaggatcctctgcgatcacgtcttcgcctcggattcggggaagagaatcgcggaatcatgtttcgcggaaataaccaaagatggcgccgtatcgctgtttggattcccggaaatggtggcgaaatgcaagaaaacgccggagaaaatgttcaggattttggatttgtatgaagcgatctccgattacttgcctcagatcgaatccatattctccttcgagtcaacgtctaacattcgctcacaggccgttacgtcgatggtgaaactcggcgacgccgttagaacgatgctaacggacttggaaaccgcgattcagaaggagtcctcgaagaaaccagtccctggcggtggagtccaccctctcacgcgctacgtgatgaactacctcactttcctcgccgattacagcggcgtgctggtcgatataatcgccgatttgccgcaatccccgttgccggagtcttactaccgcagcccgatgcgcgaggaaaacccgccggcttcggagctatcggagcgaatcgcgtggatcatactcgtggtgctctgcaagctcgacggcaaagcggaactctacaaggacgtggcgcattcttacctgttcctcgcgaataacatgcaatacgtcgtcgtaaaggtgcgcaagtcgaacctagggtttcttctcggcgaggagtggttggacaagcataagttgaaggttagagagtacgcgtccaagtacgagcgagtcgggtggagcgcggtgttttctgcgttgccggaaaatcccgcggcggagttgacggcggagcaggccagggcgtgcttcgtgaggttcgacgctgcgtttcatgaagcgtgtagaaaacaggcctcgtggttcgtatccgacccgaaatttcgtgatgaaatcaaagggtcgatagcttcgaagctggtgcaaaagtacagcgagttctacgagaagaatcgggtcgggtcggaatccgttaggggttttttacccgacgatatagggaaatacctgtctaacattttgtgtaatggagattcgggcagtgtctcgtcacactcttcgtcaacgacgtcgtcttcccatcgctctaatcgacggtga

SEQ ID NO: 4221 - DNA, 1992 bp, Unknown
  Kingdom: Plantae, Phylum: Streptophyta
gccctattcacccctacactgaacttgaccagtttccacgcaacatcttataattcttctcccactcctcatatataaacctctcccatcctcacctctttcccacactcatatccaaaaccgaatccacttctctaactaatgggcgtgttcagcgaagatccgaatcccaacccgaacccgatcgtgatccgagaggtttgggcctccaatctcgaatccgaattcgaactcatccgcgaactcatcgatcgctacccttttatctcaatggacacagaatttcccggtgttattttccgaccacatgtggaccccaccaaacccttcaaccaccgcaaccgtccctccgaccactaccgcctcctcaagtccaacgttgacgctctcaacctcatccaggtcggcctcaccctcaccgacgccgccggcaacctccccgacctcgccggaaaccgctccatctgggaattcaacttccgtgacttcgacgtggcgcgtgacgcctacgctcccgactccatcgatcttctccgtcgtcagggcatcgatttcgcgcgtaacaccgccgacggcgtggattccacgtgcttcgcggagctgatgatgtcttcggggctcgtgtgcaacgacgccgtgagttgggtcacgttccacagcgcgtacgatttcggttacttggtgaagatcttgacgcgccgtaacctaccgacgaggttggaggaattcttgaaaaccgtgaaggtgttcttcggagataacgtttacgacgtgaagcacatgatgaggttctgtgacacgctctacggcggattggaccgcgttgcacggacgcttaacgtggaccgcgccgtagggaagtgccaccaggccgggtcagacagcttgctgacgtggcacgccttccagaagattgttgacatttattttgtaaaggaagagcaccgaaaacatgccggtgtattgtttggactataggcattctgttaattataataacataaaaataataaaaattcaattgattgattatttatttgttggattatcttatttttgttttattttatgttgatgtgatttctccttttggtaggagattgcgcgaatcaagggcaaaattactagtttacatatgcatacaatagccggagattcaattgtgagttggtgtttgcctgtgtagagttcaaagaatctaaaggggggaattgaatcatagtttcccattcaggccatgacttttgatactattatcgatggctccagttttggttggtcagactgattaggtgtcagtgattatgagaggggtgctttaggagttaaaaagctttgatcaaattctggcttcttagtatgaaaaacatattcagctaactttaagagatgccttacacttgcagtatttaaaatgcactattagttttgaattctgtatcagcacttttagttatatactagtaggtgttattaattgatgcaagtgcaatgttagtctcatgaaataaggaattgtgtttgaaattgtattggaatttggaagcagtcttcaatactaacagaaaggtgacttatgactattgttgcatattgcataattagttttgaagttgctgcttacctgcagcaaacatttagaagaagtgaataaacgtctaatctgcatttgactgatctgaagacttttattttatctcaattgtctgcttaggataaaatgcaggctgaaactccagctttgcagaaatgcatagtatgtttgattggcatattgggatttttttgtttgtttgacttacaacttgtctttatggttatatttgtcttttactcaggttttggtatcgtaggcttgaaagctagttgtgtttttttatatcagttattacatgttagataaaattacaaaatgaaggatctatgattgatataccgttattccttgtatgtgtggagaggataaaataatctgtagcattttaatgacaa

SEQ ID NO: 4222 - DNA, 1145 bp, Unknown
  Kingdom: Plantae, Phylum: Streptophyta
cctacacacacatttatagagcaaaacacaacttggaaattgcaacccaccaaacctaaatcaaaagccgtgtctgtgtttgcgtttgttttcactttgcaaatcactgtgttccaaggagtctgttggttgattgaagggtatgcgtgaattattataaactttccggtgtttgagttcaattttgtgtccgtgtgcgtgaatctccattttttacagccatgagcacgcttgtacgaaacgccaccctcaccttcagccgcagaaacagatacgagcttcttggtctgcaaggcaaagacaagatggtcaagtccatcagctacagacgcagaagggcaaagcaaagacaaatctttctcacaacctacaaactatcttctttgaacagcaatacttttgttgagccacaaaagcctaagctgaagctgaagaaggttgctgttaaggtcaagaagattgtcacctcggttttgatgttcatgcgagttggttctttcaggtcctgcggttctaggtctcagatttcttccacctcaccaaataggaagaacttttgaggatgttgttctgtcatgggtttaggatgatttatttataattccaaccttgcctatgctcttcttctcaatctttggttctttcactctaggatttaattaagaagattaataagcaaggggttttagtgtgtgtttgtgatagcgtaaaggcgatgcaatggagaagcaaccccagtttggcgttttcgtattggaacgcaaaatttctccgttcaacgtggtttcaaagtgttttcaaacacattcttactagtatatttacatggttgatgatgaaggatggtaaaggggtatcaaatattctgtatataaagcttaatctaatgtctacttgactacttttaccacttaattgctaggatttttcttttagctaaataatttgccctgtttcaactttctttttattcgtgactgtctcaagtttcatttgatttcactgagtatatttatccttctattcaattattcaccttttagcgttgatatcaaagcttttgatgtcagaaatgaaaataggctcttcgccgaaatttccggttgttatgaacgccgataatgcaaatggggttatatatacga

SEQ ID NO: 4223 - DNA, 1982 bp, Unknown
  Kingdom: Plantae, Phylum: Streptophyta
tagtaggtattccaatccttcctatataaagaggaaaacattatttgcagagataagaacatgaaacaaacgactaagcaagatatatcacaagatatggcattcagcggttatttccttttgggcctcatagctcttgttattgttaggtcttccaaagttacatgcgaagaattagcagttaatacagtttcacctattattgacatttcactcagtcggaacagtttcccagaagggttcatctttggggcgggatcttcctcgtaccagttcgaaggtgcagcaaaggaaggtggtagagaaccaagtgtatgggataccttcacccataattatccaggtaagatcatggatagaagcaacggagacgtcgccattgactcatatcaccactacaaggaagatgttgggatgatgaaggatatgaatttggattcatatagattttccatatcatggtcaaggattctccctaaaggaaagctaagtggaggtataaatcaagaaggaatcaactattacaacaaccttatcaatgagctagtagctaatggtatacaaccacttgtgactctttttcattgggatcttccccaagcattagaagatgagtatggtggctttttaagtccgcgcatagtgaaagatttccgagactatgcggaactttgcttcagggaatttggtgatagggtaaagtattgggttacattgaatgagccatggagttacagccaaaatggctatgcaaatgggcgaatggcacctggtcgttgttctgcttggatgaatctgaattgcactggaggtgattcttcaacggagccttatttggttacacatcaccaacttcttgctcatgcaacagctgttcgtgtgtacaagaccaagtatcaggcatctcaaagtggtgtgataggcataaccttggtagctaattggtttttgccgctcagagataccaaatctgatcaaaaggctacagaaagagcaattgacttcatgtatggatggttcgtggatccattaacctctggagactatccaaaaagcatgagatcacttgtgcggacacgattaccaaagtttactgcagagcaatccaaactacttattggttcatttgattttattggcctaaactattactctacaacatatgcctctgatgcacctcatctaagtaacgcccgacctagctacttaacagattctcttgtcactcctgcatatgaacgtgatgggaaacctattggaataaagattgcctctgattggttatatgtttatccaagaggaattcgagatcttttattatataccaaggaaaagtacaacaatcctttgatttacatcactgaaaatggtataaatgagtataatgaaccaatattatcacttgaagagtctcttatggatatattcagaattgattatcattatcgtcatctcttttatcttcgatcagcaattagggatggtgcaaatgtgaaaggatattatgtatggtctttgttcgacaattttgagtggtcttcaggctatacatcacgtttcgggatgatcttcgtggattataaaaataatttgaagagataccaaaaactctctgcacaatggttcaagaattttctcaggaaagaaaccaggctttatagctcttgtaaataatattaagaaatttgttttccaaataatgattgtatttgtaaataattatttgatattcttttattctatagaggtcctattggacttagagagtaaatagctatagagttatttgattattcttttgtcttaaagaggtcctattggacttgtaagaggggaaatagaaattatttaattattcttttattcttaagaggtcccatgggactttagagggaaaatgaagatgtagatctgttgataatagcaactattgttataataagaatgaaacaaacttttttcttgtgataaagatgtcattt

SEQ ID NO: 4224 - DNA, 1602 bp, Unknown
  Kingdom: Plantae, Phylum: Streptophyta
tgtggattgtggaacaatatatatatatatatagagagagagagagagagagagaaagatagagagaatgcagttatcaattgcatgcagtcatcatgtacatggacttgccccagtgcattcacacaccaaccttgcccaaacaaccattccactcaaacgtgccttctctgttttgactcaaaccaaatcaaattctaggatcacactcacatgcaattcccaacctcaaccactgctaaacctttgcacaccaaaaccaccaacaagaatcttcagttccaacgttcggtgtggcatttcttccaacatgtatggtggaaacgaggttaggagtgtccgagagtggcttgtgctggctggtgagtttctctcaatggcatttccattgtgggtctcaattgggtgcgtattggggttgatgaaaccaaattgcttcaattgggtcactccaaaagtgacaattaggggcctcaacatcatcatgcttggaatgggtatgaccttaactcttgatgatcttcgtggggctcttgccatgcctaagcaagttctctatggttttgtacttcagtattcggtgatgccactgtctggatttctcataagcacactcttaaatcttgcaccacattttgcagcaggtttaatattaattgggtgcagtccaggaggcacagctagtaacattataacatatctttcacgtggaaatgtggcgctatctgtaataatgacaactgcaagtaccctaactgccacgatcatgactccttttctgacagcaacacttgctggtaaatatgtagcagtggacgcgtctggcttattgatttcaacactgcaagttgtgctttttcctgtgttggctggtgcatttctgaaccagtttttcaaaccttttgttaaacttgtctctccattgatgccacccattgcagtaacaactgtggcaattttgtgtggaaactctattgcccagagttcttcagcaatccttgtgtgtggtggacaagtgattttagctacctttcttctccatgcttctgggtttttctttggttacatatttggaagattgcttgggttagatgtgtcatcatcgcgaaccatatccactcaggttggcatgaagaactcagttctcgggattgttctggctacaaagcactttggagatcccctaactgccgtacctggtgctgtttcaattgtgtttcagtcaattattggtagtatccttgcaggaatatggagagattctatgcctgtgtttaattaaagagtgaaaatatctataatctacctggattagcttttgctaataattaaccagaaaggaaaatgatgggcagaaattagccatatatatgccacttagacatttatatatcgaaataaagagagaagtataaccatgagggatgatatgatgcgataaaaaaatagagatattaattatcagtgttatcaagtgtttgtagtagcggagatattcactatcattattcaaccagaaaatgtatcgtgatattttgtaatttataatttatatattattatcaataatattacatctggttgcgattatttacatcagac

SEQ ID NO: 4225 - DNA, 2070 bp, Unknown
  Kingdom: Plantae, Phylum: Streptophyta
atgctccaagagaattccatattgatcacactgttacaaatgctacttcttatcagaaatggcaacggtcagaacgagtgcaagaaattgtcttgtgggcctggccaaccccttattagatttcccttccaactggtgaaggggatcaaagatgaatgtgctaatcccgggttttgtttatattgtactgataaaaaggaaaccatggttgtgctctctacaatagaattccgtgtctacaccatacactacgaatctaacttctttatgttgacggacccggaaaattgccttccgaacaagtttctacaaatcgacaatttttttctacagcataaccaacttgaattaggattatttggagatgaaagaacaaacaacttgagcttctttaactgttcttcagttgggcttagacacctcagaaaacaggtttatggttctgacttttctaatcaacaagatatgatctcctgtccgattttcgtttctgaatcttacgacagcgtcctcggtttggatctaacatcctgtaccaagatgttcgacaccacttcgccagttacggcatacgacctgcagttgaatattttgattatgagatggtccataccaaattgtacaaagtgcgaagcaaaaggcaagagatgtaaatggaagaacaacagcaacacagaagcagacattgaatgtgttgactgcaaacggaaaagaatccatgttccccaatcttttatcttcgctactacaggatcaattcttttggggctggtggccattgttatctttaagatagcactctattttagacagaaagaagaagaccaagcaagagtggccaagtttttagaggattacagggcagaaaagcctgcaagatttacctatgctgatttgaaaagaatcaccggtggctttaaagaaaagttaggggaaggagctcacggggctgtattcagaggaaaactttcaaatgagattctagtggctgtgaagatcctcaataatacagagggagaagggaaggagttcattaatgaagtgggaatcatgggaaaaattcatcacatcaacgtggttcgtttgcttggcttctgtgcagaaggatttcatcgtgctcttgtctacaatttgtttccaaacggatccttacaacgatttatagttccaccggacgacaaggaccatttccttggctgggagaagctgcaacagattgctcttggtatagctaaaggaattgagtatcttcatgaaggttgtaatcaacccattattcattttgacatcaatcctcacaatgttctacttgatgacaacttcactccaaaaatttctgattttggcttagccaaattgtgttccaagaatcctagtttggtgtccatgacagctgcaagaggaaccttgggatacattgcacctgaagttttctccaaaaactttgggaatgtgtcttataagtctgatatttacagttatggaatgttattgttagaaatggttggaggaagaaagaatgtagccatgtcttctgctcaagatttccatgttttgtatccagattggatccataacctgattgatggagatgtacatatccatgttgaggatgaatgtgatattaaaattgcaaagaaattagcaattgttggactttggtgcattcagtggcagccagtgaatcgtccatctataaaatctgtcatacaaatgctagagactggaggggaaagccagttaaatgtgcctcctaatccattccaatcaaccacttcaactattacaggtggacacactagagttacaagacgacctttggagttagaagttattcaagaatgatttctagtgggagaaaattaatagtttaatttgtagaaaagtaatagatgtatgtattttatgtaatatcattaaatccaaccatagtgtttaagggtactttttctactaagaaggaaagttttggtgtgtttgaattaactatatgaaaataaattaaactattcaacaattattattttaattgatggtacaaatttttttaatatttggatatgtttggtg

SEQ ID NO: 4226 - DNA, 2319 bp, Unknown
  Kingdom: Plantae, Phylum: Streptophyta
taaaaaattgtgtgaaaaaacagggactttgactgagaaaccgagtttttctccctttctatctggtttccgcacctgattgaaaaataaaaaaatataaattaaaactgtaagcatgaactaaaagagacaccgaagtgtagtttgttaaaatcacaattctttcctcaacaaaagaaaataatgctccaagggaattccatattgatcacactgttactaatgctacttcttatcagaaatggcaacggtcagaacaagggcaataaggaattgtcttgtggacctggcgaaccccttattagatttcccttccaactggtgaaggggatcaaagatgaatgtgctaatcccgggttttgtttatattgtactaaaaaaaatgaaaccatggttgtgctctctacaatagaattccgtgtctattccatagactacgaatttaacttctttaggttgaaggacccggaaaattgccttccgaacaagtttctacaaatcaacaatttttttcttcagcataaccaacttgaactaggatttcctggacatgaaggaacaaacaacttgagcttctttaactgttcttcagttgggtatacatacctcagaagatttgtttatggtccttactgtttggattttagtcaacaagatatgatctcctgtccgatttacgtttctagttcttacgacagcgtcctcgatttggatctaacatcctgtaccaggatgtttgacctcatttcgccagctgaggcagacgacctgcagtggaattctttgaatatgagatggtccataccaaattgtacaaagtgcgaagcaaaaggcaagagatgtaaatggaagaacaacagcaacacagaaggagacattgaatgttttggctacaaacggaaaagaatccatgttccccaatcttttattttcgctactacaggctcaatttttttggggctggtggtcattgttgtctttaagatagcactctattttagacagaaagaagacgaccaagcaagagtggccaagtttttagaggattacagggcagaaaagcctgcaagatttacctatgctgatttgaaaagaatcaccggtggctttaaagaaaagttaggggaaggagctcacggggctgtattcagaggaaaactttcaaatgagattctagtggctgtgaagatcctcaataatacagagggagaagggaaggagttcattaatgaagtgggaatcatgggaaaaattcatcacatcaacgtggttcgtttgcttggcttctgtgcagaaggatttcatcgtgctcttgtctacaatttgtttccaaacggatccttacaacgaattatagttccaccggacgacaaggaccatttccttggctgggagaagctgcaacagattgctcttggtatagctaaagggattgagtatcttcatcaaggttgtaatcaacccattattcattttgacatcaatcctcacaatgtgctacttgatgacaacttcactccaaaaatttctgattttggcttagccaaattgtgttccaagaatcctagtttggtgtccatgacagctgcaagaggaaccgtgggatacattgcacctgaagttttctccagaaactttgggaatgtgtcttataagtctgatatttacagttatggaatgttattgttagaaatggttggaggaagaaagaatgtagacatgtcttctgcccaagatttccatgttttgtatccggattggatccataacctgattgatggagatgtacatatccatgttgaggatgaagttgatattaaaattgcaaagaaattagcaattgttggactttggtgcattcagtggcagccagtgaatcgtccatctataaaatctgtcatacaaatgttagaaactggagaggaaaaccagttaaatgtgcctcctaatccattcaactcaaccacttcaactattactagtggacacactagagttacaagacgacctttggagttagaagttattcaagaatgatttctagtgggagaaaattaatagtttaatttgtagaaaagtagtagatgtatgtattttatgtaatatgattaaatccaacccctcgtgtttaagcgtactttttctactaagaaggaaagttttggtgtgtttgaattaactacgtgaaaggatgttaataatttggttatgtcatcattcaatattcattgggaacttaaaggatgataaattctctactgatataaacatctataatcttaactttcatttaatttgaggtggttaggttatgtgtcg

SEQ ID NO: 4227 - DNA, 1854 bp, Unknown
  Kingdom: Plantae, Phylum: Streptophyta
atggaaaacaacgtcacaatattactctttcttcccctcttcaccattctcacaaccgttgcagcttctaattcctcctcctcatcatgccccatcaacttcacctacgttgaaaccttcccatggaacacttcatcttgcacaaacccaatcaacaaacaaccttgttgcatagcattaaacaccatcttccacataggcctcacccaacacctcaaagaaacctcattgtttcaacttcccaatgaaaacacttcctcaacttgcttatcagatttccaaaccaagctaaaagccttgtcaatagacctttctttggtccctttttgcttccctaacccctcacaatttgttaccaactcttccacatgtgcaggtattataaccacacaagattgggaacaaaaagtggactcggttaggcttggtccattatactcttactgcaaagaaagccttgatgacgaaactcggtgtcaaaattgcattgcatcaagttttaaagtggcttttcagcttactagtactaaccaaaatgctagtgtcaaagaatgtttttcctttgcatcactatatgctgcagcagttgttaatccacaaggtgcaagtgatgcaaccacgattggttgcatattgagggtgccactgaatggtgaagtaacaacaaaagggtcatcaaagaagagaagaaaagttgtgaagctggtttttgcggtattgggtggcatggttggtgttgttgtcattgcttttgtggtgatggttgtgtacaggaagtgggataggagaaggaaggaaagggtttattatcatagggaaattgaaaacggtgtgaggaacagtgttttgcctaacactggtgcaaaatggtttcacatatcggagcttgaacgtgccactgatagattttcaaggaggaacatgcttggccaaggtggtgatggggttgtgtacaaagggaagctttcagatggcactttggttgcaattaaggagaattttaatttggagagtaaaggggatgaagagttctgctatgaagtggagatcataagcaagataaagcataggaaccttcttgctctcaagggttgttgcattgcaagtgatgatttgaaaggtaagaggaggtttttggtttatgatttcatgcctaatggaagcttatgttaccaattatctcttaatgtggccaataggttaacatggccacaaagaaagaacataatcattgatgtggcaaaagggcttgcttatttgcactatgaaatcaagcctcctatttatcatcgtgacattaaggctaccaacattcttttggactccaaaatgagtgctaaattatcagattttgggttggcaaaagaaggtagtgaggaggaacaatctcatgtaactacaaaagttgctggcacatatggttatgtggcaccagaatatgctctatatggacaactaactgagaaaagtgatgtgtatagttttggtattgtgattcttgaaatcatgagtggtagaaaagtgcttgataatttgaattcatcagcggatgccatcactgattgggtgtggacacttgtggaatcaggaaagatggtggaagtttttgatgagtcaataagagaagggccagaaaaagttatggaaaggtttgttcatgttggaatgctgtgtgctcatgctgtggtggctttaaggcctactattgctgaggctcttaagatgttagagggtgacactgatgttcccaaattaccagataggccggtgcctttgggtcatgcttcttttcaatcttctctgttgcatggtttgcaaggaagtggaagatctaaggcacatgtttcatcttaa

SEQ ID NO: 4228 - DNA, 531 bp, Unknown
  Kingdom: Plantae, Phylum: Streptophyta
atgaagagacagagagagaacgaagtaacaacgttggaaagctgggacatgcaaatttgttcaacttcaatcacacccgacacaagtgtttccagttccaccatatctccggaagatgtatttgagtgcaaaacgtgcaaccgcaagttcaactcttttcaagcgctgggtggccatagggcttgtcacaacaagagggtgaagatggaaggtgaagaacaacaactcaaaacaagggcaaaatatctgggtttgggaaaacacagtgagcccaaaatgcataattgctccatttgtggtcaaggtttctctctgggccaggccttgggaggacacatgagaagacacagagcttcgaccaacgatgttttctcttccataaaccaggttgttgcaaaagtttcggttttaaaaagatcgtgtaatgacaaggttttctacttggacctcaacttaactcccctcgagaatgacttgaaattgttgttgttcgggaaattgtcacccaaagttaatctttcttccttctga

SEQ ID NO: 4229 - DNA, 1284 bp, Unknown
  Kingdom: Plantae, Phylum: Streptophyta
atatatatctcattgttgagtagtgtcagcatctaacatgctaaagcaatcgcgtgatatttacttggaacattctaaattcaaagttcaaaatatgtctactacggtttctttgacttttcctcctttatcactctctcttgttctataaatcttttctcaatcatcaaagccgccactaacctcatacacacgatagaaaacatggcatcttacgagggagggccattggtgatggaaatggaaggagaagaaggtttcgaagaagaagccggcagcagcggttgcgggtgcggatgcttcggcctgaagaaatggtggcaaggccatgaggaagaaggtaaagggctacttgttgatcaaaagggtgagggagagtcatgggtggtggagaagttaaggaaggcaaaggaggtttcagaagtgattgctggtccaaagtggaagactttcattagaaagataagtgggtatgggaagaaggtgaagcaacaaaggaacaggtttcagtatgatgaacacagctatgctctcaacttcaactccggggctcagagtgaagatgaaggcatgcctcacagtttctcatctaggtttgctgctcctggtcgtcgccagaatgaatcatgatacatatttttcactagagacaatcccagttggatagaacctttaaacatgtatattgttgcctaaatttgtttacatgattgtaattcttatcttgaaattatcattcattgtgtgaagagtgaagaccattgttctttaataaattaaattccacgttttatctttacctcttgcaaaattttcctgaatagctaaatattcgaagaaagctagctagttgaagcagaggggtacccaccaaaaatatcgtttgtgagcaaagtttagtttgaatttgaacgatcctcttcttaagatagaaatggaagaaaggatgtggattcttcacaagacaatagtcacacgtaaaccattggttttttttaggatataggtaacactttcaagaaacaaattcaaggagtgattccattcttccaaaagtaaacgcgttccatcgaggacgcgttaaaaataatttatacttttcctttgctttatgtatgccaaatccttttcatccgcaattccttttgttctaagaaggcaattggaagttgtcccctcgtgcaacttgcatacctctatctaagactaccacagatctttaatttatgttatactaaaaatatgaattttaccaataaaatagatgagtcatttttttgtgtg

SEQ ID NO: 4230 - DNA, 580 bp, Unknown
  Kingdom: Plantae, Phylum: Streptophyta
aatgtaccctgatatacacacacacagctagcagatattacatacacgtgaatcactaattaagccatggagaagaaatcaatagctgggttgtgcttcctcttccttgttctctttgttgctcaagttgtggtgcaaactgaggcaaagacttgcgagaacctggctgatacatacaggggtccatgcttcaccactggcagctgcgatgatcactgcaagaacaaagagcacttgctcagaggcagatgcagggacgattttcgctgttggtgcaccaaaaactgttaaatggatccattcactccaacgtgaagaagatgcatgcagcgctattttataaaaaataaaactactatatactatatataataagactggcgctgcatcaatgacctatgtattatagtatatattattaccgatgtcagaactatagatgcatgtactgtgcataacggctgagttatgtacttatgttaagaataaaataaagtgctgttgttgcaaagcatggtcgtattgtattgttcttagtacgatctttttaattaatcttcatctcatctcttcagatata

SEQ ID NO: 4231 - DNA, 1374 bp, Unknown
  Kingdom: Plantae, Phylum: Streptophyta
gtgaatttcctcatatttctataagacacagaatatttaagaatggagttcaccaaaacaagttccctcctaatattcttgctagtgtttgtctcaagcttgatccatgctaaggcataccaaaatctatactgtggcagaggaaccagatgctatggaaagtacatcacatgtcctgctgaatgccctaacagtgaaacaaacaatcctaagactaaggtttgccaaatcgagtgcaacaaacctacttgcaaggcagtctgcagaagtcgcaagccaaactgcaatgcaccaggatcaggatgctatgatccccgtttcattggtggagatggtagagtcttctacttccacggaaagaccaacgaacacttctccttagtctccgattccaaccttcaaatcaatgcacgcttcattggacacaggcctgaaggaagaagccgtgactacacatggatccaagcccttggaatcctcttcaactccaaaagcttctcacttgaggccaccaagacaccccagtggaatgatgaacttgaccacttcaaattcacctacaatgagaaccaagtagccctagctgaaggctctctctccacttggcacagtgaagaaaaagatataaaggtggagagagtggcaagcaagaacagtgtgatggttacagtgaaggatgtggctgaaatattggtgaatgttgtgccaataaccaaagaggatgacagaattcacaactaccaagtgccttctgatgactgttttgctcacttggaagttcagttcagattctttgctttgtcccaaaaagttgatggtgtacttggaaggacttataggttggattttgagaacccagcaaagcctggtgtggctatgcctgttgttggaggagaagacaagtacaggactaactcattgctctctcctgattgtgtttcttgtgtgttctcacaggaaagttctgctgagaaagagaccatggaatatggcacccttgattgcaccaagttttcaaatgggttgggaatcgtttgcaggaagtgaaaactgttttttattatccttaatttatgttgtgttgggtatgtttagaaacaataatccaatgcgtggttgaggtgaaaaatctgaaacctcgttttgggaataatgattctatatatgcacactagtttgcctttgtcgtatgctcagtcactcattgtaatgttaaactcttgtattgttgcagtacttattaactgccatgcatgaaaataaaaatgttgtgtttgtagtttaaatgattggctattctgcacaacttatttacattgctacttttgatattcatcgatctcctattaaaattaaagttttacttttgtaata

SEQ ID NO: 4232 - DNA, 1027 bp, Unknown
  Kingdom: Plantae, Phylum: Streptophyta
gcatatctcatttgagttaattaatttgttgtagtttagtactgaaaaatgggttcgaagatatcaacagtacctaccctaggtctgttggccatgctccttctgatctcctcggaggtcttagccactagtggtggtgcgggtaactttggtggtggtaaccctagtgttggtggtggattacctggtggtggtggtggtgatgttggattacctggtggtggtcgtggtggattccctattggtggtgatgttggattacctggtggtggtcgtggtggattccctgttggtggtggtgttggattacctggtggtggtcgtggtggattcccgattggtggtggtgttggatcacctggtggtggtggtcgtcgtggtggactacctgttggtggtggtgttggattccctgttggaggtggcagtggcttcccgggcattgttggtaccttccctagtggtggtggcacccctcgtggtcgtggtggctcccctcccggacgtggaggttttcctggtggagttggcggtttccctggtgatgttggtggcacccctcccggacgtggaggttttcctggtggagttggcggtttccctggtgatgttggtggctcccctagtggtggtggcggcttccctggtggaaggggtggtggattcccaggccagagaggataaggctcacaaatgacagagtagttctactaagtacttactatatttcatgaataaatttcttgttgttgtgtgaggcatgcttatagtcaacaaggaggggtgtcttttctcctgacctttcttaatgattaccactaacaataacaaaatattgaataatacgtacgtcactgcatgtacctatataatcagagcaaatttaagaatggtgataatatactgtgtgcaaagcttttgtttgtcctaattaaatcgtgtgtcttacttctatgctgtctacatctcttcattatttctttgtagttaagtttcagtttttataattatcatatcttcaacctgc

SEQ ID NO: 4233 - DNA, 1708 bp, Unknown
  Kingdom: Plantae, Phylum: Streptophyta
gcgactttcaaattccttgttcttcttcatgtgtgtctccctctcgtataaatacactaccatcttccatttcctcttcaaatccaattcaccaaacatggttgatctagattggcaaacaaagatggttcactccaacatgcctccaaagtcccccaaactctctctcccggataataacattccaatcccccttcgccagaacgacatcaccgcagcgtcgtctccaatctgcgctgcctacgacaactacctccgcctccctgagctcagagccctctgggcctccaacgacttccctaattgggccaacgagcccatcttaaagcccaccttacacgccctcgaaatcaccttccgcttactcgcaaccgttttatccgacccgaggccgtacataaacaagcgcgagtggacccggcgggtggagtctctcgccacggcccaaattcagatcatagctatgctgtgtgaagacgaagaagaaaaccccgagacacgtggcacgacgccaccggtgagtgacattaacggcttcatcgctcaaagcagaagctacagcgaggagagcctgctcccgcgcctcgccacgtggcacaaatccaaggacgtggcgcggagaatcctcgattcggtagagtaccagatgatgaggtgcacgtacaccttaggtttaggagaggcgaatctcgcgggtaagaagatattcctttacgacgccgtttgcaggccgagcgagattcactcgttggagacgacgccgtttgattacgtggggaactgcgagaacaagacgctgcacgcgacgcagcagatcgcggagtgttggacgcgcgcggtgaggaagctgctggagagagtggcggagtcggtggagagaaaaacgttggagaaggcggcgagggagtgtcacgcggtggagcggatctggaagttgttaacggaggttgaggacgtgcacgtgatgatggatccggaggatttcttgaggttgaagaaggagttgggaatgatgagaaattgcggggaaatggtggcgttttgcttcaggtcgagggagctcgtggaggtggcgaggatgtgtagggatctgaggcagaaggtgccggagatattggaggtggaggtggaccccacgggtgggcccgggatgatggaggcggcgatgaaggtttactcggagaaagagaaaaggaacgggttcgagaaggttcatgttttgcaggggatgcaggcgattgaggtggcgatgaagaggttcttctacgcctataagcaggttgtggcggttatgatggggagctccgaggccgataatgggttcactcagatattccttgaacccacttatttccctagcttagatgctgccaagacctttctcgcttattattgggaaaataataatcaaaatgtggttccctgctagttaattaaaaaattaatcaattaattcctagtcatatatacttactcacacaaacgggaaaacaaagagaaaaaaaaaaaggactaaatttttgtaataggttggtgtaaacaaatctttgtctgtaaaataatatttatttgactattcttttggatcatgttctttcggctgctttaaattatgacctgatccccgcttttgaattttaaaagggttcgtgttttatgatgcatgggttctgaggaatataagttgaagtactatgatttaaggctg

SEQ ID NO: 4234 - DNA, 830 bp, Unknown
  Kingdom: Plantae, Phylum: Streptophyta
acgtgtctccatgcatgggtatctttaatagaattcctcgaaaatactagacactggtcttgttttctatataaagcttcttcctctgtttctccttagcattgtaagaaagcccttcatcagagataacttgacaaagaaaatcaccatgtctatcatcccaaacttgttcggtggtagacgaagcaacgtcttcgacccattctctctggacgtatgggaccctttcgaggggtttcctttttccacaggtcacgtgccttcctctggtggggaaagcagtgccatagccaacactcgcgtggactggaaggagactccggcggctcacgtgttcaacgttgatcttcccgggttgaagaaggaggaagtgaaggttgaagttgaagatgggagggtgctgcagattagtggtgagaggaccaaagaacaagaacagaaagatgataggtggcaccgcgttgaaagaagcactgggaagttcatgaggaggttcaggcttcccgagaatgccaaaatggatcaggtcaaggctgctatggagaatggagtgctaactgttactgtgcccaaggaggaagacaagaaacctcaagtcaagtcaattcaaatatctgcctagatctttaattggttgttgctgtctctcattccaaacaagtgtgttctgttctgtctttactgtatgttgttccatgtatgtgtttatgctgtgtgttgtgctttatgtcatttgtgatggtttaatactggggaagttgaaagttttccgttaaatgtatcaataaacttttattgctttatctcgatatgattttctaaatctctca

SEQ ID NO: 4235 - DNA, 553 bp, Unknown
  Kingdom: Plantae, Phylum: Streptophyta
gcaaaaacttcgtacactgttacatttcttggctcaaagagaaggaaattaaatactcaaaagaatagtacttgtttggaaaaactaagatgcagatgaagaagagtagtctttggattgtgatgattatcacagtgcttgtggtgtcatcgcaattttgttctgtgcatggaagagttcttcgatcagaggtgttaaagacaccggtaggtgacggttgtgaggatttcaaaggagaagattcttctcttggaatggcaacatttgctgttgcttctaacaactccagcactcgtcaatttgcacgaagcttggcgtataaactagcttctggacctagcaaaaaaggccctggacattagtcttaattgcttgttactatggcttaatttcttccacttttttttttcttcttattttcttccatttttggttctgaaattgttcttttctttctaggtctttgactcatagatgttgagcctctatctttctctacgttttttatgttttgtttctgttttcacttcctccacatacattaatcttgtgt

SEQ ID NO: 4236 - DNA, 1821 bp, Unknown
  Kingdom: Plantae, Phylum: Streptophyta
gttacaccataacaccctccctttcaaatcaacggtccacattccacgcctctcagatctcgcaatcaaacactttaaattccctccttcctcacaacatgccgtttctcttttacagccgtttttcttattttatttatttacttcggcttgattttagtttcgtgttgtgatgttttctgtggttctgttgtgttatgttcagttcgttgcatgcaaaaacgattatgaagacgccaaaacgccactcgccgccgccaaattcttccctgcgagtggagtctgattccggcgaaatcgtcacgaggttcaagaacggtcgccggagaagaattaaaatcaagcgaatgaaatacacttgccagacgaagatccgcgtcaggaatgacgccggcgccggcggcgtgtctcaacttctggcggtggattctgaaggagagaagagagagattcacgagaacgtggagatatcgctgtcgctggcttcgtcgtcgtcggaagaggaagagcgattgtcgtcgaagcaaaacgacggcgttttgtcgtacgggtcggcatcggtgatagggagcaggaaggagatggaggacgcggtgagtgaggagatagggtttgctgcgaagtgcgacttcttcgcggtgtacgacggccacggcggagctcaggtggcggaggcgtgcagggagaggctgtacaggctggtggcggaggagatggagaggagtgcgagtcacgtggaatgggactggcggggagtgatggaagggtgttttcggaaaatggactgcgaggttgccggcaatgcggctgtcaggacggtgggttccacggctgttgtcgccgtcgtcgcggcggcggaggttgtcgttgctaattgcggtgattgtagggccgtcctgggaagaggaggtgaggccgtggacttgtctagtgatcataagcaaaaattgttgctggcaagtgaatgtctggggtgcgtagcgtccaaaagagaagatgtctttttgtcttatcgtagagtcaagtcaagtatttctattattatttagagatttgagatctttgtattgggtgcatcaaagcttttatattaaattatttccgtagcattttttcatcccgaagcaatttaatgcaagacaatgaatgaacggcattgcggttcccttttgtgtgcacagcccgacaggcccgatgagttgatacgaattgaagaggctggtggaagggtcattaactggaatggccagcgcgtgcttggtgttcttgccacttcacgatccataggagatcagtaccttcgaccttatgtaatatcaaaaccagaagtgacagtgaccaagcgaagcagcaaggatgaatttctcatactagcaagtgatggattgtgggatgtgatgtcaagtgaagttgcgtgccaagttgtaaggaaatgcttccacgggcagattaggagagtgtgcgatggagttgggaatcatcaaaaccgtgctaccgaggctgcaggcctcttggcagagatagcattggcaaagggaagtagagataacaccagtgtcattgtagttgagctaagaggatcagtaacaactgattgaggcctcatttctgccaaaacatgtatctttatttttattttcttctctacttattggcttgctgcttttggactaatatctactcaggatgtgcctcttcaatgccacaagagattatctacttgataataatgagtacatgctatgtcacattagtgtttttttttttttgaaaaaacgacctccaattaattctttaaatatctacaacatgtcaatacat

SEQ ID NO: 4237 - DNA, 1885 bp, Unknown
  Kingdom: Plantae, Phylum: Streptophyta
aaaacccacaccactttctttccttcatcacattcacatacaattcttctaagctctactaaaaaaagatacatagaaacaatcgaaattatttattattattaaagcaacatggttttgtcatggacaaaagggagagtgttccggcgtgccagaaagggtaaggagttgaaatattctggtggcgacatggagatagagattgcgatccccacccacttccggtgcccggtaaccttggacatgatgaaggaccccgtgaccgtttccacgggcataacctatgaccgcgacagcatcgagaagtggatcgagtccgggaaccgcacgtgcccggtcaccaaaaccgagctgaccagcctcgacgacatgatcccgaaccacgccatccgtaggatgatccaggactggtgcgtggagcaccgctcccacggcatcgaacggatccccactcctcgtatccccgtcaccccgtacgaggttgccgacacgtgtacgaggatcctgtcggcggcgcagcacggcgacgagaacaagtgcgtggagttggtgaggaagatcaaggcttgggggaaggaaagtgagagaaacaaaaggtgcatagtggccaatggtgctgctttagcactatccaatgccttcaactctttctcatcacgtgggttgttgattgagaagaacgtggttgtgttggatgagattctgggggctttggtatggatgcgtcctctttctgaagagggtagatccgtgttggggtcaacgagttctatctcttgcatggtttggttcatgaacggtaaacaattgtccacaaggcaaaacgctgctttggttcttaaggaaatgcatgttgaggcgttggtgaagtgtgtagatgttgttgaggctttggttaacatgattaaggagcctgttgggaatggttccaccaagccgtgtttgtcaacgattttcaacttggttagttattcttcagttagaggtgtgacttgtgaaaggtttgtggaattgggtttggttgatgcggtgttggaggttcttgttgatgcggagagaggggtgtgtgagaaggctttgggggtgttggattgcgtttgtgattgcaagcaaggggtgcagatggcaaaggctaatgctttgactttgcctcttgtgattaagaagcttttgagggtgtctgagttgagttcaagctttgcggtttcggttctttggaaacttttttgtgacaagaatgaagaaggggtgttgattgaggcgcttcaaatgggagtgtttcataaactacttgttttgttgcaagtgggttgtggtgagggaaccaaagagaaggctacggagttgttgaagttgttgaatggttgtaggagcaaagccgagtgtgttgattcgtccttggatttcaagcatttgaagaagcccttctaatttgatctggctaggatatgagatttcattccactttttttttgtataggtcatattggtagaaacagaatatactcttgtacaaagacacacacacagagtctcatatacggaggatacaaattggtatctctaacactcaattgaagttttgaaattcattttttttaatggaaattttagatttgagacatacggacctgtaattaacaaattcagaaattacaaatgttttggtttattacaaaccggggattgttatgtatgttttgattattagatcaaattgtacaattttaaaaatgaaaagaccaaaattttgaagaaaaaaattacaaaaccaaaattgttctttaagaattaaaagcgaaccaatattaagaaaaaatagtacatacttaaaatctatagacatgtttacaaagatgttgtctcccttacaaccatggaaaaa

SEQ ID NO: 4238 - DNA, 741 bp, Unknown
  Kingdom: Plantae, Phylum: Streptophyta
atggagaaggagaaagagaaagaatctaagctgaagaacaagatcttcaaaatactgccaaaagcagcggctgcagcagtgagcatgacattccaaaaccctcccttcagcccaggcagggatcacaagttcaaacaccatggcggcaaagggttcttctctggccctatgattcccgttgaagccagaagaaaatcaaaggatggttgtgttgaaactcaagaacccacttcccccaaaatctcctgcatgggacagatcaagcacaagaagaagaaaaaccaaatcaaaaaagcggcaaagaccatgtccatgcctacagaagaaaagaaacaagcttccaagtttcagaggatgatgtcgttccactcggggaaaccaaaacgacccgcggcgaggaaacagcaatctgatgcggacttggagagtgagagatcacctgcaccgccgttgggtcacatgaggcgatttgcaagtgggcgtgaaacattttcgaatttcgattggaaggctcagattgctcctgaggaaagggattgctattcgtattatgatgatagattggagagcgatgcagaggatgaaatcataatccctttctctgctcctcttaccgttggtggtgctgcaagtgcgcttaatcttaatgcgcagccacggaaagagattaatctatggaagagaagaaccatggcaccacctaggcctcttcagttgaatcccgtgcttacggccaaatga

SEQ ID NO: 4239 - DNA, 1534 bp, Unknown
  Kingdom: Plantae, Phylum: Streptophyta
acaacaatattagctagctagctagtattcacatatacatacaatggctactcctacttgtgtcttgtatttctgtgtacttgtcttctttgtttcaccatctttgtcagcatcaaatgaatttcctaagaccggatatatctccctccccattaacatagatccaaccacccatcagcacttcacatcaataggcataggaactccacgacacaacatgaatttagccattgacatttcagggagctacctgtggtacgactgtggtggtaattacaattcctcctcttacaatcctgtcctctgggactccccacaatgccctggacccgaacccttccaatccaattgcgatgctggttttccctttaagccaggctgcaccaacaacacctgtaatgttgcccttgataacccctttgctgactttggtttcggcggtgacttgggtcatgatttcctcttcactcctcagatcaagttgcctcaaacctttttttctgtttgctcagaatcttctaggttcccccagttacctattcttgttggccttcccaaaggcaccaaagggagtctagggcttgcaaggcagtcaccattcacattacaatctcaaatctcttcttcctttaacaacgttcctcccaagttcactctttgtttaccttcttctggtaaaaagggacatcttttcattggtgggagaccaactttctctacccctctttcccaaattggatttgatagccgttattccaattacgattacttctttcatctcaactcaattcatattaatcacaaacctgttcaatttaacacttctggtctgtccgtcgatttaaacgacaacgtgggcactaaaattagcacccttcatcctttcacagtgttacaccctcaagtctaccagccctttgttaaagcttttgtgaaggcagcaaagaccaaaaacatgaagagagtgaaaaaagtgcacccatttgggacatgctacgatgccactaccgttggggatcatagagaagctgtgccagctatcgatctagtgttggaagcagaagaattaggccgctttgggaaagtgagttatgagatatatggccacgattccttggttgaagtgaaaaaaggtgtgctgtgtttggcttttgttaatggaggtataagggcattagatgctgttcttcttggtgcgcatcaactcaaggataggattttggtgtttgatgagagtacctcaattataagctttagctcctcccttgtgcatcaaaataaaacctgcttagatccaacttctctttaatctgccaatcatgcatcattagtgtaatattatgtttgcttaattttgtagtttcgtgaaaaataaaaggcccacgtggtgctgtcttaattatgtgtcttaaatctcaagtgtacttgttcacctagaaagagaaatctcaagtgtactttccttaatagaaaaaagttattctgtccttttgatctccttatggattgtttgaataatgaattagttaactga

SEQ ID NO: 4240 - DNA, 1474 bp, Unknown
  Kingdom: Plantae, Phylum: Streptophyta
cttcagcacagtatttagaacaaattactgatagaaaaaatgaaagtaacagttgtgtgttgtgtattggttgtgctagttggtgcactaccattctcttcagatgcacaactagacccctccttttatagggacacatgtcccacagtgcattctattgtacgtgaagttgttagaaacgtttctaaatcagacccccgaatgcttgctagtctcataaggctccactttcatgactgctttgttcaaggctgtgatgcatcaattttgttgaacaacactgccacaatagaaagtgagcaacaagcttttccaaacaacaactcaataagaggtttggatgttgtgaaccagatcaagactgcggtggaaaatgcttgtcctggtgttgtttcttgtgctgatattcttgcccttgctgctgagatatcttctgttctggctcatggtcctgattggaaagttccattgggtagaagggacagtttaacagcaaacagaacacttgcaaatcaaaatcttccagctccattcttcaatcttactcaactcaaagatgcctttgctgttcaaggtctcaacactactgatctagtagcactctcaggtgctcatacaattggcaaagctcagtgcagatttttcgtcgaccgattatacaatttcagcaacactggcaaccctgatccaactcttaacacaacctacttgcaaacacttagtgcaatatgccccaatggtggacctggcactaacctcaccaattttgacccaaccacacctgacacattggacaagaactactactccaatcttcaggttcacaagggcttgcttcagagtgatcaagagctgttttccacaaccggtgccgataccatatccattgtcaatagcttcagcagtaaccaaactcttttctttgagaacttcaaggcttcaatgataaaaatgggtaacattggagtgctaacgggatctcaaggagaaatcagacaacaatgtaattttgttaatgggaattctgctggactggccactctggccaccaaagaatcatcagaatatggcatggttagctcaatctaaataacttaacaaaaacaaaagttagtgtatgcttcaaaatgcagagattaaaaggtacctaataaagagttcaataggcacgtacatggctcgtgcctgcggtggaccatgatatatatgtctgtacttttgtgcactgcgtcacctatgctatcactttatttgtaagatctggtcaatatatatattatgagaattctaagtcatatcatgcagataaacatgtgaaaagatagcatagtagaggctggggtatttgttgatgaactactgaatcttgttaccaagtattattatctatgctgcttttaatcttctacctgtattaattggattaaaattattattttaacaacaaatgaatgtaaagttacaataatatgtt

SEQ ID NO: 4241 - DNA, 982 bp, Unknown
  Kingdom: Plantae, Phylum: Streptophyta
gcttcacatggaccaaaatccaattctcacaagctattacatatatcagaatcattaaagataagattatattgctaagaagaaaaaatatgaaggttgtctacttgcttgttgccctcttggctttgacatcaactgttgtctctgcctatgaccctagtcctctgcaagatttttgtgtggcagccaaagaaaaagatggtgtatttgtgaacgggaaattctgcaaggaccccaagcttgtcaaagcagaagatttcttcagacatgtggaacctgggaaaactgacaacccactaggttcaaacgtgactcaggtgtttgttgatcaactaccgggactaaacacgctcggcataggtttggctcgcatagattttgctccaaagggtttgaacgctccccacactcaccctcgcggcactgagatccttatagtccttgagggtactctttatgttggatttgtgacttccaatcaagatggaaatcgcctcttcaccaaagtgctgaacaagggtgatgtgtttgtgttcccaattggtctcattcatttccaattgaatgtgggatatggcaatgctgttgccattgctggtcttagcagtcaaaatccaggagctatcactattgcaaatgctttgtttaaagctaatccacctatttcttctgaggttctcaccaaagctttccaggtggacaagagcataattgattatcttcaaaagcaatcttggtacgacaacaataactaatttgggagaatggacgatcatttcgcactagctagttattggatataattgaccactttatggtttcaatcaccccatacaatagacctaataaataaaatgtatgtgggttatttttatatttcatatttgttcttttggagtttgattaatttggtttaatacactgtttgagtttaataaaagaacctgttcttctttgagttgcggatggatctgatctttaa

SEQ ID NO: 4242 - DNA, 2289 bp, Unknown
  Kingdom: Plantae, Phylum: Streptophyta
agtaatgaaattcaaggttcgattcctggtggtattcgaaacctcacacttcttcaaaatcttgacttgtctggaaattcattctcatcttctatacctgattgcttatacggtcttcatcgtctcatgtatctggacctaagttacaacaacttgcttgggactatttctgatgccctgggaaatttgacttctcttgttgaacttgatttatcacggaatcaacttgaaggaactattccaacttctttgggaaatttgacttctcttgttgaactttatttatcaaataatcaacttgaaggaaccattccaccttctttaggaaatttgacttctctgattagacttgatttgtcatatagtcaacttgaaggaaacattccaacttctttgggaaatttgacttctcttgttgaacttgatttatcatatagtcaacttgaaggaaacattccaacttctttgggtaatgtctgcaacttaagggtgatacgtttatcatatctcaaactcaaccaacaggttaatgaacttttagaaattcttgctccttgtatttcccatggactcacaagacttgcagttcagagttcacaactttcaggcaatctgacagatcatattggggcatttgaaaatattgtgctgctagatttttccaacaactcaattggtggtgctcttcctagatcatttggaaaactttcatcattaagatttctcaatctgtctattaataaattcagtggaaatccatttgaaagtcttggatcactctctaaattgtcatctctttatattgatggcaatctttttcatggagttgtcaaggaagatgatcttgcaaatcttacaagcttgacggagtttggagcatcagggaacaatttcactttaaaagtgggtcccaattggcgtcctaattttcggctttcctatttggatgtgacatcatggcagttaagtcccaactttccatcgtggattcagtcacaaaacaaacttcaatatgttggactgtctaacacggggattttagattctattcccacctggttctgggaaacaccttctcagattttgtatttaaacctctcttataatcatatccatggtgagattgagactacattaaagaatccaatatctatccaaactattgatctaagctcaaatcacttgtgtggtaaattaccctatctttcaagtgatgtgtttcagttagatctttcaagcaattcattctctgaatccatgaatgactttttatgtaagcatcaggacgggccagtgcaattagaatttctgaatcttgcatcaaataatttgtcaggagagatacctgattgctggatgaattggacatctcttgtgtatgtaaatttacaaagcaaccattttgttgggaacttaccccaatccatgggttccttggcagacctgcagtcgttacaaattcgtaacaacacactctcaggaatatttccaaccagtttgaagaagaataaccaattgatatccttggaccttggggaaaataatctttcaggaagtattccaacatgggttggagaaaagctcttaaatgtgaaaatcctcctccttcgatcaaacagttttaccggccacattccaaatgaaatatgtcagatgagtcttcttcaggttttagaccttgcacaaaacaatttgtctggcaatataccgagctgtttcagtaacttgagtgccatgacactaaagaaccaaagtacagatcctcatatctattctcaagcacaacttgttatgctttacacttcctggtatagcatagttagtgtgctactatggctgaaaggaagaggagatgagtatagaaacattctgggtttggtaacaagcattgatctatcaagtaacaaattattaggagaaatacctaaaaaaatcacaaatctaaatggattgaactttttgaacttgtcccacaaccaattgattggtcatattccacaaggcattggtaatatgggatcattacaatccattgatttttctaggaatcaactttctggtgaaatccctccaaccatttcaaatttgagctttttgagcatgctagacgtgtcttataatcatttgaagggaaaaattccaacaggaactcaattgcaaacctttgatgcctccagctttattggcaacaatctatgtggcccaccactgcccataaactgctggtccaatgggaaaactcatagttatgaaggaagtgatgggcatggagtgaattggttttttgtt

SEQ ID NO: 4243 - DNA, 1588 bp, Unknown
  Kingdom: Plantae, Phylum: Streptophyta
tatctttcaaatcccttccagcccccgatttgatctcctcaccacaaaacacacaaagactagagagacccttcagttaattaatctctcatggcttctttacaaaccacatcttccttttcctcttctctaagaaaattcaacgcctctatccatctccctaaaccttcacgagtgacttattctgttcctaaagtaccaacaagaaagctgctcgttgaggaatttaatgcttctatacaaacaagcccattaaaaaagaatgcggtcaccactcatatacacccagatttattcagccctagcagtagcaagaaatctaataaggccattgttcaactctacgcagttctagatgaagtagctgacagaattgaaatgcacagaaacattggcgaacaaagaaacaactggaactcccttcttctaaactccatcaacatgatcactctcactgccacagccatgaccggtgttgctgcagccaccagtggtgacactgagccgcttttggccatgaaactatcatccacactcttgttttctgcggccactggaatgtcacttatcattaacaaaattcagccatcacaactcgctgaagagcaacgcaatgctacaaggttgtttaagcagcttcatacccaaattcaaaccataatcgcactgggaaatccaacagaagaagatgtgaagagttcaatggagaaggtcttagcacttgacagtgcttatccacttcccttgttgggagccatgcttgacaaatttcccgaaaaatatgaacctgctgtttggtggccttcatctcatcagttccaaagaagaagtaaaacacaagagagtaacaatggatggagtgaagatctagaaatggaaatgagggaagtgattgaagtggtaaagaataaagacttagaggattatgagaggcttgggaacatagctttgaaggtaaacaagagtttggcgattgcagggcctctattgagtggcattgcagcagtggggtcttcatttgttggtaatggatcgtgggcagcattagtacctctcgttgctggctcattggcttcagcagttaatgcttttgagcatggtggccaagtaggtatggtctttgaaatgtacagaaactgtggcggattcttcacgcttttggaacagactattcaagccacacttgaagagaaaaacttggacaaaagagaaaatggtcaagtgttcgaaatgaaggtagcaatgaagttgggaagaagcgtttcggagttgagacgacttgcctcaaaatctgcttcctgtcgcatggaaggaattgccgtagatgaattcgccagcaagcttttttaattaggacaacatttcatcacgaattacacgcaatattcttttattctttatttttttttgttacatattctttactaattgtatagtcctctgacacagctttattacatactgtacatatatttgtacgtacgttcatgtaactgactcaatgatcgatatttacttctcaccatttttcttgtcttaacacgaagatttttatttatttggttgcatatttttatttaaatttgaa

SEQ ID NO: 4244 - DNA, 930 bp, Unknown
  Kingdom: Plantae, Phylum: Streptophyta
aaaataaatcgaactctcgcgttgtgggggcaacttcacagtaacctgaagcgcctataaattaaggcaataccaaaatccataaactcacaccctaagagagcaaaatattttcttctatctcatcctttcttttagttttatttttatttttttatcttgggtaaaaaaaatcatgggtgttttcacttctgaaagcgaacacgtttcccccgtctctgctgcaaaattatacaaagctattgtcctagatgccagcaatgtcttcccaaaagcattgccaaatttcattaagagcgtagaaaccattgaaggagatggagggccaggaaccattaagaagcttactcttgctgaaggtttaggttatgtgaagcaccacgtagatgcaattgacacagaaaactatgtgtacaactatagtgtgattgaaggcagtgcattgtcggagccattggagaagatatgttatgagtacaaactggtggcaaccccagatggaggatccattgtgaagtccacaagcaaatactataccaaaggtgatgagcaactcgccgaagaatatgtgaagactggcaaggagagatctgcaggtttcaccaaggctattgaggatttcattcaggctaatcctgattacaactaattaagtcaccaattataattatgtctcagttttattaattatggtcattttgtgttttttttttcccttcttgtcgtgtgttgctttaatttccaataaaattattgtttgactttgcttcatgagaaaagtttgagattattacaaactggtttgtgtacccatcattattgtatattttcgttatccttttgttatatatcaatatcgatcgatcaatgtttctctcttcaacttcaatatgaatgcataattaatacctaatagcttataggaagatt

SEQ ID NO: 4245 - DNA, 1364 bp, Unknown
  Kingdom: Plantae, Phylum: Streptophyta
tctcccacaacacagcaccaacaactcctattaagttttcagttctcacaaattaaaaaataaaaatattatatatacatatatatatatatatatattctcttcgagtccgtcgaaaaagaaaacaatggcgaaacccagcagcgaaaagccagaggagcatagcgattccaagtactacaaaggggtccgaaagagaaaatggggcaaatgggtatccgaaataagactacccaacagccgtcagaggatttggttgggatcctacgacacccccgagaaggccgcgcgtgccttcgacgcggcaatgttctgcttacgtggccgcaacgccaagtttaatttccccgacaacccacccgacatcgccggcggaacgtccatgacgccgtcgcagattcagatcgccgccgcacaattcgccaacgcggggccccacgagggacattcgggtcgacccgaacatcctcccatggaatctccatcgccttctgtttcggaagggaccatccaaacggacagtgacgtccccactcttaacggttcagtaacggatttgttcacgcccgttgggtcgagtggttacgcatccgattacgggattttcccgggctttgatgatttcagtggcgatttttatgtgccggaaatgccgaacgttaattatggagaagaaaacggggaagggttcatagttgatgaatctttcttgtggaatttttgaggggcaatcaaatccagtattcaccaccggccaaatgggttatggttcaggactacgagagaggcgtaaccaagtttaagaataaagtttttttatttatacatcaaatagtttattaaaattattattattttatttaaaatttatttttaaatataattttataatatttttttttaggtatattaatactaaaaaataaaatttaaaactatttttttagctaaagtccttacatggattgtttgatccttaagtcgatcctgtcattgttatggttgcagatagttttattgattctggaaccgtggtaatgatccgggtttgaattcgttaatttttggacgaccaaacctatatgattaatgagtttctatgatattgatatcgatgctactgtcaagattattgtaaaaaaaaaagttgtgattcattcaataatgaaaatattagttatcttgcaaataccagctttcttattttttttaactttgagttaagttatgttctacgacaagcaaaatttgccgtcaccttatagctagggtaacaaatttgaatgttagttttcaaattttttattacattccaactttatccttgtaactatttatattgaaatgaattgatctatttgtgt

SEQ ID NO: 4246 - DNA, 1254 bp, Unknown
  Kingdom: Plantae, Phylum: Streptophyta
cactctcttattctataaatcttttctcaaagaaaaagttacacaaacacacaaacattatttatacctccattagccacccctttattatttcaggtgttgggtgggggtatgtacgtgtatcactgctcttactcaaatcatcaaagccgccactaacctcatacacacaatcgaaaacatggcatcttacgagggaaggccattggtgatggaaatggaaggagaagaaggtttcgaagaagccggtagcagcggttgcggatgcttccggtgtttcagcctgaagaaatggtggcaaggctatgaggaagaaggtaaagggctacttgatcaaaagggtgagggagagtcatgggttgtgaacaaattaaggaaggcaaaggaggtttcagaagtaattgctggccccaagtggaagactttcattagaaagataagtgggtatgggaagaaggtgaagtaccaaagaaacaggttccagtatgatgaacatagctatgctctcaacttcaacagcgaagctcagagagaagatgaaggcatgcctcacagcttctcatcaaggtttgctgctcctggtcgtcgccagaatgaatcatgatacgtgcatgcatgttctttaattacagttatgttcgagcaggatcgaacctttaaacatgtaaattgttgcctaaatttgtttacatgattgtaattcttatcttgtaattatcattcgttgtgtgaagagtgaagaccaatattgttctttaataaattaaattccaccggttttatctttagctcttgcaaaattttcccgaatagcaaaatattcgaagaaagctagttgaagaagagaaggtacccaccaaaaatatcgtttgtgggcaaagtttagtttgaatttgaacgatcttctcttcccaagaatcaagatagaaatggaagaaaggatgtggattcttcacaagacaatagtcacacgtaaaccattagtgtttttaaaataaaggtaacacttcaagacacaacaaattcgaggagtgattccattcttccaaaagtaaacgcgttccatcgaggacgccttcaaaataatatatacttttcctttgctttttgtatgccaaatccttttcattcgcaattccttttgttctaagaaggcagttggaagttgtcccctcttgcaacttgcatacgtacctctatctaaggctataacaaatccttaatttgtatcatgctaaaaatatgaattttacc

SEQ ID NO: 4247 - DNA, 1319 bp, Unknown
  Kingdom: Plantae, Phylum: Streptophyta
cttgttcaaggaaggaaaagaaaaccacacgctcaactagaaagaccaatttatccttctaaaaagagttatcccccagtccccagagataaatttggaaataagccaaaagccccaagaatctcaatctcctataaaattgctaagaattctttctcctactaaaaacacaaggccacaaattctatcggtttacctattataacaacatccactttcaaactgcaacctcccattggctttctttgccctcaaaaaaagaatcatatcactcatattttcttcattccatggcctcaacaaaatgtggttcgagaacaatgaagtcccaaccatcacgcacgtgcatgtgctcacccacgaatcaccctggctcgttccggtgtagcatgcacaagaagccacccctagcggcggcggtaccctccaaatgggaatcatcacctatggctgccaaagccaattcattgaaggccactctcttgcaaatgattaagccctctagccatgatcatcacaagagaaagactttccaaccaaagcctacccgcttttctttgatgaacaacggtaacgctgctgttgttgccgttaattaattaattcatcacaaattggtcttactttctatatatatatatatatatcatcatccctttttctttgctgtaatatatgtacatataccatggaatcccttgtttccctttattcttttttttttgtggggtgtaatgtaattattagaaagagtgcacgtgtataattaatctgaggatatgtgtactacgtaaggttttgctcctgtctgatatggtagaatgataagaaatcagttttttttttttattgggagtttgtaatggactcaacattaaagtagatcttgtgtgagctgcacataataatatctttatttcttatgactttcttctctccctctctctctttttcacatattttgtcattgctggctttgaagagaaacgcaatttctcgaggacaaatttttgggttgcagttgtcattgcaatctgttgtgcaaagagatggatgagttgtagaacattgtgcctagtagctataggatggggacatgaggtggacctcttccaatttcaacttttatcgcgcatcctgccttgtcacaaagaaaatttcacatcatttactggaaaacgagtgatgtgtggaaaaagataaaagaaaaagaggtataagattaatataaaaattaaaatgtaaaaaaaaattgtatatcatactagattaagaaaatgtaatatttaataagataaataaaagaaaagttacatacc

SEQ ID NO: 4248 - DNA, 1776 bp, Unknown
  Kingdom: Plantae, Phylum: Streptophyta
cttccagacacacttcactcggtgttcgttggttctcagtcccttctccactctcccctcacaaaataaaaataacactactcagtcccacagtgacacttctttgaccgacctaatcttaatgtcagtcttggccaccgagaaattcattccccccacaatatgtacccaaaaacgtgctccactctactccacctgtattctatctgtttatttaaaaagtaaatattttatttttatgttagcttgcacaccgcgcttacttgctcaccacttgtcacgcaacttccctcatttcctcacgtctttataaaccctcctctccccactctcactccaaactcaatcaactcgatcaactcaacacaaaccaaaactcaagctaaaattctcactctctctctcatctcgagatcatagtatcatattcaatatcatttcataccaaacacatggctttggaagctctcaactcaccaacaacaaccgctccatcttttccctttgacgacccaactattccatgggcgaaacgaaaacgttcaaagcgttctcgcgaccatccttctgaagaagagtacctcgccctctgcctcatcatgctcgctcgcggcggcaccaccaccgtcaacaaccgccacgtcagccctccgccgccacagccacagccacagccgacaccagatccttccaccaagctcagttacaaatgctccgtttgcgacaagagcttcccctcttaccaagcgctcggtggacacaaggccagtcaccggaaactcgccggcgccgccgaagaccaaccccccagcaccaccacttcctccgccgccgccaccagctccgcctccggaggtaaggcccatgagtgctccatttgccacaaatccttccccaccggacaggcccttggcggacacaaacgttgtcactacgaaggtaacggtaacggaaataacaacaacagtaacagcgttgtcaccgtcgcctcggaaggcgtgggctccacccacactgtcagtcacggccaccaccgcgacttcgatctcaacatcccggcctttccggatttttcgaccaaggtcggagaagacgaggttgagagccctcaccctgtcatgaagaagcctcgcctcttcgtcattcccaagatcgaaatcccccaatttcaatgaactcgttgaatttttagtttatttttcgactatatattttggagaattttgagagttactataatttgattttgtacatagtacttggaagttttgttggaccgtaccggacccagttctctggttgaggttgtactttcacaacagtggcagatttgcaattcaattcaatttatttgtttattttaattagtaattttatttgtgaaaattgaaattatttgatctggtttggttttgcgttatgagtgatgatgctcgtgaaatttttgacatgatgaaacggcagagtcgcgtggagagtgcggcaactcgtggtggcagtgcctgtttttctgttttagtatttcggttgaaacaaaccacttgcgcatctttctgactctgtgtcactgaaaagtgaaactcagcatcatcttcatccccctttttttaagagttcacgtttacggtgctttattctatctgcactaatttcatggcggttcttttcagcttttcctttcaccacctatcaatatctacgtttcacttgaacactttagttcaacttgagtctttaggtacaaggttttaaacttactttcaccttacttttagg

SEQ ID NO: 4249 - DNA, 1413 bp, Unknown
  Kingdom: Plantae, Phylum: Streptophyta
atggattatgaaatcgctgagagcactgacaaggccgatatcactgttgatgcaaggagttttagttgggcagtggacagtgcgataaagagtgagactgcgtcaattttgggagaatcccgaatccatagtttttgttccgtagtggacaatgccataaggagtaggactgcatcagatttgggaacatctccttcccctgtccatagtcttgcttcggcagtggccaatgcaatgagcagcagtagtgctgcaccattttcacaactggaaacgtctccttctcctgtccagagtcttgcttcggcagtgcccagtgcaatgagcaggagtaaagctgcaccattttcacaactggaagtggtgcccaacgccactagacatgttcctgcacgattattcacctgggctgagcttaaagcagccaccaacaatttctcacctcacaaccggattcgtcattttggaacctttggctttgggtacagaggcaaactcgttgatggtcgtgaggtcgcaatcgttaagggaacccagtttggtaagtctgaatttgccatcttttcccgtttagaccataggaacttggttgggctggttgggtactgtgaaaacagagatgaaaggctgtcagtttacgagtatatgaagaatgggttgttgcgtgattgcttgcatgataagaacaatgtggacaaggatagcagtgtgttgaattcgtggaaaatgaggatcaagattgcttgggatgcttccttgggaatacaatatctgcataattatgcaaatccatctattattcacagggatatcaagtcttccaatattcttcttgatgccagttggacggctagagtatttgattttgaattgtcgttcatatgtccagaacctgacgatgaatacgatgagattataatgggaaccatgggatacatgtgccctgagtacatgactcgaggtgtgttgacagcaaagtgtgatgtgtacgggcttggagttgtattgcttgaacttttaacgggtaagagagctatactactcgagtctgaggaagatggacctccattttatttggtggactttgcagtgcctcctattttggctggagatttggtcgaaattttggattcaagggttggaccacccgatttgaaagaagcagaggcactgaagatcctggcccatacagctatacgttgtgtggaagaggaaccgaggcaaagaccaaccatgaatgacattgtggtcgatttggatcgggcttttgctatttgtggtagtagcctatatgatgagaacttttcctattccattgcattaccatcacatgagtccaatcatatgactccggatcctcttgatacggactcatgtgatattccaatctacgaagagaatacgaactcatga

SEQ ID NO: 4250 - DNA, 1680 bp, Unknown
  Kingdom: Plantae, Phylum: Streptophyta
cacgcaaccttctgttcctcattcacctcacaccttcatcacaacaaaaagaaagaaagaaacaaagatcgttcattgctttgtagtaagatcagatcatcaaaaatggttttgtcttggtcaagaaggaacgttttccgccgtgccaagaaggagaagtcacaaactcaattggaagtggaggttgtgattcccaaccactttcactgcccggtgagtctggagctgatgacagacccagtgactttatcaaccggcatcacctacgaccgtgtgagcattgagaagtggatcgagggagggaacagaacctgccccgtcaccaaccaggtgctgacaaccttcgacatcatccccaaccacgccattcgcaggatgattcaggattggtgtgtcgaaaatagttcttatgggattgatagaatccccacacctcgtattcctatctcggcatacgaggtttccgacacgtgtaccaggatcttgtcggcttgccagcgtggagatgacaagaggtgtcaggagttggtcgggaagattaaggtttggagtagagagagtgagaggaacaagaggtgcatagttggtgctggtgctggtgctgttcttgcatatgcctttgattgtttctcaagtaactctattgaaaaacatgtggtgcttttggaggaggttttggaggtgatgacatggatggtcccacttggggaagagggtgtttctaaattgagttcaggagcttctttgaattcgttggtatggtttctagaggggaaagaccttgcatcaaggcaaagtgctgctttgttgcttaaagaagtgtgtgttcaagaattggccaaggttggagaagttgttgaagctttggttaagatggttagggagcctattgggagcacttccaccaaggcttgtttggcaacaatttttaacttggtgtcgttggctgcgaatagagagggaattgctcaaagatttgtggagttgggtttggtttcacttttgctagaggctattgttgatggagagaaaggggtgtgtgagaaggcacttggggtgttggattgcatttgtgattgcgagaaggggaaggaggttgtgaagagcaatgctctagccttgcctcttgttgttaggaagcttttgagggtgtcaccattggcttcaggttttgctgtgtctattcttaggaagatttgtgacaagagggaggaagggattctgattgaggcacttcaagttgggctttttcagaagctcttggttctgctgcaggttgggtgtgatgagagcaccaaggagaatgctaccgggttgttgaaactgttgaatggttacaggaacaaagcggagtgcactgactcatcattgaatttcgagcatcttaagaagccattttaattagtgatgaatggcaactagattcatttattctttttttttttttgtgtaggtcaatttattgatacagaattctttgctgtaaaaagatacacacatcaattgattctttgaattcattctttggaaaattgattcgaagtaattagttagatataataatcatggttgtggcaaatacagacaagtatcttcatgtcattgtcttccatatggtatgtagtagtattgttttccgattgatttttgaagcaagtccaataaaccaacaagcacttg

SEQ ID NO: 4251 - DNA, 2493 bp, Unknown
  Kingdom: Plantae, Phylum: Streptophyta
ctctgccatactcgctgttttggtccaaactaccccattgaaaacttcacgcgtagatgcacacatcattggctttactattttgactttcttctttatttggtccaaacttatctcatctgtcacatggaaactgacatgtgagatctcgtgtagagcttcattgatcgagttcagttggtacctccaatacacaaaacgcagtgatggcagaacctagagccaggactgtcaatataacatgtaacaataagctagagcacaacaccaccatctttgttccaaattttgttgcaaccatggagaagatcagtgaacagatgcgcaataccggttatggaacagcagttgtaggtacaggaggacctgacaccaactacgggttggctcagtgctatggtgatctctcattacttgactgtgttttatgttatgccgaggcacgcacggttcttccccaatgcttcccttacaatggcggtcgcatataccttgatggttgcttcatgagggccgaaaactatagcttctatgatgagtacatagggccaggagacaaggctgtttgtggaaacacgacaaggaagagcacaagttttcaagcagcagcaaagaaggctgttttgagcgctgttcaagctgcagcaaacaataaagggtatgctaggaaggaggtttttgtggcaggaacaacaaatgatgcagcttatgttctggctaattgttggaggagcttggacacaaggtcttgtagagcttgtcttgagaatgcatcttcttcgatattggggtgcttgccctggtcagaagggagagcattgaacactggatgcttcatgaggtactcagacacagattttcttaacaaggaacaggaaaatggaagttcaggaggtaatgtactggtgatagtggttgcagtagtcagttcagtgattgttttggtggttggaatagctattgtggtttatatccgcaaacacagatatattcaaatgaaacgaagaggttcaaatgatgcagaaaagttagccaagagccttcaccacaatagcttgaacttcaagtattctacactggagaaggctactaattcctttgatgaagctaataagcttggacaaggaggatttggaaccgtttataaaggagttctggctgatggaagagagattgctattaagagattatatttcaacaaccgacatagagcagcagatttcttcaacgaagtcaacataattagcagtgtggaacacaaaaatctagtcagactcttaggatgcagttgttcaggacctgaaagccttcttatatatgaatatctacctaacagaagtctagatcgcttcatatttgataaaaacaagggtagagaactaaactgggacaagagatatgacattatcatcggaacagctgaaggattggtttacctgcatgaaaactccaacattaggataatccacagagatataaaagccagcaacatcttattggatgcaaagcttcgtgctaaaattgctgattttggtttggccaggtcctttcaagaagataagagccacattagtacagctatcgctggaactttgggttatatggctccagagtacctagcacacggtcagttaacagaaaaagctgacgtatatagttttggagtgttactgctagaaataattactggaagactgaacaatagaagcaaagcatcagaatattcggacagtctagttacaatgacatggaagcattttcagtcagggactgcggaacaattaatcgatccatgtctagtggtggatgacaaccatagaagcaattttaagaatgagattttgagagtgttgcacataggacttctatgcacccaagaaatcccttccttaagaccatctatgtcaaaggcactaaagatgctaacaaagaaggaggagcacttggatttggaagctccttccaatccacccttcatagatgaaagtaccatggaactccatgaccaaaatgatgacccattttaccctctcaatgcagaagattcattggctactatgtctcatagctcattttatgccaggtaaccaagagaatacagagaaaaacacacactatagactagggctacaaactggtttcacttgtgcacgtcaaataacttggccaggcttatgcttatgccatggaggtcactaccagtgtatttgaaattttggataattatcattttaacttcatgcctacacacaaggacagcagttaagccagatttcccataaggataatgggaagcaaatggtgcataaattacatctccggatatgatttgtcactgaagaaaaattgaatgtattactagtttactgtaacaagctactatttatctgtgctttgatctgtaaaacatgttttaatagtaatgtggtcaaggtcagatttttgtatgtataaaaaaatatctattgcaagagacgaatcccttaattgaag

SEQ ID NO: 4252 - DNA, 2670 bp, Unknown
  Kingdom: Plantae, Phylum: Streptophyta
gtttgtttatgcatgcttctccctataaaacagagttcacatttctgtttaaatgcaagtaccaccgtgtagttggttctgcttcatatctggtctcttactttctgcatacttagaaacatctttttccatctctttctctcgcttgtttgaaattttgaataatcatggccttctgtggtggaacttttgttaagctaaactattctgtgtccccatgccacaaatacaaagctccaagtccataccatagctacagaaacaagttctgtgtgagagtttcagcaagtggctcagctgatgaggagaggactattataaagaaagagaaagatgggtggaagatcaattatgcaggagagaaaccagcaactctattgttggacacaatcaactacccaattcacatgaagaatctgtcaacacaggatctggagcaacttgcagcagagctgagggcagatattgtacacactgtgtcaaacactggtgggcatcttagctcaagcttgggagtggtggagttagcagtggctttgcatcatgttttcaacacacctgaagacaaaattatatgggatgttggccatcaggcatacccacacaagattctcacaggtagaaggtcaaggatgcacaccattaggaagacttcagggctagcaggctttcctaaaagggatgagagtattcatgatgcttttggggtaggacacagttctacaagcatatctgctggtcttggcatggctgttgcacgagatctattgggaaagaacaacagcatcatttcagtgattggagatggggcattgacagcaggccaagcatatgaggccatgaacaatgcagggttccttgattctaacatgatagttgtacttaatgacaataaacaagtctctttaccaactgccacacttgatgggcctgcatctccagtcggagccctcagtagtgccttaagcaaaattcaagcaagtgctgaattccgcaaactcagagaagctgcaaaaagcatcacaaagcaaataggaaaacaaacacaccaggttgcagcaaaagtagatgagtatgcaagaggtattataagtggttcagcctgtacattttttgaagagcttggcctatactacataggtcctgtggatggtcataaaattgaagatctggtcaccatctttgaaaaggtgaaagcaatgcctgccccaggtccagttctgattcactgtgtcacagaaaaaggcaagggatatcccccagcagaaaaagcatctgataaaatgcacggggttgtcaaatttgacccaaaaacaggcgagcagtttaaggcaaaatcctctacactttcatacacccaatactttgctgagtctttgataaaggaggctgaaaatgacaagaagatagtggccattcacgcagcaatgggtggtggaaccggcttaaattatttccataaaaggtttcccgagcgctgtttcgatgtggggatagctgaacaacatgctgtaacatttgcagctggtttagctgcggaagggctcaagccattttgtgccatttattcatcattcttgcaacgcggatatgatcaggtagtccatgatgttgatcttcaaaagctacctgtccgatttgctttggatagggctggtttagttggagcagatggaccaacccattgtggagcatttgatatcacttacatggcatgcctacccaacatggtggttatggctccttctgatgaagctgaactgatgcacatggttgcgaccgcagcagctatagatgatagaccaagctgctttagatttccaaggggaaacggaatcggagccactctgccactaaataacaaaggaaccccacttgagatcggaaaaggtagaattctggtagaaggcagcagaattgccattttgggatatggttctgtggtccaacaatgcaggcaagcctcagaaatgcttaaagaactcggcgttgatgtgacagttgccgatgctagattttgcaaacctctggatactggtctcattaggctattagctaaagagcatgaaatactcatcacagtggaagagggttctattggtggttttggatcgcatgtttcacaattcttgagcttatctggtatcctagatggacctctaaagtggagagcaatgatgcttcctgataggtacattgagcatggatcaccccaagctcaggttgaagatgcagggctttcatcaaagcacattgcagccacagtcttgtctcttatggaaaggccaaaacaagctcttctgttcaaataaaaatgctaaatggaataaggatcttgacctgggacctggaagatatatcaaattcttagaagactttttatgctgaaaatgagaattagaggaagctgtaaataactgcactagaattgttggagtatacatcttgggatgctcacatattttggattcttaggtcatcattagtgagtaaagagatgaatttattctgtaggaaccaatcaaggtattgtaatgtatctaaattagttaattatattactgtaattaacaaagcacacaagtcttctaaaatcatgcagcccaatgagcaaaattaaatacgccactttctggtacctaaacaatctttcccttacgttagtcatga

SEQ ID NO: 4253 - DNA, 2818 bp, Unknown
  Kingdom: Plantae, Phylum: Streptophyta
cagttcagttttccacagtcaaacatatcctcagcttcctagaagcagcttccaagacttttttgctggttatcactagcttttgccataaaatcgtgcatcaattttctgtctgtctgtcactctctcctctatatgactatattgagtcttgtctcctctccttatatcatgtcatataccacttttcgaaaataaattcaaatccaaagcaagcttttcttcattgccacccgaatttcaataggacacatatctttgatctttcacagtttcactcaccttctttccatcaataataaagaacaatattactagtaacattaccatgggagatcatagtaactgggaaacttctgaacttagtcataataatcatcatcaaaatcatcaagttggacttgatgttcttaaattcaagtctgttcaacctccctcactacccctctctccctctccagtctccccttcttcttacttgaacttttcatctgctttcagcccttctgagttgttgaactcacctttgttttttccttctccaaatatttttgcttctcctactactgaggccttggttggccagagcttcaactggaggaacggttcaggtgaagaacaacagcgtggcaaggaggatgagaaaaactactctgacttctctttccaaacccaaattcaatcttccttaaacatgtttcaagtggaaccgcttaagaaacaagacatgtggaaattcaatgaacctacaaagcagtctgatttttcatctgagaggacagcaacaaaatctgaatacccttcaattcagaaattttcctcagaaatggctgccggaaaaccagaaatacaaagtaattcagttccagggtctggttattttgactatacaagtgcatctctgtctgttagagaacaaaagagagcagaagatgggttcaactggagaaaatatggacagaaacaagtgaaagggagtgaaaatcctcgtagttattacaagtgcacacatccaaattgctcagtgaagaagaaagtggagaagactttggaaggacaaatcactgaaatagtatataagggccaacataaccaccctaaactgcagtctactagaagaacaaactctcaatcaattaatcaaccttcttcatcgtgcacaaattcagggatatctgatcaatcagtggtgaccctaggaaatccacaaatggatcatttctccatacaagaagattcttcagcttctgttggagaggaaaattttgagcaaacatcacaaaccagttattctggaggagatgaagataaccttggaccagatgccaaaagatggaaggaagataacaaaaacgatggctattctgtctcagggagtagaacggttagagagcctagagttgtagttcaaaccacaagcgaaattgatatacttgatgatggctttaggtggaggaaatatggacagaaagtagtcaaaggaaacccaaatgcaaggagctattacaaatgcacggcccctggttgctcagtgagaaaacacgttgagcgagctgcacatgacatcaaagctgtgatcacaacttatgaagggaaacacaaccatgatgtacctgctgcacgtggtagcggaaactattacatgaacagaaattctctgaacagcagcataccagcacctataagaccctcggcagtgaattgttattctaactcatcaagtttcacaaactctctctataataatactagacatccagcaactggtaatcaagaatcatgttcactggacaagttcaagaaccctggaagttttggctattcagctcttaacagatcaatgagttcacataccgatcaagcgcaatacacagatgctgcacactcaaaggccaaggatgagaggaaggatgactcattccttcagtcatttctctcaaaggactactgaatttgaactggaccacaactttacgtataatcttggatatgtttttgtatagcatgtaggactttagttttttcacagcagaatatagacaaaaaatttgcaaatgtttacttatttacctcatttagattagtgattggcactacagccatagtgacagcaaattgctgctatacctgcctgccaagttcatgtccaaatagaaacttcaactttaccataggattgactgatgaattcagttattcttttgttgtatttgtagggaaaaaggttcttctggaagaatcttccgatatttcatcaatccgtagcatgtgtgcttgttttggcaatttctacttttagtttttatcaaatgatttgtgatgaaaatcaggaggtccgggacttcataatttgtaccaacattgttggttttttaaagtctttgagtaattcacaagatcaaagaaacaagaacgagcacagcaaagtacaaagccaagatctacagcaagattttacgtggttcagcaatgtggttcagcaatgtgcctacatccacagaaaagtgcagctcatcatcatcacattcatcatggagattacaagttcaatacaagcaaaaattagctttaatctctctcggtttctttctaacaaaacctctctcaatctcctagctctctatctcctttcgaactctctttctctctatgaaaatctccctctcttctcatttacatgatcaagtatatatagacacaagttgctagctttaggagcaaaagattttcctttggcgccaagtcaccaattcagttatgacaaccgaatttatgttgtgtatgtctaccgggatgacatcaactaattcaattcttc

SEQ ID NO: 4254 - DNA, 1902 bp, Unknown
  Kingdom: Plantae, Phylum: Streptophyta
aagtttctcaaacgtatatatctcggctattgcaacaccatctctccagattcgattccatgctgccgatcgactaaatacagcatgaacttagctctttattcagtgttattttgtgttcacgcagtctttgcagcaagttctaatgggcatggacacaaatcacaagactggttaaaccatggtggagatctgttcaacagaagatatgcttacaaagagcataagatcagcccaaaaacagcaccgaacctacgtttgaagtggaaattcaatgcaggcaaagacatcagtgcaacaccagccatatatgatggtaccctttattttccaagctggaacggtaacatctatgcagttaaagaagctgatggatcgcttgtgtggaagcagaacttgcagaatctgacaggtataaatgcaactggctatgttactactgtaaattggaccgtgtcaaggtcaactcccacagtagcaggggatagactgataattggagtctacggcccttgtattcttattgctgtcaaaagaacaactggtgagcttgtgtggaagaccactttggataaccatcctgcagcaatcatcaccatgtctggaacatactataacagacatttgtatatcggaatatcttcagtggaatattttgcaccctttgagcaatgctgcacattccgtggaagttttgtaaaacttaatgcccgatcaggtgccatcttgtggaagactttcatgttaccagataacaataacacgagaggagaatatgcaggagcttccgtttgggggagcagcccttccattgatgttaaaagaaaccatgtctatattgcaactgggaacctctattctgccccattacgcatacgtcagtgtcgagagagacaaattaatggaactgagcctactcaaccagacgcgtgtgttgaaccagaaaaccactctgattcaatgttagcccttgatttggattctgggaaaatcaaatggtaccgccagttaggaggcgttgatatatggctctttgattgtgtcgatccttcaactcctaattgtcctcctcaaggtatcaacccagatgctgattttgcggaggcaccaatgatgttgaccacatacgtaaatcgaaccaagaaagatattgttgttgcaggccagaaaagtggcattgtatgggctttagatcgtaataatggcaacctcgtctggtctaagcaagctgggccaggaggggtaacaggaggtgcaacatggggtgcatcaactgatgaaagaagggtttacaccaacattgccaattctgaggccagaaatttcactcttgctccttcaaacatcactacaactgctggtgggtgggtggcaatgaatgctagcaatggtagagttttatggtcaatagccaaccccagtaacagcactgctcatggccctgttagtgttgcaaatgatgttgtcttcgctggatccacggatagaaatggatccatatttgccatcgatgccaagagtgggaaaattttatggtcctatcaaactggagccagtgtctatggaggcatgtcaattagcaatgggtgcatatatgtgggtcatggatatagtgtttggggacctgatctctttaacttttccggtggaatctggctctttggcttctgtgttgagttctaagaatttatgtggttaataagcgtgtttgtaattgttgtgttttaaagaataattattttcattagcttttgtgattgttcaaaaactttttgaaaaatgttttcaaaattatgtgattatcaaacacgtacaaatataaatggatcaataaaacagaaactgttattctgatatattttttgctttccgtgtttctctttatttttactagaatgttaa

SEQ ID NO: 4255 - DNA, 1065 bp, Unknown
  Kingdom: Plantae, Phylum: Streptophyta
atgaatgcttctggtttttggggcttcagccattccaagcacacaagttcctcacagagaaagtatccaacaataatagaagagttgtgccataaattttctctggccgatcttaggaaatcaacgaacaactttgatccaaagagacaaattgaccttagagcatttggtatcaaagtatataaaggttgtcttcaacatgatgatggttctgattatacagtcgccgtaaagcgatttaatgtgaaagacagtcaagcacgggaagagttcaagaacgaaatagagttactctgccagcttcatcaccctaattgtgtctctcttataggattctgcaaccacaaagatgagaagattattgtgtacgagtacatgtccaatggatctctatatgaacggctacaaggtggggaactgtcatggaagaaaagactagagatctgcataggaattgcacgtggactacactaccttcatgctggagccaagcgtaccatcattcaccgtcacatcaaacctagcaacattcttttggatgacaacatgcagccaaaacttgcagattttggcattagcatacagggaccacgttttatgtcaaagccaaaaccaattaacgtagattttgttgtgggtacttttggctacctggctatggagtatgccctgtatggtactgtcacagataaaactgatgtttactcgtttggtaaggttctactagaagttgtgtgtggagggaaatacgtaaaaatggtggcagaaacagaatttatggagaagcctgttgaggagaaaattgatccgaatatcaaaggaaagattgcaccagagtgttggcaagtctttatagatatcacgcatagatgcctgaaatatgaaccagacaagcgaccaacaatgggtgaagtagaggtggagcttgagcatgctctgtggttgcaggaacaagcagatatcacaaacaccaatggtgattataccttattttccaccaccattattgacatgggagtggaactggaatctaacatggaagagattgatactagagatgcttga

SEQ ID NO: 4256 - DNA, 1135 bp, Unknown
  Kingdom: Plantae, Phylum: Streptophyta
atggataaagatataaaacacagattgttctactcatacctcacaaaaggcaaagcttattcccccaagacttatctggcactagcaaacacctctatatttaaaatggttctattttctgatcatgagctggttttgatctttggtctcctaggtaacattgtgtcattcatggtgttcttagcacccttgccaaccttctatacaatttacaagaacaaatcatctgaaggatttcaatcaattccatatgtggttgcacttcttagcgcactgttgcttctatattatggcttcataaagaccaatgctactttgattatcaccattaactgtattggatgtgttatagaagtttcatacctagcaatgtacattatatatgctcccaggaagcagaagatttccactttggtaatgatactcattgccgacattggaggttttggcttaaccatgttaatcaccacctttgctgtgaagggaattaaccgtgtccatgctgtgggatggatttgtgccatttttaacattgcagtgttcgctgctcccttgagcataatgaggagggtcataaaaaccaaaagtgtagagttcatgccattttcattgtccttatttctcacgctctgcgccaccatgtggtttttctatgggttcttcgataaggataacttcattatgttgccaaatgtgctaggatttctgtttggcatctctcaaatgatcttgtacatgatatacaagaatgctaagaagaatggagaaatcaattgtacagagcagcaagaaagggatggcacagtgaactccaaacagcacagctgcaatggcaacaaactcgatttctcttcactggtagaaatgaaagagaatcaactcaatcaagtttgatgttatgttgataagtatctaagttctagagttgatggaggactatatataggcttaggatgaatatcgaataactaatgtctcgtatctaattatactgttgtaataacaactattgccacttggtatgcattgactacgtaatagactaatgatcatagttctggtttaaagcatatggtttggttcctattgaaattcctaaagttctatttcttcatgtttaaagcaacactaaagg

SEQ ID NO: 4257 - DNA, 1176 bp, Unknown
  Kingdom: Plantae, Phylum: Streptophyta
atcctctgttttttccaaacaaacaaagagagcttccttcgtgaacgttcgaaatctctcgcttaagtttctagactctcctacacatgtctcaatttctctcgttctcacaaatcacagaacgtaacataaaaatgaagaagtatccagaaacccaaacacctccctacatatagacaccaacccaacacgcttttcaaacataacatacaagaaaactatcataagtgaccaaaaaagacaacctttggggaatcataaaattcttcagaatggctcgcacaattacaattgcagcaatgtgtcttcttctctcattagtgtccctctgtgtcaccaccaacgcattaatgccatacacacgtagcaccctctgggacatgatgctccaatccgaggacccatttggaatcttggaacagaacccattcaacaacatacccaacatcagaggaggagccgagactctcgccctggcacgtgcggattggaaggaaacccccagcgcgcacgtgatagtgctggacctacccgggatgaaaaagaaggacgtgaagatcgaggtggaggagagtcgcgtgttacgtatcagcggcgagaggaagggagaggaagaagaagaagaagaagaggttgagggcgagaagtggcatagggctgaaaggactaacgggaagttcatgagacagttccggttgccggtgaatgcggacttggagaaggttacggcgaggcttgaaaatggggtgctgaggatcacggtgggcaagtttggtgaggacaagaagaggcagcctaaggttattgacattgctcagagggattctgctgctgagaatgtgaagcccaccaagcctcaaatgtaatgtcatatgtcatcatcagccaatccaattacatatgttcttgcttatgttttccttttttttttctttcagtttacaagttgtaagttgcatcttcactttgtttgggacatgggatttcagtgatgatgtgatgttgtttgtgtctaatagtttctagtgacgcttcttttgttgatcacggatctagtacttatctctcattattttggtttatgatctaagtatcaaatttgggatgacatgatactaaataaatacatgctcaaaatatactgttttctcttatcacctgaaatttagtcttcaa

SEQ ID NO: 4258 - DNA, 640 bp, Unknown
  Kingdom: Plantae, Phylum: Streptophyta
acatttcaaccggtgaatttaactcctaatttgaagtgcaaaaggagcactttctctttgtttcttcatttacctagagaggatatttataattatcaatggctttatcacacagaaggatcctcttcacagttcttcagattattttgttcaccctcatcatttttgttgcttctccagaatctggggtagcttgcaggccattattcttgcactatcaatggtcatgggattatgggcttctcatgcaatcgcttccaaacgcacctgcgccaccgtcaacgggagattcaactcatccctaagcccgtttgaaatggtccaacggattaattcacatattatagctaaggaaatatagaagttgtcaacgaaataccaaccttaatttgtccatacgtgatatgtgtgattcgagtaattacattctcgttgcacatgtttgacgaggctgtagattatttccattcttaacattattatttttagcgtggtttgcatgatttcacatgcaaatgtcttccaaatatatactagttccttgtattcttgtcttcacattcaattaattgtaacaattcacagaatatatatttacttatctgaaaaaatatttaatatattcttttaggtcaattgt

SEQ ID NO: 4259 - DNA, 1056 bp, Unknown
  Kingdom: Plantae, Phylum: Streptophyta
tactactaatagaagagagcctccacaattagtttatttaaatcagtcaaattccttgactttattcctagtaatagtatagcgccttataaatatatacctccatttctaagttttactcaccaatcccacaactcattctcaaatattcattttgtcaccaatcacatctcatttttctaaattcttgtttacacactctcattaatttattacattccatattgtaattaattcttcgtacgtatccatgaagagacagagagatttcaaggggtttgagagcatagatttggcaaattgtctaatgatgctctctcatccccaacaaaatgagaaactacttcaaaaaaaaattgaggctgtggaatttgagtgcaagacatgcaaccgcaaattctcttcctttcaagcattgggtggccatagggctagccacaaaaggtcgaaacttgagggagatcatgaactcaaagcacatgctatatctctaagtttggcaaacaaacccaaaatgcacgagtgttccatttgtggacaagaattctcattgggacaagcacttgggggtcacatgagaaggcacagaacaaccatccacgaagatttttcttcaataaaacaggttattacacaaatgcctgttttgaaaagatcgaatagcacgagggtggttacgtgcttggacttgaacctaacaccgcttgagaacgacttgaagttgttgtttggaaagatggcaccgaatgctggtgcctttgcctgattctttattgttatcagttttgtgatcaacgctgatttgtatttagttttttttttttctttttcggggtgagaatttgtatttagttagtagtcctgtttttgaagtcttgtagtgtattctttaattttttttaacgtgagaattggtttttattttcttcacaatcaactgatgatatatattgcttacgcatgtatagatgaaacaataatatttattggttaactttctggatggtttgatacatttggttgacctttctcttggcagataatatgtaatttcag

SEQ ID NO: 4260 - DNA, 2294 bp, Unknown
  Kingdom: Plantae, Phylum: Streptophyta
ttttaattgaaatttctaatagatcataaacaagtgcatttgagaatagtgtctgttattcgaccaatctaaatccaaatggcatcccaagcacctcagcttcactttgttctgtttcctctcatggcccccggccacttgctccccatgacagaccttgcaacaatattagcacagcatagcaacattgttacagtagtcacaaccccacataacgcttctcgtttatcagaaacttttgctcgtgcttctgactcaggcctacacctccgattagttcaactccaatttccatcacaagatgctggacttccagaagggtgtgagaattttgacatgcttccttcaatgggtatgggcttgagtttcttccttgctgcaaacaactttctgctggaaccagctgagaaagtgtttgaagagttaacaccaaaaccaaactgcatcatctctgatgtgagtttggcatacacagcccacatcgccaccaaattcaacatccccagaatttctttctacggagttagctgcttctgtctcttgtgacagcaaaagttggtcacttctaatcttctcgagagcatagccacggattcggagtattttttgatacctgacatccccgacaaaattgagatcaccaaagaacacacgccaagaccaatgcatgaaaactgatggagcgagtttgtcgacaaaatggccgcggctgaagcggtaagttatggcgtggtggtgaattcttttaaggagttggagccagcatatgcaggggatttcaagaagaccagaaacgataaagtgtgatgtgttggccctgtttcactcagaaacaggaatcaattggacaaggctcagagagggaacaaggcttcaagtgatgcgcacagttgcatgaagtggcttcacttgcaaaaaacaaattcagtaatttacgtgtgccttggaagtatatgcaatttaattccgttgcagtttatagagcttggtatggccttataagcagctaaaaaaccattcatttgggttatcagggagagaaatcaaacacaagtgttgaacaaatggattaaggaatccgggtttgaggaaaagaccaagggggtgggtcttttgattcgaggttgggctcctcaggtactgatattatcacaccctgcaattggagggttcataacacactgtggttggaactcaaccttagaagcaatatgtgctagcgtgccaatgcttacatggccgttgtttggggatcaattcttcaatgagaagttcattgtgcaggtacttagaattggagtaagagttggggtggaaagtccggtaatctggggtgatgaagagaaaagtggggtgttggtgaagaaagaagatgttgtgagggctatagagaagttaatggatgagggaaatgaaagggaagagaagagaaaaagggctagagatcttgcggagatggctaagaaagctgtagaaggaggatcttctcacttcaatgtaacccagctaatccaagatatcatgcaacagtccaacaaaaactaaggattatcttcggtttcggttatcaaaagcatatttatatatactatttcatgagaagttccttatttgcttattagcaaatcagtaagatatataatggtatcttttgtaatcttgaatatttgtgtgtgagcgtgccaaaggattcttgccctatgtttttgctgattatgtaagtccacttatagcacgtttaatgaatcaactaacattagtgatattctttccaaccctcaacaagctaattaggaacttctcatgatatatatatatatatgcctattgataacctaagatgatcgttgtactagcctttgttggactgttgcatgatatcttggattagctgggttgcattgaaatgagaggatcctccttctacagcttttttatccaattccgcaatctctttggccttttttctcctctcttccctttcatttccctcatccattaacttctctatagaccttaaaacatcttccttcttaaccaacaccccaattttctcttaatcgccccagagtacctgactttccacccaaactcttacccaattcttagtatctgctcaacgaactctcattcaagaattgttcccgaaacaacggtcacgtaagcattggcacgccagcacatattgcttctaagccgcagtgtgtcaataccccaatagcaggtgtgatagtatcaatacattaatataaaatacataatacaaatgaaagaaaaacatacaaaatacaagt

SEQ ID NO: 4261 - DNA, 1155 bp, Unknown
  Kingdom: Plantae, Phylum: Streptophyta
atgtttggtggccggttaagtttgttgtttgtagattatatgacgcgctttttccaactcccctaccccacagttggttatataaccaaaccacagacacaaggaacttcaagtcttccattgattccatctctcacatcatttcccactcccgcgtttcctttatcatattcttattccgccatgtcccagttgaacggagcctactatggcccctccatcccgccgccgaaaacctcctaccaccgcccagggcgcggcggaggctgctgctgcggctgcctcttcagcctcatcttcaagctcatcttaaccgtgataatcatcgttggcatcgccgggttcgtgttctggctcatagtccgtccgaacgtggtgaaattccacgtgaccgacgccaccctgacgcagttcaactacaccgccaacaacactctccactacgacctcgccctaaacatcacggtccgaaaccccaacaagaggctcggaatctactacgaccgcatcgaggcgcgtgcaatgttccacgacgcaaggttcgattcacagttcccggagccgttctaccagggccacaagagcacgaaggtgctgaacccagtcttcaagggtcagcaagtggtgccactcaacgctgagcaaagcgcggaactgaagaaggagaacgccactggggtgtacgagatcgacgtgaagatgtaccttagggtgaggttcaagctgggggtgttgaagaccaagacgctcaagcccaaagtatcatgcgacttgcgtgttcctttcaaaggaagcgccgcctttgagaccaccaagtgccactgggatcgctgatggattcgcatctgttttcactcatttcttccttttcatatttctttattgattggttacttttggacataggtccttcagggttatcccttcgctcgaggggatttttgctccattctttatcctttatatcacactcttgtcgttatttgttaataaatcaattttattttcattccccttcttcaattcccttgtttcgccgtttctcaagttgccaacttgcgccgtaatataaatttacctctggattacgcgtgcccaaacacaaaacgtaatgcagtacatgacttataagataaatactatccaatccttaag

SEQ ID NO: 4262 - DNA, 933 bp, Unknown
  Kingdom: Plantae, Phylum: Streptophyta
cactccccttctcccatatctctctgctctccatcaagtcccccttttcaattcacaactaataattctcttcattcattcactcatctgcaaacatggccgataagcaaccccacttgaacggtgcttattacggtcccgccattcccccggcggagcaaccacgctaccgccctcaccgcggcagaagctgctgttgctgtctcttcggaatcttgtggaagattctggttgcacttattgtcctcgttggccttgcaatcctcattttctggttggtggttcaaccccgctacttcaagttccatgtcacgaaagccgacctaacacaatttgattactatagcaacaacaacaccctccactacaacatggtcctcaacttcactgcacgcaaccccaacaagaagctcagcatatactacgacaaggttgaggcattagcattctacgaggatgtcaggttcgccaattacgatgtgatcactcacatgaactccttccggcagtacaagaagagcagcagccccatgagcgctgttttcacggggcagcaagtgctgatgctcaacaatgaacaagtctcagagttgaaccaagacaagaatgctggggtttatgacatctatgtgaagctctacttcaggattaggttcaggcttggggacgtcatatccaatgactacaagcccaaggtcaaatgtcacctcaaggtcccttttagtaaaaatggcacctttactctgtttccgaccaccaagtgtgatgtcgatttctaaggactacacatttgattagattggttttaatttgaaattttctttctttaatccttattttaaattttaataattcattatgtaacttttgtgattatttctttcatttttttgactatatgttggtaatgtatttgttttctggcaataaatt

SEQ ID NO: 4263 - DNA, 1643 bp, Unknown
  Kingdom: Plantae, Phylum: Streptophyta
atccaactgaaaactcatcgtctcttgaaacttttgttctctcttccctctttgttctctttaatttttgcctgattccctaatataagttaaattctcgtggaaaaaaaaggagaaacttttgggatttgtgaattgtgggactaagccatgggattccaaaacttggtgttgatggcttttatgatgacattgattgttattggtcaatacgaacattgcatggctactggtcgtcttcattttcatcatcactcacacaaaaacttaaccaccaaaaaacttcatggtggtttcattgaacgaagtaacacccatttttatctcaatggaaaaccacactacttaaatggattcaattcgtattggttaatgaatgtagcatccgatccatctacaagttctaaggtcagtataacttttcaagaagcttcccaacatggtttgaatgtagcaagaacttgggcattcaacgatggaggttacaatgcccttcaaatttctcctggttcttacaacgagaatgtcttcaagggattggattttgtaatttcagaagcaggaaaaaatggggtacgactgatactaagtctagtaaataactggaatgattatggtggaaagagtcagtatgttcaatgggcaagagaacgtggtcaatatgtaaacaacgacgatgacttcttctcacaccccattgttaaggaatactacaaaaatcacgtcaagactatgctgacaagaaagaatactataactggattgacatatcagaatgatccaacaatttttgcatgggaacttatgaatgaacctcgttcccaaaatgactattctggaaaatcaattcaggattgggtgagggagatggctgcctatgtgaagtctattgataacaatcatttacttgaagtaggacttgaaggattttatggtgaatcaatgccggataagaaacaattcaatcctggatatcaagtaggaactgatttcatttctaacaaccaagttcctgaaatcgatttcaccaccatccatctctaccctgatcaatgggtatcaaactctaatgaaagtgctaaagatgattttgttagcaaatgggtccaagcccatatccaggactcaaacgacattttaggaaaacccattctttttactgagtttggaaagtcttcaaagtcttcaggatacagtgttgataaaagggacaattactttgaaaaaatatacaatttcatattcaacagtgctagcaatgggggaccatgtgcaggtggacttttttggcaactaatgacacagggaatggatgacttgcatgatggcaatgaaatcatctgtgatgagaatccttcaactgccaatgtcatcactcaacaatctaaaaagatgtcaaatctaggataattatatgtaaaaaacttctcttgtaatcaaaatattcattctcactaactatcacaatggtggtgtgagatgatataatatcataataactaataagaagggaaagtcaaaataacactttggatcaataaatgtgtctttggagatagtacaatttatcatgctttattgagcaccctaagttataattaagggtgtgcaaaaacactaaattgaatcattttttatctcca

SEQ ID NO: 4264 - DNA, 847 bp, Unknown
  Kingdom: Plantae, Phylum: Streptophyta
gtccatcttcgattcctcatgtgagccctttcttttcaacccaaaacccatttcttctctcttaaccccaattttctcttcctatagttaggaattaatcttttttgttctccttgtttaattaattgataatttttggtgatgggcaattacatttcttgcaccttggctcctcctttgatgaagaacacaagggcagcacgcgtgatcttccccacgggcgaagtgaagcaatacaaggagcaagtgatcaatgtcgccgagctcatgatggagtgccccactcacttcttagccaactccaactccctacacatcggacgccggttttcgcctctcggcgccgacgaggagttggagtgtggcaacgtctacatcttcttccccatgagaagactcaattccgttgtcactgccgccgacgtggcagtgcttttcatggcggccaatatgaccgcgaaacggataactaacgacaaagatttaatgtcatgtgatcatttagctgaaggtgttggaacaaatgatgatgtcccaaggttgagcttggaaggggtagaggttgagtcagggtttcggaataggtttagttattgtaggtcaaggaagcctgcattggaaaccatcaacgaggaacccatttggttaaggtgaagaaaagtgaaagaaaatagatagaggcggccaaaacatcaatgtacgtagacaaagaggggtgcagcaagtaatagaggtgcaacaagcaaacccaaaatagggtacaaacagcaacacagagacccaaatagaaggcagagcaaagaggatacttaacaaaccttcatacctgaaggatttcgtgtgatga

SEQ ID NO: 4265 - DNA, 1227 bp, Unknown
  Kingdom: Plantae, Phylum: Streptophyta
ttcataaccatttgattaataaattatggttatcctcaacttctttaagaaaccgaaatcaagaggaacaatcagttcagcaaaactcaatcatccttacaaaatttcactttcccgttattctcctcccagacatggccccccaaaacctctgtggtttcatttctcaatctcagcacatcatgaaagcacaccttcttcacttctacaccctctccctcctcttcctcttccccatatcctcctccttcatcctctctcccaccctcttccaccttcaccaacaaatcaccaccaacacaaaccctagctctctcatactatttcttctcctatattccctctttatttctctcttctccacctgtggagtcatcagcatcaccaacagcgtcttccacttcttcatcaacgaccaacctgccatgatgaacctccgatccgccatcaagtccatcccggcttccttctttcccttcctcacgaccacattcatctcccaagccgtcttcatttgcatatctttttcatacgcgcttctcttggttcttctcactcacaacatggctgagcttgcccgcggaaccgggttgttctttgttgcgtttcctttgctgattgtgcttatgtatcttcaagttaactggaccttagtgcctgtgatcgtggtggtcgaatcatgctggggtttggagcctttcaggagaagtgcgaggttgatcaagggaatgaaaggggtggctctatcttccttgttcttctatggattctgtacggggtcatgtgcgctgagcttttttaatggaattacttttaattgggcaataattgtgatatgttcttttttgtttgcgatgattatggcttctaacattgcggtcaatacggtcttgtacatatattgcaaggccaatcatggtgaaaatattgcagataaggagtttgggagggaatatgttaacttggccttccatgatggaaattcgcgtctctcatgttgtttataaatttttaatgtgttttatcttttattcttactgataaaaagaatgttattcaagtcatttggttatttttaataaatcttataaaatatcaaatgagtaccataatatctagattcatagagagcttgatcaacacatagtggtcacaaacaattgatttaataatatttctcaatcaaatcatcttattccttattggaccttcgttttctattcagat

SEQ ID NO: 4266 - DNA, 1238 bp, Unknown
  Kingdom: Plantae, Phylum: Streptophyta
cccgtatatgacagccataatgttaaaaacttaaaatatctcccaaattgaccaataccaaacaaacgctgcatttgcccccttcttacctcttcctttaaagcccaacgcgcatttccaagtctcatcgaaccaactcaacactggtcaacacatctcacactaccacacacacaaacgcacatgatataattcacaacaacgtgcacctccaatattttataccatactataatatatagaatattcccctaaccaaataatactacttttcttcttgacttttctccctctctatgtatatatacccacaacaaaccttcaaacccacccacaaaacaaaccatccatcatcaaatctcccattattcttcaaattctctccaacgttataaaccaccttcaatcaacgttatatatatatcggttattattaattttattttcacgtaatgggcaactacgtttcatgcactttggcgcctcctttgatgaagaactccaaggccacgagggtcatcattcccaccggtgaagtgaagcaattcagagagatcgtgaaggctgcggagctcatgctcgaacaccccagctatttcctcgttaattctcgttctttgcatataggaagaagattctctgctctcggtgctgatgaagagttggagtctggcaacgtgtatattttcttcccaatgaggagagtgaactccgttgtcacccccaccgacatggcggtactctttttggccgccaactccgccgccaagagattgtctggtggaaaggcacgtgttctcccggacaactgcgacggcggagcatggcaacataaagaagagagttcaaaagatggaagtttaagtgagattccaaggttgagtttggaaggagtcgagtcagggtttcagtgtaggttaaattattgtaggtcaaggaagcctgttttggagactataaatgaggaacctgttaggttacggtgatgatgtaatggaactcaattcgtttagcatcagaattttttttagcttcaagagagatttaattagtagaattatacaacacttcacaaaaaaaaatatctgatccctagcattaaatttgtacaaaattcatatatacaaagaaaaagtttgcgtgtgatatgtattgattattattttaatttttggctacaatgaatgggttgagattaatttaattcggactgatatttggtaattctgtatcttatt

SEQ ID NO: 4267 - DNA, 1178 bp, Unknown
  Kingdom: Plantae, Phylum: Streptophyta
attggactagttcatacaataccaattacctggaagattcaaaatgtcgttacgttaatggcgtggagtgaccactagcttgctctttttattatataaagcaccctacactttacttttacaacaagcaaccaaacacttgctctataagagaaaccaaaagcaaccatggcaatgcgttccctttgcttcttagtgtttctagctgcagcaatgcaaggaacacttgcagttgattacactgtcaccaacaacgccctctcaacctctggtggcgtgcgtttccgtgatgcaataggggacgattatgcaaaacaaacgctcgactcagccacccaattcatatggggggtgctccagcaaaacgctcctgctgatagaaaagatgtgcaaaaagtaaacctgttcgtggatgacatggatggcgttgcatataccagcaacgatgagattcatttgagtgcaagatatgtcaatgactatagtggggacctgaaaacagagatcacaggggtgttgtaccatgaaatggtccacgtttggcaatggaatgggaatggccaaactcctagtggattaattgaaggtattgcagactatgttaggctgaaggcaaattatgcacctagtcactgggtgaaagcagggcaaggagagaaatgggaccagggttatgatgttactgctcattttcttgactattgtgattctctcaaaagtgggtttgtggcacaattgaaccagcagatgagggatggttacagtgatcaactctttgttcagctactggggaagacagttgatcagctttggcaagactacaaggctaagtatggcactagttaagaggctatgagagctttgtacgatatttttaaaaataagcgagaatgtcgcaatctatttgtagattaatttgtattaagtctatgtgtattcagcagaatggatgttgtacctaactctgatctgtaagccgtgtgtgtgtgccaataattgaaaatgatgattattctactgatggacaagttaaataaagagacgtttagaggatataaatcattatcagctattctatatttttgctgttgatgttttattagcacatatagaaaataaaaaggtaatatactctgtcttatcccagattgattttctaatatggaaaagactttgcc

SEQ ID NO: 4268 - DNA, 845 bp, Unknown
  Kingdom: Plantae, Phylum: Streptophyta
cgttgacaatttgcgcgtcaaaatctcatagcaaactacaccaatataaatacggccttccgtgtaaccttctgctacacacaacaccaaacattacttgaaggctttcaacaatattcatagtcaaagattgtattttgagagagaaagaagaaaaaggaagatcaagttaatcaataatggaaggtttgattccatatctgattcatgcaatcaagaagcaaaagcctcaccaccacaactacaggagctactctcattctgaaagctcaaaccgcagctaccacgtgctattggcgtctgaatccttcacaggatcttctcacagaagaacaaggtctgattttcagccccccacaagtgagttcttagagcagagatatggtgttgatggattcttggtcagccccagaggccaatttactgctgctgctcctcctcccactgtcaatgttaatgctgcccaacactctaacaatatcaccaacatgcgcaatcgcaagtgatatatatcgtcaagatcataggggatgatcaacttttcttttaattttttggacctttagatgttattatatgtctcttctaaggtttgattcatttgtttaagatgatgattgatgggtgattatcaattttaatcttattgtgtatacttctgatcttgtaacctaatctgtaggggatcaattgtaatggtgtgcttcagtgaatgttataaaatttgtagacgaacaattctcttcccttcagtgacagcccgatattgagtaatcagtacaaagaacttacccaaaattacggttgcattttttatttatttgtggttcttttgttggtatttt

SEQ ID NO: 4269 - DNA, 1607 bp, Unknown
  Kingdom: Plantae, Phylum: Streptophyta
aatacaggtaaaaatagcaaaaattattattcttttctctcggtgtgtgcctgagagagagagagagagagagagaaagagaagaaaaacctccttcgcggaaactactaaatagtttgaatatggaaatatgtgtttcctatagttggaccattctagtcatggcgtgcggaatatccaaggataaatagccagcacacgggtctttggaaacgaagttgaagcggggaagagaaaaagaactagctagcttgctagagtgtgagaactctagcatatactagtactactacattcctccatcttcctttttatttttcaccataaaaaaaccagagcacaaagatggtgagagctccttgttgtgaaaagatgggtttgaagaagggtccttgggctaccgaggaagatcaaattctcacatcttacatccaaaaacatggccatggcaattggcgtgccctcccaaagcaagcaggccttctaaggtgtgggaaaagctgcagactccgctggattaactatttgaggcctgatatcaagagagggaatttcacaattgaagaagaagaaactatcattaagctgcatgagatgttgggaaacaggtggtcagcaattgcagccaaattgccaggaagaactgacaatgagataaaaaatgtttggcacaccaatttgaagaagaggctgctgaaatcagaccagtccaagccaagttccaaaagagccactaagccaaaaattaaacgttctgattccaattccagcatcataactcaatcagaacctgctcatcttagattcagagaaatggacacaacatcaacagcatgcaatacttctagtagtgatttttcatcagtcacggttggtgacagcaaaaatattatcaagagtgaagacatagagtctatggaaacaatgcctgtgatagatgagagcttttggtcagaagctgcaattgatgatgaaacccccaccatgtcatcacaatctttgatcacaatctcaaatgacatgccacttcaatacccttttgctaactatgaggaaactttccaacagagtcatgcttatgattcaaactttgatgatggcatggatttctggtatgacatattcaccaggaccaatgattcaatagaattgtcagagttctgaatttttcatgtgacacgttgaatgagggtattattaaatttggcagatagagtagtttaaatgaaatggtatagcttgaatttgaccgttacaactaaagggtacgataatttctggtgtggggacagcattatcaccagctgcaagatctagaggcatccattgacaaagaaaccagccagagtaatgcgaaaaggctaatgatatgtaatgtacacatgtaatctactagtgaaatcactgactttctttcttttagttgaagacagcgatgctctaacatttttgtattttagaaaattatagtttaattaggctagagttacttgattgtaatatcaataaatgatgtattaagtatgtgaattattcaaaaaatttatgccccttgttgagctttcttgtgcattttctttcgggtttttttattggcatgattatgc

SEQ ID NO: 4270 - DNA, 1967 bp, Unknown
  Kingdom: Plantae, Phylum: Streptophyta
gaccacaccttccatccaatcttcaagctacaaacaactctcttaattgttcgttctttcatccgaaataccatttgctatggcattcaatagcttgtactttcttatgctctgtgtttcccttgtgctatccttcctgacatccatttccatagctgataataaccatgcagtcgttccaccagaaaccatatgctactcaaccttagatccttcttactgcaaatctgtacttgcaaatcaatacggtagcatatatgactattgccgcatttctgttcgaaagtccttgtctcagtctcgtaagttcttgaacaacatgtattcatatcttcaaaatccctcttcttactctcaatccacaattcgtgctcttgaagattgtcaattccttgctgaactaaaccttgagtacttatcaacaacccatgacactgttgataaagccagcgctgttcttcccacctctcaagcagaagatgttcacacattgcttagtgctgttttgacaaaccaacaaacttgtctagatggcctacaaacttcagctccagatccaagagtgaagaatgatctttctttacaactcgcggaaaatgcaaagcttgacagtgtctccctttatttgttcaccaaggcttgggattctgagaacaaaacttcaacgtcatggcaaaaccagaatgatcgtttacccttgaagatgtcaaacaaagtacgtgccatttatgattccgctagaggtcaggggagaaaactacttcaaacaatggatgataatgaaagcgtactggtgagtgatattgtgctggttagtaaggatggaagtggaaactttaccactatcaatgatgccatagctgctgcaccaaataacacagctgctaccgatggttacttcattatttttatctctgagggtgtatatcaagagtatgtatctatagccaaaaacaagaagttcttgatgctaattggagatggaatcaatcggacaatcatcactggcgatcacaacgttgttgatggctttacaactttcaactctgccacatttgctgtggtagcacaaggatttgtagcaatgaacataacattccgcaacattgctgggccaagcaagcaccaagcagttgcagtaagaaatggagcggatatgtccaccttctatagttgtagctttgaagggtaccaagacactttgtacacgcattctctgaggcagttttaccgtgaatgtgacatatatggcacagttgacttcatatttggaaatgcagctgttgttttgcaaaactgcaacatgtatccccgcctcccaatgagtggacaattcaatgccatcacagcacaaggtcgaactgatccaaatcaaaacactggcatttccatacaaaatgcaaccataaaatcagcacaggatttggctcccgtggttggtactgtggaaacatatcttgggaggccatggaaggagtactcaaggactgtttatatgcagtctttcatggatagtttgatcgctccttctggctggcatgagtggaatggaaattttgcactcagcactttgtactacgcagagtatgataacacaggtcctggttcaaatacgggcaaccgaatcaactggccgggctatcatgttattaatgctactgatgcagctagttttactgtgtctaacttcttgaatggggatgattgggtgcctcaaactagcgttccatatcagacatctttgtaataataagtggatatgttacttggattggaatagctgtcatagagtatgtttaatgtgttgttccatatcatctagccacataatgataaatgtggaggatctggtaaaagaatgagtgaatttgtcaaatctgtttacacgaataaattgttaattgcacatttttttatctgcaatattaattattaatttttgctagtagaaaagatttaaactcaca

SEQ ID NO: 4271 - DNA, 1489 bp, Unknown
  Kingdom: Plantae, Phylum: Streptophyta
ctcattgtctcaaaacttttgattctttttttctctctttaattttcacttggttgtacaagtttaactttggagctttgtgtcctgagacaaagccatggggtttcaaaacttggtattgatgatttttatgatgacattggttatttgtcaatatgggaattgcaaggatatagtcaatcctcatcatcacttacacaaaaaaaacgttaccaaaatacctaatgataatggtttcattcaacgaagtgatacccattttcttctaaatgaaaagtcacaatacttcaacggattcaatgcctattggttaatgactatggcatctgatccgtctacaatttctaaggtcactacaacttttcaagaagcatcccaacacggtttgaacgtagcaagaacctgggcattcaatgatggaggttacaaagcccttcaaatttctcccggttattatgatgagaatgtttttaagggattggattctgtgatatcacaagcaggaaagaatggggtatggctgatcctaagcctaataaataattggaaagatggtggtggaaaaaatcaatatgttcaatgggcaaaggaacatggtcaaaaagtaaacaacgaggatgacttcttctcacaccccgtcattaagcaatactacaaaaatcacgtcaagactatattaactagaaagaatactataactggattaacatataaagatgatccaactatttttgcatgggagcttatgaacgaacctcgttgttcagagctatctggaaaacaaattcaggattgggtgagggagatggctgcctatgtgaagtccattgatagcaatcacttactccaaatagggcttgaaggattttatggtgaatcgatgccagaaaggaagcagttcaatcctggatatcaaataggaaccgatttcatttctaacaatcaagttccggaaatcgattttaccaccatccatctataccctcagtggatgtctaggtttaatgaaacagcccaagatgtctttattaacaattgggtccaagtccatattcaagacgcaaatgatgttttacggaaacccattcttcttagcgagtttgggttatcttcaaagatttcaggatatggcgtggagaaaaggaatagtttgtttgagaaactatacaatttgatatacaagagtgcaagtaacagggggtcatgtgcaggagggcttttttggcaactactggccaaaggaatggatgactttcgtgatggctatgaagtcgtttttgaagagactccttcaactaccaatatcattactaaacaatctaagaagatgtcaagtcttgcataattctatttcataaacacattctttccttctaaccaagcattctatcatcttggaataatataatctatagcaataataaagttcatatgactatttaaatacatatttttttaaatattttttctattaaattgtaataaatta

SEQ ID NO: 4272 - DNA, 1806 bp, Unknown
  Kingdom: Plantae, Phylum: Streptophyta
agttctctctcttatactcacagcagctttctgctttctgtaattgagtaattaactcttttgcaaggaagctagctagctatgggtattgagatggagcaaccttgtgtggagctttcaaaagttgcagtttctgaaactcatggggaagattctccttattttgctgggtggaaagcctatgatgagaacccctatgatgaattaaccaatccctcaggagttatacaaatggggttggcagaaaatcaagtttcatttgatttgcttgaaaagtacttggaagagcattcagaggcttccacatggggaaaaggagctcctgggttcagagagaatgctttgtttcaagactatcatgggcttaaaaccttcagaacagcaatggcaagcttcatggaacaagtgagaggtgggagagcaaaatttgaccctcaaagacttgtcctcactgcaggtgcaactgcagccaacgaactcttaaccttcatcctcgctaacccaggagatgctttactcgttccaaccccttactatcctggatttgatagagatttaaggtggagaactggggtaaacatagttcccatccactgtgacagctcaaacaacttccagattactcccgaagccttagaggccgcatacaaagacgcagaagccatgaactccaaagtgaggggagttctaatcacaaacccttcaaacccattaggtgtaacaattccacgttcggttcttgaggagattcttgacttcgtgactcgcaagaacatccatctggtctcagacgaaatctactcaggctcggttttctcttcctccgagttcacaagcgtggcagaaatcctcgaggctcgccaatacaaagacgcggaaagagttcacattgtttatagcctgtccaaagaccttggccttcctggcttcagagttggcaccatttactcatacaacgacaaggttgtgaccacagcgaggagaatgtcgagtttcaccttaatatcttctcagacacagcacttgttggcttctatgttgtcggataagaagttcaccgagaactatatcaggaccaacagggagaggctgaggaagaggtaccaaatgatcattgaagggttgagaagtgcggggatcgagtgcttgaaggggaatgcagggttgttttgctggatgaatctaagtccacttttggggaattataaggccaaaggatcaagggaactaggtggtgaattggagctttggaatgctattctgcatgaactgaagctaaatatctctccaggctcttcttgccattgttctgaaccaggttggttcagggtctgctttgcaaatatgagtgagcaaacgctggaaattgcattgcaaagaatacgtgacttcatggaacgaataaggacagaaagcgtttagttttttttttttttttataatctgtggaagacaaatataaaaaatttacaacaactcaggcactgctgaatcaattgaactaaagtccctcaggacaaagcgcgtttgttttttttcaaatggttatttggactggccattttgataaattctttattcgggtgaagcatgacaacgaacccgaaactcgatcatatcccaggaaagcatatactactgtataaagctgattcagctgaagtgtgccaatccttgtttgcttgctttaattacttgagcaagtttcctcaggaatatccttttgtatcagtatgattattaaagtgaattaccaataataatgaagcaaatctttgtcattaaattattaatcctttgactcag

SEQ ID NO: 4273 - DNA, 1231 bp, Unknown
  Kingdom: Plantae, Phylum: Streptophyta
taacaataaccatagcccactaatgtgccaagctcgagagtctaaaattcaaatcctagcttgggttaacttagatatgagttctctatttttaattttccttatccttcttgttgccgatggggtccttgtccgaggaagtataaatattacagaaataagcttcgatcaaaactatgaggttacgtggggtgataatcatgttgtctccttaaaccaagggaaagaaattcagctcacaatggataactcttcaggatccggttttggatccaagatgtcatatggctctggactattccatttgaggatcaaagtaccagataggaattctgctggagttgtcacagcttactacttaacttcacaaggaagaagtcatgacgagttagactttgaattcttgggcaatagagaagggaagccatatagattacaaaccaatgtgtttgtagacggccaagggaatagagagcaaagaattctcctttggtttgatcctactgcagattttcacaattatagaattctttggaatcaacaccaaattgtattttatgtggataacatccctattagggtatacaagaataaaagcgatattggagtcggatacccaacaaagccaatgcaaatacaagcatctttatgggatggagatagttgggcaacaaatggtggcaaaaccaaaactgattggagctatgcaccattcagagcaagtttccaaggctttgatgttagtggttgtcaagttccaacctcaaatattagccaaaattgttcttctgataagtactggtggaatacgcagaagttttggcggttggattctgtacgacaaagacaatatgaacgtgttaaacacaagtatatgacctatggttattgtgctgataggaatcgatacccagagattcccttggagtgcctttaattaattacccaattaatttactcacatatatgcttaaaaaaattgccattttttatggaattgaattggagcttcttttgagcgattacgtggcagaggaggaggaaaaaagtgttgattcaatttgattatccgagtatcgattgctgttcttgtttagttgtttacccaaatttgatgatgtgcaatcatatttctgttaacatcttttttatattatgtaatgcttgataagtctgaaattgtttaggacaaaccgtttcttttttttagggaagtagctcaaaattgatg

SEQ ID NO: 4274 - DNA, 1549 bp, Unknown
  Kingdom: Plantae, Phylum: Streptophyta
aattaatcatatatcttcagttcattagagtaaacatttcattatatatagcaaaaatgatcagcattatgaaccttactagttccatggccattatcagtgtccttatttcagccttagtttgtgaagctaggcttctccgtgttacacctggatttgttgaaactaagggaacagaacttgtgctaaatgactctccctttctgttcaatggttttaactcttactggatgatgaacgtagctgctgatccaaaccaaagatataaagtttccaatgtatttcgagaagcttcagctataggtcttacagtgtgtcgtacatgggcatttagtgatggtggcaatcaatctctacaaatatcgcctggtctctacaatgaggctatgtttcaggcattggattttgtggtggcagaagcgagaaagtacagagtgcgtttgattctgagcttggtgaacaattacaatgattttggaggaagacctcggtacgtgcagtgggctaatagcagtggtgttcccgtcgccaacgatgatgacttttacacaaatcctgttgtaaaaggttactacaaaaaccatgtcaaaagggtgctgacaaggatcaacacaatcactaaaacagcttatagagatgaacccaccatcatggcttgggaactaattaacgaaccacgctgccaagttgattactctggcaagaccataaatgcatgggttcaggagatggctccctatgtgaaatctattgacccaatgcacttattggaggttggaatggaagggttctatggagactccatcccggataggaaactagacaaccctggtttccaagttggtacagactttgttagcaaccatctcattaaagaaattgactttgcaacaatccatgcttaccctgataattggctaacaggacaaaacgataccatgcaaatggcattcatgcaaaggtggatgacaagtcactgggaagactcaagaacaatcttgaagaagccattggtgtttacagaattcgggaaatctaagaaagatcaagggtatagcatcagcgcaagagattcgttcatgaatgttgtgtattcaagcatctatagtttcgcacaaaatggaggaacatttgctgggggtttggtttggcaacttttggacgaaggaatggacccatatgatgatggatatgagattgttttgtctcaaaacccttctacaagtagtgttatcagtcaacaatcttctaaaatgattgcacttgagcatatgcattgagcattcggcaatctcttggaagagtattggaagatttaagaaaccaattggaaaaatttctagtaatccgcttcttaaatagaaataactatgacattctgtacgcattaaacattatttataataataataccatgggaaaatttcaatgtggattgagactaacaataacactcgatgtacttattacgttgatatctttatctttgtattactatcaacaacttaaagtagtttgagccaaaaactcttatacaattgagtattat

SEQ ID NO: 4275 - DNA, 1044 bp, Unknown
  Kingdom: Plantae, Phylum: Streptophyta
  misc_feature (937)..(1036): n is a, c, g, or t
aaaacgcgtaacaaaaacacaatatattaaggactaaacccaaatcctccttcgatcacacactttccaagttttaattcttcttctcttactcctcccaccttcaagtctctaataattggttatattatatccctaacaaatgggttcctccaagttattgggtattatggccatgcttttcatagtgcttctacccatggctgccaaaggggataatattactgatttctttgataaggtttgtgaagaagtggaatgtggtaagggaagctgcgtagtaaacacaagttacccattaaacttcgtttgtgaatgcgattctggctggaagcgaacccaagatgacgatgatgaatatgccactagctttcttccatgtgtcattcccgaatgtagcttgaactatggttgtcagccagcaccaccgccagttccagagaagagttttccacataacttctcagcttttgatccttgctattgggcgtactgtggggaaggtacatgcaccaagaacagaacacatacacacagatgcgaatgccaacccaattactataatcttctcaacatctcagtttttccttgttacagtgaatgtactcttggatctgattgttcgagactcggaatcaaagttgcaaattcatccactgatagtggcagtcaagatagctcagcctcaatcttcacaggaaggtttcattggatggttatgttgttgatgtccacgggtatggttatgtggagctagtacgcaaagggatagtcaaaattattttggcgaattattgatttgattgttgttcatcaattggcgtttgatgactactgtgtgatgtactgtatacatatacatatatatagttttttgtgtaataaagggagtgagatttgaactttagagcttgtataaactagttatattccacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatggtc

SEQ ID NO: 4276 - DNA, 1982 bp, Unknown
  Kingdom: Plantae, Phylum: Streptophyta
ccgtgactcatttagtctgacttatattgattaattctcatatgcattatagtgatcactagctatacgtcaagttatctcccattccacctccacttcatcaagttatgtagcagttaattaggtaaggccgcagacattcttcctctatatatactagcaataactttagctgaatccttcagagttaagagagccatatatcatggggtactatttggtattcgttggtgtgttcttgtggtgtgccatggctagtcacattaatggactagccatgatggatggaaagttaatgagttcctcggcaaataattatgactatggagatgctcttggcaaagccatcttgttttttgaaggacaacgctcggggaacttgcccgccacccaaagagtgaagtggaggggagactccgctctctctgatggcaaacttcaaaacgtggatttgattggaggatattacgatgctggagataacgtcaagtttggatggccaatggcatttacaactagcttattgagttgggctgctgtagagtacgagagtgagatatcttcggtgaaccagcttggttacctccacagtgctattcattggggcgcagactttatactgagagcccacacttccccaaccaccctctatacacaggtgggagatgggaacgctgatcacaattgttgggagcgcccggaagacatggatacagcaagggcagtgtacaagatagatgctaattccccgggaactgaagccgcagctgagtctgctgctgctcttgctgctgcttcaattgtcttcaagaaaatagatgccaattattcctccacgctattaagcaagtcaaaatcactgtttgattttgcagacaagtataggggttcttactcgggttcttgtccattctattgctcgtactcaggttaccaggatgaactgttatgggctgcttcttggctatataaggcgagtggagaaagcaagtacttgagttactccataggcaaccaaggttggagtcaggcggtgtctgaattcagctgggataacaaatatgttggagctcagacattactaacggaggaattctatggtgggaagaaagacttggccaagtttaagagtgacgttgaatcatttatatgttcagtgatgccagcaagtagctctctacagattaaaacaactcctggtgggcttctatttactagagacagcagtaatttgcaatatgccacgagctcaaccatggtgctattcattttctctaaaatcctaaacagaaatcacattgatagaatacattgtggttctgcgcttttcaccccgtctcagattagagcctttgcaaaaacacaggtggactacatactaggaagcaatccgatgaagatgtcttacatggtgggatttggcagtaaatacccaaagcaattacatcacagaggctcatccatcccttcaatcaatgttcatccgaccaaggtgggttgcaatgatggtctctcagtttattacaattctgctaatccaaatccaaatactcatgtgggtgcgattgttggaggccccgattcaaatgaccgattcagtgatgcaagatctgactattcccacagcgaacctaccacctacatgaatgctgctttcgtggcttcagtgtctgctttgcttggcaaaacgaccgatcgaaaccaaattcaggactctgcagtttccccatatcgatgctagggaaactaatgaagttaattaatgtaacataatcaccgattatatatgtgtcagtggtactagttatttaccctgccatatattgaaactccacttttatgggctggtataataaaatcatacgtactgttttaccaactgccaagtgcttgtgtgttgtttacttgtagaaaagggaatttgacttttgtaagcacaatcaaaatttctcctcaagccatttcacataccttgttatttc

SEQ ID NO: 4277 - DNA, 1519 bp, Unknown
  Kingdom: Plantae, Phylum: Streptophyta
caaatcttcatagccaaatcacatatcttcatcagttcattagagtaaacataacttcatcgatcatagcaaaaatgactagcattatgaaccttactagatccatggtcattctcagtatcctcatttcaaccttagtttgtgaagctaggcttctccgagttacacctggatttgttcaaaccaaggacacagaacttgtgctaaatggctctcctttcctgtttaatggctttaactcttactggatgatgaacgtagctgctgatccaaaccaaagatataaagtttccaatgtatttcgagaagcttcagctataggtcttacagtgtgtcgtacatgggcatttagtgatggtggcaatcaatctttacaaatatcacctggtctctacaatgaggctatgtttcaggcattggattttgtggtggcagaagcaaaaaagtatagagtgcgtttgatttttagcttggtcaacaattacaatgattttggaggaagacctcagtacgtgcagtgggccaatagtagtggggttcccgtcgccaacgatgatgacttttacacaaatcctgttgtaaaaggttactacaaaaaccatgtcaaaaggattctaacaagaatcaacacaatcactaaaacagcttatagagatgaaccgaccatcatggcttgggaactaattaacgaaccacgctgccaagttgattactctggcaagaccatcaatgcatgggttcaggagatggctccctatgtgaaatctattgacccgatgcacttattggaggttggaatggaaggattctatggagattccatcccggataggcaacaatacaaccctggtttccaagttggtacagactttgttagcaaccatctcattaaagaaattgactttgcaacaatccatgcttaccctgataattggctaacgggacaaaacgataccatgcaaatggcattcatgcaaaggtggatgacaagtcattgggaagactcaagaacaatcttgaagaagccattggtgtttacagaattcgggaaatcgaagaaagatccagggtatagtatccacgcaagagattcattcatgaatgttgtgtattcaagcatctatagttttgcacaaaatggaggaacatttgctgggggcttggtttggcaacttttggatgaaggaatggacccatatgatgatggatatgagatagttttatctcaaaacccttctacaagtagtgttatcagtcaacaatcttctaaaatggttgcacttgagcatattcattgagcatccctcggggaactaataacgtcttagaagattagtggctcttccattgttcgcgatttttttccctggcattggggagatttaagagatcagttagaatagctttaattagtaattcgcttctaattaaagtgaaaaaaaaaatacaagtatgagattctgtacgcattagacattgtctataataataataccacgcgaagaatctcaatgtgcca

SEQ ID NO: 4278 - DNA, 1650 bp, Unknown
  Kingdom: Plantae, Phylum: Streptophyta
atggaaaccccaacgagattctcaagttgccgaggcgtggcctttgaggtgaaacctcacgctgatccctttgcaatagtaactacacccacatcccaaagcctctcaaacagcaaacgaatttggcctttagacacttccagagtcttcccttcttcatcacaaagatccttcagcagtgtcagtagccatttctgtgacctcgacgacgacgatgaagaagaagatgctcctgaaagcatctttgaaaaaacctacgatgtagagaaacaaaaccaacttgccgctgtgcacaataatggtattgttggtagcactagcaagtctgagcaaccctcaaagccttcaagaaaaaacgaatcaagactctcagtcatacttctagatcaaggcttgttcactgtgtacaagcgacttttcatgctttgcttaacctttaacgttactggcttggttcttgcagccacagggaattttccctatgcaaggaatagagctgctctattctctattgggaacatactcgccttaactctctgtcgaagtgaggccttcttgcgtcttgtcttttggcttgcggtgaagacccttggaaggtcctgggtgcctctcttcctcaaaacagccaccacttctcttttacaaagcttgggaggcatacacagtggttgtggcgtgtcttcgattgcatggctggtgtatgcattagtcctcactcttaaagatagagacaacacttcaccagagattattggtgtttcctctgccattcttggccttctttgtctctcttctttggctgcattcccgcttgttcgccatctccatcacaatgtgtttgagaggacacatcgttttgctggatggatggccttgtgtctcctttgggctttcatcatgcttactatttcttatgaccctaaatccaaatcctactcaaaagaactcggatcaaggttggttagaagccaagagtattggttcacagtgactataaccgtgcaaataatcttgccatggttgactgtgagacgtgttgctgtgaaagtgtcaagtgcttctggccatgcttcaatgataaagttagagggagggataaaggcagggatacttggtaggattagcccctctccactctctgagtggcatgcttttggcataatctcggatgggaagaaagagcacatgatgcttgcaggtgcagttggtgatttcaccaagtctttggtctcaaacccaccaagccatttgtgggttcgccaagtgcactttgcgggactcccttatttggtgaacatgtatgatagggtcttgttggtggccactgggtcgggaatttgcgtgtttctttcgttccttttgcagccatctaaagcggatgtttatctgctttgggtggcaaagggtgttgagcaaaactttggtgaggaaattaaggaaatggtaagtggggacttaaaagagaagcttataatccatgatactgctgtgcagggtaggccaaacgtgtctcaattgagtgttactgctgcaaagaaatggaatgttgaagtggtaattgtcacaagtaatccagaagggagcagagatgttgtcaattcatgcaaagcagatggaattccagcctttggtcccatttgggattcctag

SEQ ID NO: 4279 - DNA, 1905 bp, Unknown
  Kingdom: Plantae, Phylum: Streptophyta
atgggaggcatttcacaagctttaagcacacaatatattgcatctaccaaaatttgcattttccaaaataaatctatctatcacatactcatggcttccctatatcctccacccttttccattgcaaccaataataatacttccaccccagctgccaccggaacccatgtttctacctcttgttccatccccttaatcagaaatcacaattccaatgccccaaaagttgcgaagtctagagtgtcatgcaaagccacaaagggtggtgaccaagaaaaccaatcaataaaaaacatcaacaaagacacccaagaagaggcctttatgtttgacagaagaaatatcctcattggcctaggaggcttttatggtaccctaagcaatgattcattgtcccttgcagcacctatctcccctccagagataaccaaatgtggcccacctgaccttccctcaggagccaaacagaccaattgttgccctccaatttcctcaaacatcatagacttcacacttccaatcaccccccaagttaaggtcagacccgctgcacatttggtagatgccacatacctccaaaattacaaagaagcccttcgtcgcatgaaagccctgcctcccaacgatccacgaagcttcacacaacaagctaacattcattgtgcttattgtgatggtgcatatcaccaagttgggttcccttctcttgattttcaagttcataactcttggctcttctttcccttccaccgctggtacctctacttctatgagaaaatcttgggaagcttgatcaaagatcttgacccaaattttgcccttcccttttggaactgggatttccccaatggcatgccaatgccagccatgtacactgatcccaagtcaccactttatgactccctcagaaacgcaaatcataaaccgccaaaactcgttgacctagactacaacggcgttgaagaccaatcctcaacacaagaacaaatatcaaccaatctcaacaccatgtaccggcaactggtgtcaagttcaaagactccaacgctcttcttcggtagcccttaccgtgcaggagaagatagtgatcccggtggtggcctgtggagaacattcctcacggtccggtccatatatggaccggtgataacacacaacctaactttgaggacatggggactctctattctgctgctagagaccctattttctattctcaccacgctaatgtggatagaatgtggtccatatggaaaactcttggaggaaagagaagtgacatcaaagaccctgattggttggaatctgggtttcttttctacgatgagaacaagaatcttgttcgttaaggattgtcttgatactagaaagcttggatatgtttaccaagatgttgatgttccgtggttagaagctaagccaacaccgcgttttcgaagagtggttgcaaggagctttggtgctggtgcagcactggctgctgagactactaataaaactactaataagtttcctttggttttggattcaagtgtgagtgctcttgtgaagaggccaaagaagggaaggagtgagaaggaaaaggaagaggaggaagaggttttggtgatagaagggattgagtttgagagggatttgggtgtgaagtttgatgtgtatattaacgatgaagatgatgtgccaggtgggccaagtaagactgagtttgcgggaagctttgtgagtgtgcctcataagcacaagcacaagcatgggaagatgaagactaacttgaggcttgggataacggagttgttggaggatttgggtgctgaagatgatgagcatgtggtggtgactttggtgcccaagtttgggaaggggcatgtcatcgttggtgggatcaagatagagtttcacaagtga

SEQ ID NO: 4280 - DNA, 881 bp, Unknown
  Kingdom: Plantae, Phylum: Streptophyta
aaaaacttcaaaattagttactataaaacccccccttacacttctccaattttcatcactcaaaatcaattagcattcacaaactaagcatcatatcccaaaccctaatcgttgtgatatcctttgttgtgtgaaatggcttccaagggcacagttgcatccacttatgttgctctattcctttgtctcaacatgctttcctacactatggtgagctccacctacatccctgtaatccctgacccatcagtgccttctcaaaagggtacctgccctatagatgcacttaagttgggtgtgtgtgccaacgtgttgaacttggtcaatgttaaattagggtctccaccaacgctcccatgctgcaacctcattaagggtcttgcggatcttgaagttgctgcatgcctttgcactgccctcaaagctaacgttcttggcatcaacctcaacgtcccaatttccttgagcgtaattctcaacaactgtggaaggaataacgctggcttccagtgcccttgaattctttattgctgatccatatccacacattccacatgttgttggtgatctttgtcatgcatatttcatatctctttatggttaattttctcttttcaattcatgttgtgttgcatgtattattattattttttggcgcttgccatcctaatttctcactccttcaacatttgttctactgacggagggttactcatcatcctcgtcagcatctttgattgcatctgtaagagctgtggtatcaataaaattatgtgattcttattaatttccagaattcatttgtcatttttaaaaaatctttataggtacatatacgatataccatttctttttaatttgtcttagcgtgaagcatattt

SEQ ID NO: 4281 - DNA, 1479 bp, Unknown
  Kingdom: Plantae, Phylum: Streptophyta
gaaaacataattaatcttctttactacaatatatataatgccaatggcttactcaaaaagtttttcattcctcatttccattctccttttcatctttcataatttccatgtatccactgcacaaaaaatcaaaggagggtactggttccccggcagcagttttgcagtgtcagacatcaactccacgctttacacccatctcttctgtgccttcgccgacttgaacgcctctacttaccaagtcaccatttcctcctcaaacgcacctcagttctcaaccttcacccaaaccgttcagaaaaagaacccttcagtcaaaaccctcttatccataggaggtggtgcttccaatccatcaacattctccgccatggcgagccaagccggtcgccggaaaacattcatcgattcatcgatacaactagcccgatcgaacaacttccacggcctcgacatggattgggagtatccatcaacttctacagacatgacaaactacggtttcctcatcagagagtggagaacagctttggtcaacgaggctagaaactcagggaagcaaattttgctcttagtaggagcagttttttactcttccaattattactcattgaattacacaattcaggatgtaattaacgcctttgactttgtgaatgtgatggcttatgatttctatggaccaaattggtaccccaatttcacagcaccaccagctgctttatatgctcttaaccatccagcagctaatcgggttagtggtgacatggggatcagagattggattggatccggtatgcctgcgagtaaactggtgctgggtgtgcccttttatggctatgcatggcgtttgttgaattctaataaccgtggattgtttgatagagctaatggttcggcctttggtggtgatgggtccatggggtacagtcagataagggagtttgtaagccagaatagagcagcgtgtacgttcaattcaactgtggtctctgattattgctcttctgggacaacatggattggttatgatgacgtgcagagtgtgtctgcaaaggttgcttatgccaagacaaataatttgggtggtcattttgtttggcacgttggtgcggattacaattgggttctttctcaagcagcttcccggacgtggggatgatacatactagatgaagaggtcaaataaaagtcatgcttgacttgataaataaaattcaggtgctgtttaccctgacatgtattgttgttacagagtataaacagataaaaaaaattacagagatatgcgcactgatcttcaatggttgtataccctcatgacatgtatctctgctttcttaaagcaaaatactagtatatatttaaacaatgaggttggaaatcacttgtacttgctactttaattagatgagatccaactaataatatttatcattttaatttggtagccattagctagccaaagtcgcactatgt

SEQ ID NO: 4282 - DNA, 807 bp, Unknown
  Kingdom: Plantae, Phylum: Streptophyta
atccctacaaacactcttctcttaagctctagtagttaagaaacattagttgaagaaaataagaaacattatacctagctattagagtttaagatggcttcaaaaacttgttcctcccttgcccttttcctcacactcaacctcgttttcttctcacttgtctctgcatgcggttatacaccatgccctggtccaaacccaaagccaaggcccaaccccaaccctaaccctaaccccagcccaagtggctcgtgcccccgtgacgcactcaaactaggtgtatgtgccaatgtgctaaacttggtgaacgccactttgggtcaaccaccagttaccccttgctgcacccttctcgatggtctcgttgaccttgaagctgcagtgtgcctttgcactgccctcaaagcaaacattttgggcatcaacctcaaccttccaatctcccttagcttgcttctcaatgtttgctcaaggaaagctccacgtgatttccaatgtgcctaatcatggcccatgagcaagttgctacgtgcttattcctagttgtggttttccgttgtttttttttttttttgaaattccatttatcatggtgtgattcttgttcgtgcatcagtgcatggatgggtaaattctcgttatattctgccgctttattgattgttttatcaggcaaagtgtcacattaaataaattcccaatgcttaatttcttatgtaaagcaaaaggaataaaaaaatgatagtgttatttatatggcagataaatggttaatgttgcaaatacattttaatatttattgatgcc

SEQ ID NO: 4283 - DNA, 980 bp, Unknown
  Kingdom: Plantae, Phylum: Streptophyta
cataacccccttccaccttcaaaacatcatgagcactatataaaccacaatccacatcctcacaaacactcttctcataagctctagcacttaactagtaatatttattagaatttgctagagaattagaagaataaacataataccccagatggcttcaaaaacttgttcctcccttgcccttttcctcacactcaacctcgttttcttctcacttgtctctgcatgcggttatacaccatgccctggtccaaacccaaagccaaggcccaaccccaaccctaaccctaaccccagcccaagtggctcgtgcccccgtgacgcactcaaactaggtgtatgcgccaatgtgctaaacttggtgaacgccactttgggtcaaccaccagttaccccttgttgctcccttctcgatggtctcgttgaccttgaggctgcagtgtgcctttgcactgctctcaaagcaaacattttgggcatcaacctcaaccttccgatctcactcagcttgcttctcaatgtttgctcaaggaaagccccacgtgatttccaatgtgcctactaagcttatactataagtataacatatcatcttaaatcttcttttgcttcgggtttgctctagttgtggctttccattttttcttcttcaaattctattgatcagagtgtggttctaattgtacgtgcatggggggggattaacttccgatcgctattccttcctttttagtgattttttttatttgtattgttagtgttgcgataaataaagttcctgatgctggcttatgtaaatcgctagggaaccaaaaagatgatgaactagtgtgttatttatttaatttgattgagaaatgattatgtattgcgtacaaagaatccttcttaatatatttttggcttttgtcttttttggtaaatatgagatcaacaactgatcaggtgaattacttggctcgtctaattaacttttgtcc

SEQ ID NO: 4284 - DNA, 1574 bp, Unknown
  Kingdom: Plantae, Phylum: Streptophyta
caactttgttccttgcagttgcagcctaatttgaaaattgattattgcaattcaactaggcgtaaaatcatcacgccttatttgaaaattggtcactgcaataactcaactcatctaagccacgttgcatgtcccagtgaaatcaaacaaatatatagtagtatttatcaatcaaaagggtctataaatactgaaaacttaaatcaaggaagtggagagctatataggaaaaaagcggaagcttgcagcagatcttttggctagagagggcaaggcacgactcagtttaattaaaaaattaatgcttaaagccaaatcaatacttgaagaaaccataaccacactgtaccgtgattcttctccaaactgcatgaaagtggcagacttaggatgctctgtaggaccaaatacatttcttgtgacatcaaatattatcgacattgttgataccacaactacccttttgaattgtgaacaacccaccttccaattttatctcaatgatttatatggaaacgattttaataccatcttcaagtcacttcctgatttctatacaagattggaagaagataagggacacaagtttggttcatgctttattaatgctacccctggatccttccatgggaggctctttcccagtaattccataaacttatttcattctgccaacagtctacactggctctctcaggatccattatctgggttgactgaggaggagaaatcacttaacaagggcaattgtcacctagttagcacaagcccttcagaggtatacaaagcttactttaagcagtttcaagaaggttttaaatcatttctaaaatcacgttcggaggaacttgtgcctggaggagcaatggtcttggtgttaccttgcacttgcaaaaatgaaactctttcaaaaagcctttgggaagtaataagccttacactgaatgacatgctctcggagggtttgattgaagaagcaaaattggactcttttaacataccaacatatgagcctacaattgaggaaatcaggcatttgattaaggaagaagagtcattgtttcttcaaagattagaggttttcacggtgcctagggatgagggtgtaagtgaatgtggtgatgatgtttttcttgatggaaatataagagctgaattcatagccacatacacaagagctgcaatggagcctctcttatctgcaaagtttgacgcacaagttatagatgaattatttatccggtttcagaagaaacttgtgcaaataatgaaggtggagaaatttgagactgctaatttgatgatatccctgacaaaaattgcttgaagaagtactgtttctcaatagaaggacacatcttaaaaagtagtttttcttttgtgattttgatttgatttggtgaaattaagttatggagtagaagatgctacgtactcttattgaagcttgagatctgtatcagtgtgtcacaaatcttaataatgacttgtagtaatatatacttacttatttttctacttaaaacaatatcaatgaaataaaaacttatgtttcaattagaagactggcccaa

SEQ ID NO: 4285 - DNA, 1436 bp, Unknown
  Kingdom: Plantae, Phylum: Streptophyta
gagaaacaactgcgttccccacaatccagtacctgaaaaatccactctctctctctctctctgtccttaaccctccaacaaatatatacccttctttcccacaattctatgatcacaattttctctttctctttctctccttcaaaatcgttgtcaatttcgcctctttctttctcaactcccttagattctctccatcgggtcttcaaaaatgcggatgagctgcaatggatgtcgagttctcagaaaaggttgcagtgaaaattgcagcatcagaccctgtttacaatggatcaaaagcccagaatctcaagccaatgctactgtgtttcttgccaagttctacggccgtgctggtctaatgaacctggttaacgcaggccccgaacatcttcgtccagcgatctttcgttcgttgttgtacgaggcatgcggtcggatattgaacccgatttacgggtctgtcgggttgttatggtccgggagctggcagctatgtcaagccgccgtggaaaacgtcttgaaaggcgcaccgattacgccgatcacgtccgaagccgcggctagcgggcggggcccaccgctcaaggcttacgacatacgccacgtgtccaaagacgagaactccgccgccgcgtccaacgaaactcagcaccaacgagtcaagactcggtctcgagtgaagcgacccctcgccaacaacaacgccaagcccaaatccaccaccaacgaaaacaacaacaataagggaaccgaattgggttcagctgaaccgagtttggtggcatgcgagtggaccgaagaggtgatgaaccggtctggaagtcacgattcgacgctgagccaccagtcggaggcggcgaatgcggtggagagcgagagcatgctgtcggcggagacgccggagacttcgattctcttccgagaagaaccggaaacgaacccgaagcgtgtgagcgatgatgttggtttagagcttacgcttgggttcgaaccggtttcacgtgcgcggcccgtggttccggtgaagaaaagaaggattgagttgaaaaattttagtggctcggctgagagtggctcgtgcaagatggagctggggcttgaatgttcggcttgaggaactcgtggctcggctcagttttgactccatcatcggctttctgtgtttgatacttattacaagagatcagaaccgttttgttgttttttaattactttttttcttttttggtaatttgggttattgttaacccttcctttatttttttcgtcggttgtgaatgcggtgctgtacaaactcaaacatgaatggtaagtagatgaagaggtgcatttcaaaatttatcttgtgattttaagtattttttattttaaaaataagaattgacagtaattcatttagattataaaagatggaaaattatacataaattaaa

SEQ ID NO: 4286 - DNA, 1512 bp, Unknown
  Kingdom: Plantae, Phylum: Streptophyta
ttcttgcactcaatgaaacccatgttacgtgttcttttaagctaatcacataaattaaatgcctatatatctatttatgtgccatcctgaaacaaatcatgtaaggtcagccgaaaagataattctagtgaagagatggatagactaagacgtttgtggatgtctcttcttccatttggatttctgttgttctttagttcagctttcatcggagtacctggtgcccttgcctggagcaaagagggtcatgttatgacatgccaaattgcacaggcacttttagagcctgaggcatcggaagccgtgtaccaattgttacctgaccatgtcaaaggtaacctatcagccctctgcacatggcctgaccaaattagacactggtacaaatataggtggacaagtccacttcatttcattgacacaccggataatgcttgttctttccagtattcaagggactgccatgatccccaaggcgtggaggatatgtgtgttgcaggtgctgtgaaaaatttcacttctcaactcatgcattacaaagaggggacatctgatcggagatataatatgactgaggcgttattgttcttgtcacacttcatgggagatatacatcagccaatgcacgttggattcacaactgacgaaggaggaaacacgatagaactacgctggtttaggcacaaatctaatctgcaccatgtgtgggacagagaaattattctcactggattagcagactattatgataaggatgtgagcttccttctccaagacattgagaggaactacactgatgggatctggtcagatgatgttacatcttggaaacattgtaatgatatctctcagtgtgtaaataattgggccaaagagagcatacaaatagcttgcaaatggggttacgaaggagttcaacctggaacaactctagcagatgattacttcgactcaaggatgccatttgtcatgaaacgaattgctcaaggtggaattcgattagccatgattctgaacaaggtgtttgctgactctgaagaaggatttgcaacagcaacttaggcaggcagacccatcaacataaagttgttttgaatttgttctcaattgttagtccattaacattctgactacaacctgccattgctgtaagttatttcagcatgtactaggcattgcagaattccccaaagctaaagaatgaatcgagaagaaaagaaaaattgaattattgataagcatagcaactagcaaagcaatgatgtgtttttactccaccttttctattttcctttttatattagacctgttggctacaagagactccatcatttgagtcgtgcttcaggaattcacattaggaggtatcgaaaggaagagggagaaaataagatattccatcacctaaagcttgcaagcaaatactccgtccaacgtataataaatgtcgttttacatttttttacacaaaaaaacaaactagtaaataaataaaaaataataataattttt

SEQ ID NO: 4287 - DNA, 1820 bp, Unknown
  Kingdom: Plantae, Phylum: Streptophyta
ttttaattatacttgtatcatattacaaatataataatgaataaattacattaatatatcatttttgtaaaagtacacaaactttctctactagctttttaacattcattcaattgatcacaatgtaacagaatgaacttgtccccgcggataagaatgaccacacaatacgcgtgtagtcaattttctgcatcagataatctctatcaattaactccaacagctgctggaaaagccactcatgaatcagtggtttgaattaatcaattatccctagtgatgggcatgcaactagtggatgaagacccttcaacccgtgtgtgcgctaccttacaagtcacaaaacttcatcaaactcatgaacttactcagtcccttccagcgaggaatttgcaacgaccctcatcgattttcctctatatatattactcctcagctcttttatttagactcacacaagctctagggaataaaccaagaaattatatacgtatacccattaattatgatgaaatcttcttcacatctttctgcaatattcctattgttctttctccttactgccctatccccttcggatggagtttcattctcttcattcctaaagcaattaaaacagaagctggagaagagtcccaccctaaaagatttcctgaaacccaccactataggggatatttattatacgttgaatttcacagaaatcttctcttccgaagagagaagcgcaccaccggtgtctctcatcaaagattacttatcaaactacggctacattgaatcctctgggccattgagcaattcgatggaccaagaaacaataatatcagccattaagacctaccagcaatatttcagtttgcaacccaccggcaaactaaacaacgagactcttcagcaaatgtcgttcctacgatgtggcgtccccgacattaacattgactacaacttcaccgacgacaacatgtcatatccgaaagccggtcaccggtggttcccccacacaaacctcacatacggttttcttcctgaaaaccaaatcccagccaacatgaccaaggtgtttagagattccttcgctcggtgggcccaggcctctggggttttgaatctcaccgagacaacctacgacaacgccgacatccaagtagggttctacaacttcacttacttaggaattgatatcgaggtgtatggtggcagccttatatttttgcaacccgattctaccaagaaaggggttatacttctcgacggtaccaataagttgtgggctcttcccagtgaaaacggtaggttgtcgtgggaggaaggagttttggacttggagagtgcggcaatgcacgagatagggcatttactagggcttgaccactctaacaaagaggactctgttatgtacccttgcatattgccttcacaccaacgaaaggtgcagctctcgaaatctgataagaccaacgttcagcatcagtttgctaacgtagaggactctgcaggccacgtagggcgtttgggagtgagtttaattaccactttgtctcttggattcgcttacttacttctccttttgtattaattaggtctactcgtgcgtcacgctttaccttggttgtaataattttatgattgttgaatgtgcatcagtgcatgttcccccgcgcatgatttctttttgttttactcgtacgtgtcgttgtttcttattggtctttggacatcttgtatatcttaataaataaaagattgttgtttttttatttcattaataatgtgtgagattttacttaatatatatatataggcaatatttattaatg

SEQ ID NO: 4288 - DNA, 1997 bp, Unknown
  Kingdom: Plantae, Phylum: Streptophyta
ctttcttctaacttcgcaccaatctaagatccttctgcatcatcacccttcgtataataccgtctctccctttttgcatttttctctccatcattgacttctgccaagtctttcaaaaagctagctgatcgaggaataatatagcatgcacgaggtcttcgtggaagaacataccattgacacttgccacatgccaagcgagttggtgaggtgaatgttacttatgatgttaattacactacgtccatctcactcttaatttcttaatccgagtcctttagtcaattgctttttagccccttttgaaattccaatctcattctaactttgcacaaacaattttcttagcggtggaaaattggaaattttgttagatatatagaaatattggtgaagtagtggactttattaggagttgatggaacccaatgcactaggtggtggaatatttcctaacataagtagtggtttgctaggagtagaaaaccctttacaacaacaaccaaaccttcaaaaccagcaaaacccccaccctttgcaccatctccaaatggtttcctacaccactaaccacgacactgacacacaccatcaacaaccaccacctcagcaatcaatcaaacatggctacaacttttcggccactaaatccaacaagtcacaaatcacactcagtgatgaagatgaaccagtgttcacagcagaagacaatagctccggagaccccaagagaaaagtgtcaccatggcatagaatgaagtggacggacaccatggtaaagttcttaataatggcggtttattacattggagacgaggctggttcagaaggcactgaccccaccaagaagaaagcctctgggttgcttcaaaagaaagggaaatggaaatcagtgtcagggggcatgatggagaagggttactatgtgtctcctcagcaatgtgaagacaagttcaatgacttgaacaagagatacaagagggtcaacgacatcctaggcaagggcacagcatgtcgggtggtggagaaccaaaccttgttggacactatggatctgtcaccaaagatgaaggaagaagttcgaaagctcctcaactcaaagcacttgttcttcagagaaatgtgtgcttaccataacagttgtggccacaacaacaacaacaactgtggcagtacttccaacgtgcaacaatcaactgatcagccactacatcaacataaccatcaacagcagcagtgtttgcactcatcagaaaatggggtggggagtctaagaatgttgaaagaggatgaggatgaggatattgaggacgatgattcggatgagttttctgatgaggatgaagatgaatcaggagaaggaggatcaaggggtatggaggaggatgaaaatgatcatgtgatgaggaagagagcaaggaataagggaggtttcggtgtttcatcgatatcatcacagatgatgcagcagttgaatggtgaagtgagtggtgtgttgcaagatggagggaagagtgcttgggagaaaaagcagtggatgaagaagaaggtggtgcagttggaggagcagcaggtgagttatcaaatgcaagcgtttgagatggaaaagcagcggttgaagtgggcgaggtttagcagcaagaaggagagggaaatggagaaagataagcttcaaaatgaaaggaagaggttggaaatagaaagaatggtcttgctacttcgccataaggagcttgaattggttaatgttcagcagcagcatcaacagcaacattcttctacctagctaggctagaagaaattactgtgtaaattttatgtatggttaattgaaattttaagagcatatgtagactaggcgaaatagatgaaaatgattgttcattttctgggttcattctatgtaatttcaaatatatagtatgcttgtttgtagacagttttttttttcttgtgttaactgttaactaattaatatctttacatccttcgagttc

SEQ ID NO: 4289 - DNA, 1647 bp, Unknown
  Kingdom: Plantae, Phylum: Streptophyta
gaaacccccctctgcccaaactaaaggttccgctatttcaattcccaaatctacaggctttgtctacaaaacaagcagcgccaacctttcactctgtgcaccgcccatcgcaaacttacaataccacaccacatacatataaataatatctctcgctatggttagcttcgttcccttcccattatttcaatcaaacacttatcatattactaacaaaaatggaactaacattccctcatcaagacgaagatgattccgttgtttctgattgcgagagcggtgtttcgggcagtggagtcgtggtggcaccaccaccaccaccaccacaacaacaacaacgtggttttttcgttaggcttggagaaggtgacgtggttcacgatcttatcaagacaaggtttattcgtggcctcggcatgctcgggcctaaaaccgaggttgtctccgttcgccgaaacgcgtgctccgacgtcgtttcacaggcgcgccttcactcgtttcatgctcacgccagggcggtggcgaggctccgcggcggcgggaatcatgccaacgtgaagtacgcctggtatcgtacgaacggcgaggacgacgtgaacgacatcgtttcgcaaggcttcggcttcgcgcacggcccgaaactcgttctctcccctgacgacgctcctctccaaagtgcgagagggtgtggggttgggaaggacggtgtgaggcacgcgttactgtgccgcgtgattctagggagatcagagattgttcgtgataacacagaacactgctatccgagttgtgaagagtatgattctggagtggatagtttttcggggcctacaaagtacatcatttggagcaatcgcatgaacactcatgttttgcctgcgtatgttgtaagcttcagagtttcttccttcaaagggatggagaagagtgaagaagaacctttgagacctacttcgccttggatgccattcccaactctgatttctgcgctttccaaggttttgcctccatgtgatattgccctcatctccaagttctacaaagataaaaaagacaagaagattttacgacatgaattgatacaaagagtgagagaaatagctggagataagttgctagttgcggccatcaaatcttatagagacaacaagaagaaaccaagctttctacaatcaaggtcaaagaatggcttagcaacgaggataaaataactttcttcacacgagttctttttcttgggttgacataatactaaatacccaaacttacaaggaggacacacaaaactgctttaaaagcagtgtggcatatttgactaggcctttttttaaaaaaaattctattttttgaggtcgatgtagcataggagaaggaatcttttttttttttcttgttttctttttctcgttgccacttgccagtgggaatgatgtcctccgtgaataaggatatatacatgtaggctctcatggacacattgacccaccccaatgcactgtccctaaaattgtacatagtaattttgttgcttcttctttttctcttgagatatattatttcctcacacacgtattaaattagttgtccaatttaatttgctactgattaaattgttaattcattgcaaaagaaaaaagaaaaagtttg

SEQ ID NO: 4290 - DNA, 2074 bp, Unknown
  Kingdom: Plantae, Phylum: Streptophyta
ctcaaatatcaagtctttgtcgtattacacaagctaaaaccactcccctccaccaaattcggtcaaccaacataagtctagttcttcaagccaactaaactcgaacaaaccgtatccgattcatagtttactccctattcccgttttctctgcaatttcgatcagtcacacaacaacaaaaatataaaatataatttaaatagaaacagaaacagcagtttacccaccatcatcacacttgaaaagagtcccatcaaaaaaaggcagaatcttcttatctttatcagcctagctaattaacttggatcacaccaaagacaaactccatacgcatacatatatatgattctaaactcacagttatgataataccgcttatcacatattctgtttcatgacgtctctttttaataattgagctcttcgttcattccctggcaacataactaccatattaacgaacgaatagttatgtttccgtttttcagttactttaacttgttcttcttctgcatgaccctcttcctttgccgcccttgctttcccgccaggatcgtacccgagtccgtaaccgtggtaaccaccgaaaccgaaaaaaccgtaacgcataacgccatgtggcacgacttctccaagttcctacacgccgggcgaggcagccacgtcagcggcatgtcggaactgaaaaagtacttccaccgcttcggctacctctccctccccgaaacgacgccgaatttcacagacaccttcgattctcaattcgagtccgcgctcgtccgttaccagaagcgcctcggcttgccggtcaccggaaaactcgactccggcacgatttccgcgatcgtggcgccgaggtgcggcgtctccgacgccgcacctcacggatttcgcgccacgcgtcgctacgcttacttcaacgggaagccgcgatggacgcgcggaactccgatgactctcacgtatgctttttctccgtacaacatgatcgaccgcgtgagcgtgccggaaatccgagcggtgttcgagcgtgcgttcgcgcggtgggcgtcggtgattccggtgagtttccaggagacgccggagtacgatagggctgacatcacgatcgggttttacctcggggatcacggcgacggagagccgttcgatggagttttaggcgttttggggcacgcgttctcccctcagaacgggagattccatttggatgcggcggaaacgtggtccgttgatttcgagcgcgaagcgtcgagggtggccgttgatttggaatcggttgccacgcacgagataggtcacgtgcttgggttgggtcactcttcggtgaaggaagcggtcatgtacccgagcctcagccccaggagaaagaaggttgacttgaagattgatgacgtggcaggagtccaagctctttatggctccaacccaaactttacttttagttctttgttgcagtctcagaattcattaaacgctgctgttgggttggaaaccggtttctataaatggaccctctctttgcctcttcttgccttgttcgcattatttttatctgcttgattttttttttaatacatgtattttcattctttgatcatatattgttatatgaaaaagaaaaagaaaagatagaaattaaagttcaatcacatgggcgaagccctcgtgattcatcgtatatggtttcttagattttttttttgggcacaatagacgatagatatttgtttaatctgccgaatatatttttttcccatagaaatgaggtacatcatactacttttaagtagggaaaggtgaatgagcttttgattggatttgaggccaacattgaaggacaagacccatggaaaagggaagattgaaaaggttgggagaataaaaaagaacccaatgggaaatccatgaaaaattacgaagttgttctaagaggatataataacattccgtaagtgattggctaacccccgactagtgggatgaactaaggaatctctttgtattggagatatatatatacacataactatcacatggacgtaatacgtatcaatgttaactaacatacccg

SEQ ID NO: 4291 - DNA, 2120 bp, Unknown
  Kingdom: Plantae, Phylum: Streptophyta
atactttcttacacgtttattctagtttgccaaccttgattacatgcagtgtgatcatatatatatatatataaacaataatattggacatatttaaacattgatattggacgatctcaaactcaaattatgattaacttggcaggttggttgtttcaagcacttcagtgtagatctctctcgcttgtatgagattcactatccaatggacgagaatagaagttccaacgaacccaacaagtggaagatgcctctcttcgttttcttcaaagatgcaaggaatgttttcaagctggatgctctatctcgggagatattagggattgcactcccctcagcactggccgtttctgctgatccaattgcttctctcatagacacagcattcataggccgtttaggaccggtggaacttgcagctgctggagtttccatttctttgttgaaccaagcttcgaggattaccatattccctctggtcaacattaccacttcctttgtggctgaagaagataccattcaaaaactgaacaccaaagcagctgaaaatggtaatagtaaggccaagttcggcgaaacaattgtgccagaggatcatatgcttcaagacatggaaaaaggtacccccaaagtgatgaatactgacgctccaacagaatttagggaagataaagatgaatcacaggaatataatgctaccggcaacaatgacacaaatattggagatggagccaatacaatatgcaagttttcatcggttactagcagtaagaagagtaaggacaaagttggaaagaaaaagcgacttattgcttcagcatcaacagcactactttttggcacaatccttggtctcattcaagctgcagttcttatatttgcaaccaaacctctgttaggtgttatgggtgtcaaacgagattctcctatgctaaaacctgcagagagctacttaagattgagatcgttcggggcaccagcagtacttctctccttggccatgcaaggcatctttcgagggttcaaggatacaacaactcctttatatgtcatcgtttcgggatatgcattgaatgtcatattggacccaatttttattttcacattgaagttaggcatcaaaggtgcagccattgcacatgttctctcccagtacatgatggcattcactctcttattgatattaatgaaaaaagtgcatctcctacctccaagaataaaggatttacagattttccgatttcttaaaaatggaggattgttgatgctaaaggtaatagcagtcacattttgtgttaccttagcaacatcattggctgcaaggctaggttcaattcccatggctgcatttcaaacatgcctacaggtctggatgacatcgtcccttcttgcagatggtttggctgttgctgttcaggcaattctagcttgttcttttactgagaaagactataagaagcaacagcagcagcaacaaggacactgcaaatgagttttgttttgggagtggggctctctcttgctgttgcacttggattatactttggagctggagtgttttcaaaagatgctcatgttgtgcacttaattaaaataggcatcccgtttgtggctgctactcaaccaatcaattcattagcctttgtatttgatggagtgaactatggagcttctgattttgcatattcagcatactctctggttctggtgtcactagtaagcgtagccacagaattcattctctacaggaccaaacatttcgttgggatttggattgcattaaccatctatatgactcttcgcatgttggctggtatatggaggatgggaactgggacaggaccttggctctatctcagaggtcgctcactgccttagcataaataactaatcatcagggaaattttgttgtcaagtagtacatcttttgtatcacattgtcactttttcccagatctttagaacttttttattcttaattttcccatacttgtaatacatattggattgctttattttcacgattatacttttgtgatacatcaatatatctaggattgcttcctttacaaatcatatatagtgaatactactcatttgattttgtggttacagaatat

SEQ ID NO: 4292 - DNA, 1865 bp, Unknown
  Kingdom: Plantae, Phylum: Streptophyta
cccatctcttgttaagcttgtaattaaagatacaattaagatagatcgcatgtataaaataaaataaattattgtaattttatgtcggccttcactattgcaacccttttcagcaccgacctactgtgaaccgtcaagtttgttcactccacacaaaagcaaccctatttttcagttttcacacctaaatcctttgacccatcatcactattaatctacaagctccatgttttgtttgcaatttgcttagtcaacttgttggtatcatcagagctttgtgaaacataaagttaaagcagggcatattgcagagggagcaaaccgaatatttcaaaacttgttctactttttattatcactgttgcatttatttcagatatttagtatttgcctacaagtttgttctttagtttaaacacagacaagacgactctttatggcggctataaccaatttgaacttttcttccttgtgtaaaaaaaggttttgtgtgcgtttgtgcgtgttggagttggctttttgaagtgggtgcatgctgaagttatatgtgtatgtgaaagatgaagaacaatagagataaagaaaagggtaacgacgttgaccagagttacagacagcatcacacgttgtcaatgccaatgatgttttctggtttgaacagagagaaggagatgtcagccatgatctctgctttgacacatgtggtttgtggagaagatgagcatcatggtgctgattactctcttcttaatcacaatattaataatactaatagtgcagttgttggtgatgatgattttactgtaacatcaaatatggcttctggttctatgccaccttcttctacttgttcatctcaaggtggcaactctgttctcaagagaagacgggaatatgataatacaaatgatttctcacgtggaggttcattccctgctatttcaacaattgctgaaagttcaagcacggtaacaagaagaacggcgaatacagtatacgattacgaatacagaacagagaacgtgaaagtagtggaggaagaaccgaggagaaaatacagaggagtgagacagaggccatggggaaaatgggctgcggaaataagagaccctttcaaagctactagggtgtggttaggaacatttgaaaccgctgaggacgcagccagagcctacgatcaagcttcattgcgtttcagaggcaacaaagccaaactcaacttccctgaaaacgttagactcagacaacaacaagaacctccgttgaacttgaaccctccaccacctaatcatggggctattttgtcaattccttcaaccactgttcacactgaggctcttcagggttcacttggttcaagcaatttttatgagcattcttattcgcatcttcatgagtttcccgtgagtctctacgatcagattgcagagtcaacatctactactatggcttctcatcatcttcaatttttgccgccagcttcttcctcaactatgactatgacatctccgcaggcaccaccttcgatttatcctacgcatccagcggcatggtcttctggttatagttataatagctcttcttctgcttcggggtgatgtaaattgcgttttatttcaagtctctctcgtttttgccccttgtattgtatcattgttactctcctctgttttttgcatttgcaccacgaccatttccatccaggagtggttttttgtgaccatgttattatgatcaagcaaatcatataattcacagttaacagtttagtatctgtgtataatagagttttatttatcctcccatcacatttctccaaacaaccatatcaatcttatatctcttccttcttctaacagtttaac

SEQ ID NO: 4293 - DNA, 841 bp, Unknown
  Kingdom: Plantae, Phylum: Streptophyta
atagcccattgtcttttaaaaaaccaccactttacttcccctggttttgcaactttaattttcccatgtgcttctctctatataataaagaccaccttcatttcatttcctcattcattcaactaaaagcaagaacaattactttagtgttttctcttgtcacataaaagtcatctaagaagaattacaagatcatcatcacaataacaagatgagttcaggaattagagcatggagtgtggcagcaagtgttggaattgtggaggccttgaaagaccaaggtatatgcaggtggaatcatgccttaagatcagctcaacaccatctcaaaaaccatgttggctcattctctcaggctaacaagctttcttcttctgctatgatctccacaacactaaaacatgagaaggcaaatcaatcagaagagtctttgagaactgtcatgtacttaagctgctggggtcccaactagatatcataagcccaacaacaaaatattcttttctcttttcaattctaggaatcaagcaagcttaattagtctcaaatgatgatgagtattgaaagaatattgtttgtctttatggcagtcattatgtaaagtgcctaaagtggcatggtttaattgatatcataagatgcaaagttagttgcactattaagtgagactaattaattaacatataggctctaaacaaaggaccaaatttcaataattcaatttgcttcccgtgccgaaaaaatcgctggcttttcttatcattggtttctaaaaacttttgacatttaccttaaactcaatgagaattgtacatgcaacacattagtattcattgcaagc

SEQ ID NO: 4294 - DNA, 2089 bp, Unknown
  Kingdom: Plantae, Phylum: Streptophyta
gcagcgcataaaaataaaaataaaaataaaaacaccaaaaataaacctatataaaccgtctcctcccgctataaattttcagctcgagtcaccaaaacgaaacacaaacagtgttctctctttctttctttctttctgtctgttgtgctctctgaacatgttgatggattccccctctcgctcctccgtcatcatcgtaggtgccggcatctccggtatcgctgcggcgaaggtgttggccgagaacggcgtagaggacctggtgatcctggaggcctcggaccgcgtcggcggcaggatctgcaaagagagcttcggcggcgtgacggtggagctcggtgccggatggatcgctggcgtcggcggccagcaacccaaccccatttgggaactcgccgctcaattcgagctccgcacctgcttctccgactacagcaatgcgcgctacaacatttatgatcgcagtgggaacatcataccgagtgaaatcgctgctgactcgtacaaaaaagcggtggactcggcgattcagaagttgagaaaccaggaagaagaagaagaagcatatggtgatgatcattgtaataataatattaaaaatagcgaaacgaaactgccttcgacgccggagacgccaatagagctcgccattgatttcatcctgcatgatttcgaaatggctgaggtagaaccaatatccacctacgtagattttggggagagagaatttttggttgcagacgagagagggtacgattacttgctgtacaaaatggctgaagaatttctcttcacctcagagggtagaatcttggacaatcgtctcaaactcaacaaggtcgtccgggaattgcaatattcaaaaagtggtgttacggtgaaaacggaggatggtttcgtttacgaagccaattacgtgattctgtctgttagcattggagttctccaaagtgacctactcgccttcaatccaaccttacccagatggaaattggatgccatcgagaaatgtgatgtgatggtgtacactaaaatctttctcaagtttccgtataagttctggccgagtggacccgataaggaattcttcatctatgctcacgagcggagaggctactacacattttggcagcacatggagaacgcgtatcctgggtccaatatgttagtggtgacattgactaatgaggaatcgaaacgtgtggaagctcaagctgatgaagagaccttgagagaagctatggcagtgctcagggatatgtttggacccaacatccccaatgccattgatatacttgttcctcgctggtggaataacagatttcagcgtggcagctacagcaactaccccattatttccaatcataaactttttcataatattaaggcccctgtaggtcgcatttttttcactggagagcacactagtgaaagatttaatggctacgtacacggtggatacctggcaggtattgacaccagcaaagcgttactagaagaaatgaggaaggaaaaagagagtcaaactctgttgttagagccattgctagcatcattaacaatgtcgaaaccagaaacagtctccaatatccacaagtgcgatattcctacacaattatatctcagtggcaagcttggggtaccagaggccatattatgacgactatatgggactgtaccttctagtctagatgatgcatatataatacttatgctgaagtggggggcctgcctcatccttaactctcattcaagtccttggcgctgccattgcccattggtgatggaaattaacaagtcactgaagtaagatgtggtgaggggaagaagtgttggaacactgcgatgtctcctcactttagtccctttcactggtaattaatgaagcttaattataactactaggttttaatttttgaagagaattaattaattgggatacacttacgattactttgttctttatagtcagaagcaagattacattttatggataatggctgatatgtatgtggatcctaaattttttactggtcaacgatatccatttaaattttcttgcaatgaactcgatttcccaggctgaaaa

SEQ ID NO: 4295 - DNA, 2683 bp, Unknown
  Kingdom: Plantae, Phylum: Streptophyta
aaaaaaaaatagagtcaaacctgtactattctctccactattctggacccacgttgtggaaaactcgttcagtttggctagtcaaaactatcttctttccattcaaattcccacccttacatatatatcactcttcttctcaccttccccaagcaagtcctctcgatctgtctatttcacacgcaccttcacttccacatttgtagcttatatctcctcacttaagcaccctcttatttggcatatcagtagctcactttggcttgttgagagcaattcagcaaccacaggccttagctgcaactaaaagtaggagagcaattccattgccgttgcttgttattagttcattttcacaaaatggaagagagcaccaagaggaaatacactaatctgatccatgaactaatccaaggaaaggaactaacaaagcagctcagtgaccatctggtttcatcttctccatcatcccatgaaaccaatgaattgttggttgagaaaatacttttgtcctatgagaaagcactcaccatgttgaactgggggtctattgtgggagaagccaaaaccaccagtctcaacatcatggattcccgttgttcttttacaaatagtgaaagccccagaagtgaggtcgtggaccgtgaatttgagcacaaagctgtcttcaagaaaagaaagaccatgcccagatggaccgagcaagtgaagatttgctcaagaacaggacttgaagggtctttggatgatggatatagctggagaaaatatggccaaaaggatattctcggagctaagtttccaagaggatattacagatgcacacagagaaatgtacaagggtgtctagcaacaaaacaagttcaaaggtcagatgaagacccaacaacaattgaggtgacctacagaggaagacatacatgcacgcaagctaagcatttaaacaaggcattctcatcaaacataaagataggtttgggggaaaatcaattccaaaagaatcaaccacttctagagaaaacacaacaacagaaccctgaggggattttcacctttgaaacagagcttaaagtcaaaacagaggaattggaaaccaaggaggatatcttcccatggttttccttttcttcttcatcaattggatcagaaaatgaggataacatgttacccgacaccatgattgaaaaccatttcatggaaagcttttctcctgtattcatatcaccagcgacttcagaatcaaaccctttctgtttgtcagcatacgacttggacagcactggactattatgccgaaacatacaaacctcagaatctgatatcactgagatagtttcagccctaacttcagtcaccaactccccaatcctggatttggatatcttacttgataagggggattttgacacggatttccctttcaacattcctgaatttttctcttcataagaacttccctgcagttccacgtagatagttagagagagtaagagctaaggacagcatagccatagtctgttctggattaactggtgagccgtagatcctgactatggaagggtaatcataagtcatgttgataaatcaagacaatgaatcatccctgtcatgcaagtttggagagttttcctgtatgtaatgtaccttcacctaggatgtaatgcgtatataatttgtagctgtagtctaccgttttcttacttctcttgtaattggttcaagcagggttgaaatttctgaaatgaatgagttttcctctcatagttgttatctagaattttgattgtgatcaatggtcaatgcatcatgtcatatgccttcttttagcccatcacttaatgttaattgttagtttgtattagtgggtggattcgaatctacaacctttctcccctctcttctcccttatctatcaagtcaaccttatatctccatgattttgtattttctacccaataaaatgacctctctctacctctccacctaatggtatgtaggatccagatttccttaatatcacagaattcacgcattgagtcaatcataactgtttgatgaagataaaacggtttacatttaaaatcaagtcattcgatcttcatcaacagtatgaattcatgactgcatgaatgcatggaatccatttccctggttatgtacttgtcataaaagaatgtggtactccttgagaccagctagcaaaatgtgtgtcatgtctctcacctgattaagagtcaaaacaagttgtttaagtgattcatctgttcagcacagtcaaattccatcaaactgagtcttagcccattatgatccaggttttcaaccctgctcaattttcctattttttttttctttttctattggaaactctcatagtcgcagtcaattcacttttctaattgatttgaagccgagtttattttttaatcataattgcgaaaacaatagtaacaacagtaagatagggagcaagaagaaatgaggcagacgcctggtgcatattgtattacaagcagatatagcaatcaagggtgtagatggagactagatatcacccatccttcttgcacatttgatacaatcatccaatagcatcttggcgtcatatttgtatacaaagcctttgtcacacagctttgttgaggcccacttgatatccttcttcagcccatcttcatatctg

SEQ ID NO: 4296 - DNA, 1819 bp, Unknown
  Kingdom: Plantae, Phylum: Streptophyta
gctagttgctaccttgagatgcaagcctctgtatggctctctctataaatagtggatctctcttcttcccccatattcacttctgatttgattcttttccccactttcagaacatcaacaaagtagagagagagaaccaaaaaaaaaaaactactactcaacaaaaagagctagagagaagataccccttaaatcctaatttctacctcaaagaaagtactcttcaaacattttgtattcactgaagaaggatctttgcacttgcacctgcagccatctaccatggttaagtcagaacacaagatcaaaaccgaaccatcatcaaaggcaatgcggttatcttcaccctcatcatcaacatcagattgcaagaagaagaagtacaagggagtgagaatgaggagctggggatcatgggtttctgagattagagcaccaaatcagaaaacaagaatatggttaggctcttattcaaccccagaagctgcagctagagcctatgatgctgcacttctatgccttaaaggctcctcagcaaatctcaatttccctttaagctcttcacaacaatacattcctggagatgctgtcatgtcccccaaatcaatccaaagagttgctgcggccgccgcaaatagtttcatcgacaatgccaccactcccccttccccacctccggcttcgaccccatcatcatcatcattggcctcatccccctcattggtttcttctccctcggatcaaatcgatgacgacgccttgctgatatcgtctttccaagcctacactagttgtggtcaagcaaatcaatcaatggctgtgaatgtgatggagccttggtacacctttggtgatggtcttcaatcccccaagtatgctgatcagatgctaagtggtgatttcttccatgtcgattcttcccatctgcttgatgatctatacgaagaaagtgacattcgtttgtggagcttctgctgagaaaaaaaatcaattcaagccacctacaatatttcttcttttctcaaaaattcaattcgtttgtcttcagtggtatagcttgaagatgttactgactgtgaccaaattaaaatttgtataccctatgctacataaatggtgcattttagatgaaattcatatagagataagacaattttcggcctctcatgtgaatttctaagagtttgaaattatgtatcatcgatacaaatcttggtatgtcaatgtcatgaatggtttcccatgtgtcacagaatataagggagaaaaaaaaatgtagtcaccaaaatccttaggtataagcaattcgtttcactgtttttggaatgtaactatgggaggagacttttgctattgtgagtatctttggaaggcctttgttgcatgggaaggtatcagagatgcttatttccaattcagtgagaatagggaaccatgtacagagcgtggtaacttgaaaccattggaaaaattgcatcttttctaagccttgtctgctctcccgcgtgcccaaagaacaaagagtgttcccttgttttgatgtttaagtttggtattttataccctattctattcttcttttagatggaaataaatcctggttaattttcattttatgcatagtgcatagtgatcggttttgtactgccccggagctgaaaccctttccctccctcagttttgggttagattttggtaatgcttttaattaattgagttggtagaggcaaaaaaagattaataataatgtaattgaacatgaaagatgatttgattgtatgatgattactttaaaaaaaaattgttctttaattgggcc

SEQ ID NO: 4297 - DNA, 1990 bp, Unknown
  Kingdom: Plantae, Phylum: Streptophyta
ataatcgttattattgtggaatcacaagggttgttactgaacatgaaactgcataaatatgccacaggtgcaagacaaaacaataatctctgctttctagtttctactctcacagctgtttattttcttcctcttctcaactgtgttcgtgtgtatgcatttgagttgaaagccagactcaaggagctgaaagacaaaagaagaaacttggatttgaatcagccaaaatttgagttacacgtaattgcaaagataagatgagtgttatgtatagtcctgttctcaattactcagatgtggagcatcagctaaggaaaaaccaagacatggattcaagtattggacatccacaacaacactgtcaccaacccaattctggactattgaggtattgttctgctccaagctcattgctggcaagcctcattgacaacaccattcatggctgtgtcaacgaggaatcgttcacaagtgagaatcatcatcatcagcagcagcagcagcagcagcattatcttccatctacaagttcagaaatggagaccatgttatccaaattgctaccatccaacaatggatggagcaattcagaagctttgcaagaatttggaggcaagcctgtgaagcaggaaataggggaatctattccacaagagccaccacaacagaatggttattcttatggtggctctcagttgatttaccaatctcagcaaattcaaggcttgccaaatggtggatcttccagtgcttctggcagtgcttttgatggctcttttggtgtggtgcactccatggcttcagaggactccattcaatctaaaatgggtatcaggaattgctccaatctctttaggcaaaagagttcccctgctgcatttttctccattgaaaatgatcttgcagcattgagagaagtaggaagctttaaagccgatgatgtttcaaatggactagttactgcatcaactggtgggttgcatagttctcatactttctcatctaggccatcttcatgcttgaaacggttgccacaaatagccgaaaatggaaatgaaagcctagaagaaaattgtgaccaaagtagaaacctagtaaatgacaatggtagctcaaaatgttacatacctagcttcaccaatgaattatgggaaagttctgcattcaatgccccaaaaacagagaatgaagatgaaatcatgttttccacttcaaatattttggaatctcaggaagcagatttcagctttcaaaatctgggtttgactcaccatttgagtctacctagctcttctactaagatgtcatccatagaaaagtttcttcagattcaaggttctgttccttgtaaaattcgagccaaaagaggctttgccactcacccaagaagtattgcagagagggtaagaagaacaagaattagtgaaagaatcaagaaactgcaagacctttttccaaaatcagaaaagcaaacaagcacagcagatatgttagatttggcagttgagtatattaaggacctgcagcaaaaagttaagatactctcagattgtaaggcaaagtgcaaatgtacaagtaatgagaagcattacactagaacttgtgcttgatttatttgcatgtagatagcaaaaggatggaagattttttagtgtgccaaagttagcaattgtaattagataaaataatgctgacatttgcctggagtgagtttaggaccaggtgaatttttttttttacttttttttttcattttttcccttaatttctttttcttcatagtttgatttaaggatcataaagacctagcatgtttagcatgagttttgtagctcttcattattacatataagaatttatgttgaaatttatatggagactgcttttgaaactaaaaattatgatcttccctccagtcaggttcgaatatataaaatgttttctgcccactaagatacactatcagtaaaaatgtccggtactgtatgag

SEQ ID NO: 4298 - DNA, 2229 bp, Unknown
  Kingdom: Plantae, Phylum: Streptophyta
aagaaataataaattaataactaacatttgagaagttattaaagagagagagagagaaacagagcccgcacacagtaaggtttacggttttagttaacagaaaatatccaccacgtatacaaaaagcagcatccttgttggcgttttgaaacggccgtggctccctagttttgaacaaaacctgtgggttggttgatttggttctctttctctatccagtttctcccaaaccctctcactctaaccaaacacaaaaccatgggcagtttctgtctgctccaacaaaaccagttgcttctaaaaactcttttctctgttattataaccttagccttaacccattctctttccctgaaaacccaatccatcaccaactcctgtgtaatcccatccttaaactcactctgctatttcgcttttctctctctcaacaaaaccttcattgatgttctcatgcttgtgcacccttttggcactgttcaaccattcgattaaagggtagtggaatgttctctgggttggtaggagtggaaaaccctttacaacaacagcagcaacaacaacaacaacaacaacaacaacaacaacaaaaccttcaccatttgcaacaccaccacccccaaatggttccctatgccacacaccatgacactgaaaaccctcatcatccacaccttcaccaatcaatcaaacaagggtaccctcccttttcatcccagaccaaacaacaacaatctcctctcagtgatgatgatgagccagggttccctgctgatgaggaccccaagagaaaggtctcgccatggcagagaatgaagtggactgacaccatggtgaggctcttgataatggcggtttattacattggtgatgaggctggctctgaagggactgataagaagaagtcatctggtttgatgcagaagaaagggaagtggaaatcggtttcaagggctatgatggagaaggggttctatgtttctcctcagcagtgtgaggacaagttcaatgacttgaacaagaggtacaagagggtgaatgacattcttggcaaaggaacttcctgcagggttgtggagaatcagagtttgttggattcaatggacttgtctccaaagatgaaagaggaggttaagaagttgctcaattccaagcacttgttcttcagggaaatgtgtgcttaccataacagttgtggacatgggaataacaatgctccacagcaaggagagtctgggggtgaagtgtctcagcctcaggctcaacctcatcatcatcagcagcagcaacaacaaccgcaacaacgatgttttcattcatcagaggttgggaatttggggggctcaggtgttgagggtttgaggatgttgaaagtgggaaatggggaagagggtgatgatgactccgaggatgatgatgactcagaggatgattcggacgaggacgaagatgattcgggagaaggtggttcaaggggtcatgtggggcatggacatgaagatattgaggatgagaatgatggaaggtcaatgagaaagagggcaaggaaagtaggaggggtttctatgtcaccacagttgatgcaacaactgagtgctgaggtgagtggtgtgttccaagatgtaggtaagagtgcttgggacaagaagcaatggatgaggagcaggataatgcagttggaggagcagcaaataagctaccatactcaagcttttgagttggagaaacaaagattaaaatgggcaaggtttagcagcaagaaggagagggaaatggagacagccaaacttgaaaatgaacgcaggaggcttgagaatgagagaatggttttgctcattcgccagaaggaatttgaattgatgagtcttcaacaccaacaacagcagcagcatcaacaacaacattcttccacctagatctaggggagatgatttttctgcggttaattgtattgatagatgaaactaaggtatagaaaagatgtagatcgattaggcctaatagaggaaagtggttgttctctttttggggtacttattataagatggttgttattgaagaaaagaaaaatagtaaatttctgtgtctaccatctagatacccttttgtttatttaaacatgctttggttattactattaattttgttttaaactatgcttaagtaaatctgtcacttcctccttcaagttggataataaaactaagcaaagctacttgacccgggatc

SEQ ID NO: 4299 - DNA, 1787 bp, Unknown
  Kingdom: Plantae, Phylum: Streptophyta
gtcagcactaaactaacataaccaaaccagctgcttcaccctttgtattactatttgctatatatctatccttgtctttcttccaagttcccaccaatctaacaaacatgcttctgcatcatcatccttcctataataccgtctcttcccttttgctttttcctctccatcattgacttctgccaagtctttcaaaaagctgatctaaggaataataacctacacgaggtcttcgtggaagaagataccattgccacttgccacatgccaagcgatcaggagtagaaaaccctttacagccgcaacaacaacaacaacaaccaaaccttcaaaaccagcgaaaccctcaccctttgcaccatccccaaatggtttcctacgccactcaccatgacactgacacacatcatcaacaacaacctcctcagcaaccaatcaaacatggctacaacttttcagccatcaaatccagcaagtcacaaagcacactcagtgacgaagatgaaccagtgttcacagcagaagacaacagctccggggaccccaagagaaaagtgtccccgtggcatagaatgaagtggactgacaccatggttaagctcctaataatggcggtttattacattggagacgaggctggttcagaatgcactgatccaaccaagaagaaagcctctgggctgcttcaaaagaaagggaaatggaaatcagtgtcgaagggcatgatggagaagggttactatgtgtctcctcagcaatgtgaagacaagttcaatgacttgaacaagaggtacaagagggtcaacgacattctaggtaagggcacagcatgtcgggtggtggagaaccaaaccttgttggacactatggatctgtcgccaaagatgaaggaagaagttcgaaagctcctcaactcaaagcacttgttcttcagggaaatgtgtgcttaccacaacagttgtggccacaacaacaactgtggcagtacttccaacgtgcaacaatcaaccgaggctcaaccaccacatcaacatcaacagcagcagtgtttgcactcatcagagaacggggtggggagtctgagaatgttgaaagaggatgaggatgaggacgatgattcggaggagttttctgatgaggatgaagaggaatcaggagaaggaggatcaaggggtatggaggaggatgaaaatgatgtgattaggaggagagcaaggaataagggagggtttggtgtttcatcatcacagatgatgcagcaattgagtggtgaagtgagtggtgtgttgcaagacggagggaagagtgcttgggagaaaaaacagtggatgaagaagagggttgtgcagttggaggagcagcaggtgagttatcaaatacaggcgtttgagttggaaaagcagcggttgaagtgggccaggtttagcagcaagaaggagagggaaatggagaaagacaagcttcaaaatgaaaggaggaggttggaaatagagagaatggtcttgctacttcgccatagggagcttgaattggtcaatgttcagcagcagcagcatcaacaacaacattcttctacctaggccagaagaaattactgtgtaaattttatgtatggtagttgaaattataagagcatatgtagactaggcgaaatagatgaaaaagattgttcattttctgtgctcattctaactaatttcaaacatatatagtatgcttgcttgtagacagttttttctttcttgtgttaactgttaaataaatatatagcatgttttactaaatat

SEQ ID NO: 4300 - DNA, 1759 bp, Unknown
  Kingdom: Plantae, Phylum: Streptophyta
tttttaataaaaaatacttccacttttatactaacataagttgatgttaattaaattgaatattttcgtacaaaaaaaaaagatttttttgacacaaccaacgttttgcaaaatcgcgtagaatgtgtcaaaatatagtaataaatagaaattatggtcgcaataaagttgggcagatacaagacccctccgttttttttttccagaatgctgaccaaaagtcgccgcaaacccactgtgtatttgactctgtgtggtcaaatcaaaggagtatatattaaggtgcacttgtcctataaacgtgttaagaagtcaaagagtcaacgcttaacctcagatcaaagtttaaaagacaggaaaagctaaggaataaaaactagtttaatatctaataatcgattaacaagtcatagttgcagaactatttggcagcccaccaaaattgttttggtatagaaaattacttctacccaaaagtgcaaatcctcctaaatccaacgacggatgagtttgatcctcaaatctatttatataatcaccttcattagtatgatcttacttataacagaattagccaaaccatatctcaaccaaaactattacctctctctcttttctctctaacaaacactccataaacggaaaagaaaagccacacaacaattaattaagttgttaaatttttgtgagatggagaggagtttatcaggaagtagtgaagaggagatgtcaataacgaaaggtccatggacagaggaagaggattctgttctcttcaattacatcactgtccatggggaaggtcactggaactctgtcgctcgctacacaggtctaaaacgaacaggcaaaagctgcagattaagatggttaaactacttgcgtccaaatgttcgacgtgggaacataaccctcgaagaacagctcttgattcttgacctccattcccgttggggcaacaggtggtcgaaaatagctgaacatttaccaggaagaacagacaacgagataaagaactattggagaacgagagtggtaaagcaggctaagcaactaaagtgtgaggtgaacagcaagcaattcagggacacgttgcgttttgtgtggatgccacgtatgttagagcggatccaagctcaggcctcatcatcatcatcatcatcatcaggccaagcccaccaaaccacgttaatctccaacgctcaagcacacagtgacccttgcggagtcatgacgaccaacccaagtttgttgtcggaggtgtcatcatcagcccttgatgcccacgcgccttctctctatgactctagtgcgtcttacaatctaatgggtggtggtagttcctcatcgtatagtgcagaatattgctactactcggacatagcaggaaatggttttggtggttcggacttgtggacggatgaaaatatttgctttctgcaacagctgctcgctgatcatgacttgtcgtgaaacatgcatctttgttttaaacttaggtgaaattaatttgcatctatcaagtatcaacgtaactattattatgtatacttcaattaatttcaagagaactgctatttgttgtaaatttaatttagcctgatttctaagagataatgatgagtattttaatttcccagaagacgattttgttcacaacaaatagaattaataatagagtaataaaatgtgattcgaaaaaatcatacaaatgcatgagtgtaagtttttgacagaaataacatgtgatgagttgtat

SEQ ID NO: 4301 - DNA, 1392 bp, Unknown
  Kingdom: Plantae, Phylum: Streptophyta
cacaaaggcacaaacccaatcatataataaatcctcttcattcccacacgatatataaccccctcttacaagtctctctattcctataatttcccaacccgcaccatcatttttttcatctatatatataatatctattcacaacatattgcaagtttcagctagcaaaccccttcaacatttttcaccctcagaattcatatcatgagttttcatgatacatcaaacacagggcttggacttggtcttggtcttggtcttgttagcttccatgatcaatcagggaattgcatgaagagtacaaataatgatcccatgagagaaagccataagatcaaaaaagtggagaatccatcatcaaaatgtaacaacacatacccttcacttacattaggaccaccagatgatgatgatggtgatgatgatgatgaagtgaataataataatcaaccaagttcaaagactgagtcctatgaatattttcgtccccaagtttcttctcctagtgcggtgtcttcattttccaactcttctagcatcaagagggaaagagatcaggtcttgggaggagaagaatttgaggtagtggtagagaaagttccaacaagggttgttggtgatgttgatgaggatggtaaccccagaaagaaacttagactcacaaaagaacaagcagcagtcttggaggaaaatttcagagagcattctactctcaatccgaagcaaaagcaagaattggcaatgaaactgaatctgcgagcaagacaagtagaggtgtggtttcagaataggagagccaggacaaaactaaagcaaaccgtgtcagattgtgaactactcaagaagtgctgtgatactctaacagtagaaaataagaagctgcaaaaggagctgcaagaactaaagtcaatgcaagcaacgccagtgcctctttatatgcagattccagcagccacactttccatatgcccttcttgtgagagaatctgcggtggcaacgaaaacaacggtgacaacaacaacaatggctcttcacacacgacaacgttgctcattggctcaaagacgcatcatcattccttttacaaaagtaacaactatccattccctcattcatcatccgcggcatgctagatatatatatacatatatatatagttccgagctaatatatatatgtaattaaagataggtgattagtgattattactattagagatcaatcccccatgcaccacatgctttcttatatatatgtatacttcataaatggaaagatcaattcatagagatttttctaatttgttgtaatttattttatatgtaatatatttatggtctatgcgtacattacatatgaataacaatgcagggttatcacatagttcaatc

SEQ ID NO: 4302 - DNA, 1504 bp, Unknown
  Kingdom: Plantae, Phylum: Streptophyta
atttaagttaaacccgaaaccgtaaaccaattgaaaatcgaaatttttctaaaccccgttgatctttaagtttatcttccaagttcacgtaccatcgcttttataaataccctcatccagtttcccttccaagttcgaatattcaattcaacaccttccctcattctcttctccaaacacgacacaaacattaagaagaagaaacataccacgaaatgtacggacaaagtagctatgagtccgatttggcccttttggactccattcgccgccacttacttggcgactccgaggagcacaaattcggagccccgaatgttagttcgggtaacactccagcgtactctcggagctcctgtttcagcaggttgtacccttgcttgagtaacgattggggagaacttcctcttaaggaagacgattcagaagacatgcttctttacggtgttcttcgcgatgcaataaacgcagggtgggtcccatctctcgatgcatcctcaccggagagtttctcgtcgggtttcatcccggcggtgaccgtgaaatccgaaccggatctatttccggcgccagagcctgtctatattcctccggcggctcagaaggctgagccggcggtggttccggcgaaggggaagcactaccgcggcgttcggcagcggccgtgggggaaattcgcggcggagatccgcgacccggctaaaaacggggctcgggtttggctgggaacgttcgaaacggctgaggacgccgcgctggcttacgaccgagccgcgtaccgaatgcgcggctcgcgcgctttgttgaatttcccgctccggattaattcaggcgagcccgaaccggttcgggtcacggcaaagaggtattcgccggagccgtcgtcttcttcgtcggatagtgcgtcgtcgacgaagaggcggaagaaggtggtggggtccacggtgacggctcaaagtggattgagaaaggagcaagtgggaagtcaagtggcacacagtgcacacgtggagagcagttgttggtcaactaatgcgtgatgctgacgtgggatgcattgcggttttgctctttttttttaaaaatacactctgtgtggcagtggctagaagttattataaaaattagaaataataacccaaaaaggggtggacagtgccacagtgtaaaaaatggatagggattctgactcattactcaagtgggggagtgataaaatctaaagaaaaaaaaaaaaaaagagaacagttggaaaaagttattagggtggaggttttgtttggatttgtgaatacaattacatgatttgttattttttggttcaatatttatgaaatttgtgaattgtgttgcatgaattgaagcctccactctttatccccccaactacacacgctgatccaaatgaaccatcaatcaactaactataaggcgataattaaaatgaaaaaaagaaaagaaaatcctactttagatgatgaaattggttcaattttcagcaact

SEQ ID NO: 4303 - DNA, 887 bp, Unknown
  Kingdom: Plantae, Phylum: Streptophyta
cgcaaagtcaatataaacttaataattattcatatgaggagtagtagttcagccaagaagttgaagggagttcggcgtcggaaatggggaaagtgggtgtcggagattcgtgttccgggcacgcaagggcgtctctggttgggaacctacgccacgcaggaggctgccgcggttgctcacgacgttgccgtttactgtctgaggaggccttcttcgttggacaaacttaacttccccgagaccttgtcttcgttcagccttcagctcagggacatgtctccgaggtctgtgcagaaggtggcttccgatattggcatggacgttgatgccagaaacattcttgctggtaaaacttcaacggtggtggcggaaactaattacgagagtgatgagaggagtagaactgtgtgtgatgttgatggaggtggtgctgatgagcattctgatgtgtttcggtgggatgctgtggggaatgaggatggagggtcttggcatggaagtggtggagattgtaaagaaagggatcaggccttgagcatttccattgaagattatcttgagctgtcttaggttttttttttttttaagaatcaaaagacaatattgaaaattttataattggtagatccctcgttaggtgtgggaggtttcaattcactatagggatctttttttagtatgtgaatagtttaggggttacgacttacaaattacgagtgattactattagtgttcgtgtttaaagctcagacatcaatatgtttcttgctttgtgctgcctttttaaagcaaaggaaaatgaaattaaaaaaaggtaaaagaagaaaaattgtccccccaatatgaacttgctcaatttcacactttcacaccgtttgtatttctgc

SEQ ID NO: 4304 - DNA, 1053 bp, Unknown
  Kingdom: Plantae, Phylum: Streptophyta
gactaaattaatcacaataatactacaggtcatggatcgcttttttcctgagaaaattctcggtgagattttctgggatgaaccttttttggccactgatcaaagtgatttagttcaatattcccagattaacaaggctgaagcttcccctcctgcagcaactccaagcgcttttgttcaatatagagacctacccagaagaattaattctctaaacgggtcaaattcccagatcatgagtaagaaaatgcttgcgttcttgagaaaaagttggccttggcctgtggagagaaataacgtacaagagaatgagagaaaccgtagtttcaggcacatgatcaacgaaagaatgagaagacagaggcagaggcagtgttgtttggcgctgcattcaatattaccacaaggaacaaaaacggataataattctgtaattcaaatggcggcaaaggagattgtacggctacaaggatgcagagaagagttgcaaaggaaaaatgttgagcttgaagcaaatcttgaaggtgttgagagcagcaaaggtagcggaagtaaagttcaatatttgagagttccacatcctaagtctggaattgattctatggttgagatcctcaaatgcttgaaagacaaaggagtcgataccagaagcatcaaatcaactttctccccacaggagttgtttgcagtgttagagacagaaactgatgagatgctgatgttgaaagcgctacttggggaacacatgatgaacttgattggaagcttcattccgatgcccgggaaggttcaaataaaaagcaaaagactatacattaagagttagaccaaatttagaaatgtctaccttgtatttgtaaatatatacacaccagatcaattgacttttttttatagtcgtcaagcttgtacacgtgtaaaagtcttcggattttaccttatttgagattcacttaattccctctctaatttctcacctgttaagtaaatgcatagatattagttagttgacaagatcaagtgtatattcacttgctataattttagttccca

SEQ ID NO: 4305 - DNA, 1120 bp, Unknown
  Kingdom: Plantae, Phylum: Streptophyta
tctttactcgtctccaattccaaacctctataagtaccaagaatttctcatcaacaacaccatcgaaattctagacacacaacacataaaagatttccttgttctttttactgcttaaccgttcggctatctcatatatgaacaacaacatgttaggaatgaagagacggagagatgataatgaagggtccttggatttggcaaaatgtcttatgctgttttcttgtccaatagaaagcaacaagacacaacagaaaagttttggttctgtggaatttgagtgcaagacgtgcaaccgcaagttctcttcttttcaagcactgggagggcacagggcaagccacaagaggcagaagctggagggggaagaactgaaagaacaggccaaaagtcttagcttgtggaacaaacccaaaatgcacgagtgctccatttgtggccttgaattctctctgggccaggctctgggtggccacatgagaaaacacagagcttccctcaacgaagggtttcctattattccttctatcgaccaagttattgcgaaaatcccggttttgaaaaggtcgaatagcaccagggttatgtgcttggacttggagttacacctgtagataatgactctgtgcttggaatcaactatgaaatcaccacctcagcttctttttctttgttctgactaactcttttttacctctttctggacacatgtagtattctttcatttttgtgtaaaaatttcattgacttttcccttataaagatcattgattctttatttgttaatacctttgtttctcacatattatttagttgttgttggctaacgggtacgtcataccaccgattatcaaaagttctgaatgttttaatagtattgatttttcaattatttttttgtcaaattaattttccttttaattcaattttgtaaataaggaccaaatgttaactatctatcaaattttttaactctttaaccacgtgacttttgtacatctgtgagatcataatatgatattatattaagtgagaaaaataagattatacacttacattaaatcttgattgagaaatgtgagaaacacacttaatttgtaacgcacactttcatctaaga

SEQ ID NO: 4306 - DNA, 921 bp, Unknown
  Kingdom: Plantae, Phylum: Streptophyta
aattgataaaatttgcttctctcgtctcattattgctccaacatagcccaggctaaaatttaagtagcactagctagttaggtttaatttctgtcttgtaattgagacaatttatgaaataaccgcacaattgattcgagatgaagaagagagtagcaagcaccagcactgagtcctctaaacttgatcgcaaaaccattgaaaagaaccgcagaattcacatgaaatccctctgccatcagctttcttctcttattcctcccaacctcaagcctgccaaatccaagttgatgctagggcagcgggaccagctggatcttgcagcaaggtatataaaacacatgaatgagagaatagagaaactgaagaggcaaaaggagcaagtgatgtcaaacaatgatgatagaaaaatgttcaacaataatgttgagtccaaattgccaatagttgagctgagagacttgggttccagcattgaagtgatgttggtgagtgggttgaacaaagcattcatgttgtacgaagtaattagtgtactcgaggaagaaggtgctgaagttgtcactgctagcttctcaactgttggcgacaagatattttacgttgttcatgcccaggttaaaatatcaagagtgggagtagagacgacgagggcatataatagacttcaagagttcattgccccaccagaaatctggccggaagatgtgtgaaggcttgagttaccctgtctatcacgggctagctagctatatatgtattgtggcctggtcacaaattgatagtttgagagctatatagtagccttttgcttctgtgagagcgtgttatatattagctatgtaagaaaaaataataatagctttttctttaaaaaaacagaaaagagaaatatatctgtttgtttcttttaatcgaatt

SEQ ID NO: 4307 - DNA, 1077 bp, Unknown
  Kingdom: Plantae, Phylum: Streptophyta
aggtcgaaaacaaaagaacaagcctttctttctctctttttctctctctctctctctttcttgttcattttctctcacttgaaacatgcacacggtgctctgaaagttctaaccccatatttgggaacactctgggacgatattatagcatatctctagaaaggtgattcttctcactctctctctctctctctccaagacactatttaaatacaaccatagccctcttctttctcccatgcattactacttgtcttgatttctttctcgatccccaacatcactagctagctccttgtacacactctacaaccccacctagctacatcacttaattagttttaccaatttcaaattctcacctgtcactagctatatttcataactgatcattaccaactcatcactacatattattggctaggattcaccattagacttaagattagttgatttattacatatataagatgtctagcaggaggtcacggtcaaggcaaacaagtagttcaaggaatatcaccgatgatcagatcaatgatcttgtctctaagttgcaacagcttcttccagagattcgcgataggcgctctgacaaggtttcagcttccaaggtgttgcaagagacatgcaactatattagaagcttacacagggaagtgggtgacctaagcgagcgtttatctgagctcctggatacaactgacacggctcaagctgcaataattagaaatttactgatgcaatagatcggtgcagttgttaatttatcgtataattcatagttaacacttcagtacttgtgaaccgatccagtcactggtcgtgtatttcttattctcttttcgtttcacttttttttttttttttgtgctggttcttgtccactaatatgaatgattactgcttttgcaaagcccaatttccttatatattaaataaaagtttcagagttcgtgctttgctaaattaaatatacattttctctttctaagcacacttaatattagatggacatttttttaaaaaatatttgtctgaaatttgaccctatcgtttttaattatttaccagggg

SEQ ID NO: 4308 - DNA, 957 bp, Unknown
  Kingdom: Plantae, Phylum: Streptophyta
atgccaaacgccactgaacaattctcaaacatcaacagcatcgagtccctccatgtttcccttcgcaacctctcccaactcagcacccgaatggattccgtccaaagcttcgtctcccaatcgatccaatcccacactctcctcactcaccaccaaatgaacatagtctccaacgagatcctaaccgccattcgccacgtcatcaccaacggcgtcgcccttgtcgccgcctcggaaaacgcgctccctctctcggagactccaacgttggactccccgaacaacaacgacgacgacaacgtggtggagctcgatgccatggagctgctggccaagcaccttcacttctgcgaggtgtgtgggaaaggcttcacgcgcgacgccaacctgagaatgcacatgcgcgcgcacggggacgagttcaagaccccggaagcgttggcgaataaagcccgtggagaaacgcgcttgaaggcgacgcggttttcgtgccccttggagggatgcaaccgtaacaagacgcacaagaaattcagggcgttgaagtcagtgttctgtctgaggaaccacttcaagaggagccactgtcccaagacgctgttgtgcgagcggtgtcggaagaagagcttcgcggtgctgtcggacttgaggagccacgtcaagcagtgtcggggagaggccacgtggaagtgctcgtgcgggaccacgttttcgaggaaggacaagctgctcggacacgtggcgctgttcgaggggcattcgccgatgcttggagaggagagagatacggtggtggcggcggccgcggaagggttacctgaagggttctttgatggattggatgaatttggatttggatccattcaaaacaactcttcacaggaggaacacttggccttggggcttcccacaaataatttagatgcatgggaattttctttttctaatttaatctaa

SEQ ID NO: 4309 - DNA, 1386 bp, Unknown
  Kingdom: Plantae, Phylum: Streptophyta
attacacctcacaaaatttctcacttcaactttgaacttcttttctctattattattatctttctctttttcttcatctcttatcttccttcacctttttattgaaagaaaaaaaaaatgagcaacataagcatggtagaggcaaagctgccaccaggattcaggtttcatccaagagatgaagagcttgtgtgtgattacttgatgaagaaggtgcaacacaatgattcccttctcttgatagatgttgaccttaacaagtgtgagccatgggatattcctgaaacagcatgcgttggagggaaggagtggtatttctacacacaaagagaccgtaagtatgcaacagggttacgcacaaatcgtgccactgcctcagggtattggaaggccacagggaaggacaggcctatcctccgcaagggcacccatgtagggatgaggaagactttggtgttctatcaaggaagggcacccaaagggagaaaaactgagtgggtcatgcatgagtttcgtatcgaaggacctcatggacctcctaaaatttcttcttccaaggaagattgggttttgtgtagggtgttctacaaaaacagtgaagttttagccaaacctagcatgggtagctgctatgaggacacgggatcttcaactcttcctgcgttaatggactcttacataagttttgaccaaactcaaacccatgcagatgagtttgagcaagtgccctgcttctccattttctctcagaaccaaacaaaccccattttcaaccacatgaccactatggagcctaagttccctctcaaccatgcaactacaacatatggaggagcaccaaatttgggttattgcttagaccctttatcttgtgacagaaaaatgttaaaagctgttttgaatcaaatcacaaagatggaaaggaatccacttaaccaaagtctaaaagggtcaccaagcttaggagaaggaagttcagagagttatttatctgaagtggggatgccccacgtgtggaattactgatgtgagactttagtacttaaaccctctcctccacctatgccaccatgaaatttttttttttaaaaaaaaaacaagaaaaaaaaaggtataagggggaagataaaatcaatccattgttttaagtcatggtgagtacttatgttttacctgtggtgttttagctattaatgtatacccatccatgatgtgtccctatatattaggaaaatgggacttgtaatttaaacttataaatatttgtagttaattttatttagtggatgatttttttttcttctttgttaaattagatgttggattgagatgctatgaagataatcaaatctctatctttatattgaagaagttttcacgagacaa

SEQ ID NO: 4310 - DNA, 844 bp, Unknown
  Kingdom: Plantae, Phylum: Streptophyta
tataacaccttcctcaacttagctagctagaagacatagtaatcattatatctaacacagataataataacttagcaacgttttttccttctttctttctttctatactttttgtggttctgattattaagttctaagagaataacaatggagggtggaagatcatctgcttcaaatgggaattgtgaggttcggtatagagggattagaagaaggccatggggcaagtttgcagcagagattcgtgaccctacgagaaaagggacaaggatatggcttggaacatttgacactgcggaacaagctgctcgagcttatgatgctgctgcttttcattttcgtggtcatagagcaattctcaacttcccaaatgagtaccaatctcataatccaaactcttctttgcctatgcctctaattgtgcctcctccttcttattcttcttctttcacttctaattattctggtgatgataataaccaccttgtgagacctggagaaataatgcaaggtggtgatcttgatgacacttttgagttggagtacttggataataagttgctcgaggaactccttcagatgcaagataacagacacttctacaagtgaaatataacacaagccaaccagctaggtagtactgctatgtatggcatgaaataaaatgcaaaaattgttgttgattttatttaatattttgtttgctttgtttttgtagctgatcaaagttcttcgaaatgagatcgggcatttgttattattgtaagaactcagttgtgagaataataagcgacatggaaatttaatatccttgttttggtaaagggtatttgctaaacattgt

SEQ ID NO: 4311 - DNA, 1629 bp, Unknown
  Kingdom: Plantae, Phylum: Streptophyta
gccagctttgaaacaagtagcggatatattcgcatgtgtgtctttttcctcactctctttcctctcagtttccttcttcaacttgtgctccttctaagtgctactccctccctatatatatatgcttctctcacttcacaaacttaatttgaacctctcaccttgctcatcatctggaatttatttggcagtcatggattattcatcatggattaacacttccttggatctcaacattaatctccatagggttcacgaagaacttcccaaaaagcaggtggaaaacaattttttctcattggatttggaggtgaagaaatcttctgtaaaacaagagtcagcaggtgccttggcggaggaactgaagcgggtgagtgcagaaaacaagaagttaaccgaaatgctcacagagatgtgtgagaactacaacactttgcgaagcaatttgatggaatacatgaggaagaatcctgataaggagctcagctcatcaaggaaaaggaagtctgcaagcagcaacaacaatagtactattccaatgggagtcaacggaacctctgaaagcagctcaaccgatgaggaatcctgcaagaatccaaaggaagacatgaagacaaaaatttcaagagtttatatgaggacagaagcatctgatacaagccttattgtgaaagatggatatcaatggaggaaatatggacaaaaggtgaccagagataacccttctccaagagcatatttcaagtgctcttttgctccaagctgcccggtcaaaaagaaggtgcaaagaagtgtggatgatcaatctgttctggttgcaacttatgaaggagagcacaatcatacacacccttctcaaatggaggtaacaacaggttccaaccgttcagtatcatgttcagcgtctcttagctcttccgcaccaacagttacccttgactggacaaaatccaagtccagcagtgagtctaagaatgtaaatcccaaaactgaatcaccagaagtcccgcaggttttggtagaacagatggctacttccttgaccaaggatcctaatttcagagcagcactagttgccgccatctctggaaaaatgttgcacaataataattaagtagaaaatgagtcaactgtatttaactcattgttaagcagtattctataagtggatcttgtttagagcacatgatctctttgtaaatacaacataggacattgctacgtatgtagagctcctcaatttaatcaatcctttttggtggaatagagctccactcaggatcgatagcatgtctagctgattgtgcatttgctaatcatgctcatctcagtcttctctattcttctgcatctggatgattaaaattaggtttacaattaagttctggcgaagtttctatagcatacaaaagcaaagagaaactttgtttcgaaaagtgcaactctattgagtattgagtattgacaatacaatatctccttgtcattttccaactgtccatttggaacaccgcttctccctttttatctcacaaaagattaataatagggatgcaacgatcgcaacttctcaggctgtttaatacattatatagattcagactcctagtctgagatttttcacttcac

SEQ ID NO: 4312 - DNA, 1009 bp, Unknown
  Kingdom: Plantae, Phylum: Streptophyta
cggccgcacagaccacacattgtttgactgtctggatggatgtttcgaggaagcagcaaattaaacatcggaaacaaagagagagagagagagagagcatgacagacgaacagcaacatcaattcccatcatcgatggtctcctctcccctatatatacatatataccacgcagaagtggaaaataaaagtgaagaaaacagaccaaaaatagaaagaaagagaaataccaaaaccttggcgcatcatattctttattccctcacttggatcgttaattccgcgaacgagcttctgcccttcaaattaaccatggagaatattggtgaggagtacggctactggccggagaacgacatgcttttccaaaacgaagaccttggcagctgggcgataatggatgaggcagcgttatcagggtcagggtactatgattcaagctccccggacggtactggtgcttcttcatcggtggcatctaagaacattgtctccgagaggaatagaaggaagaagctcaacgataggctttttgctctaagagcagtggtccccaacattaccaagatggataaggcttctatcattaaggatgctattgagtacatccagcacttgcatgaccaagagaagagaatccaagctgagattttggatcttgaatctgggaataaactcaaaaacccaacctatgaatttgaccaggacctccctattctgctcaggtccaagaagaagagaacagaacagctattcggttctgtcagttcaagaaattctccaattgaaataattgacgtataactcttaactcatcactctcttgtatattttatattagttaatatacataaactcttggggctattattttcattactataacattttttatcttaaaattgagtgtataagttcatgagttgaaaaaatatgtaataaatagttttaatattgttttgaatatgcttaaggtccttaattataaatatagcacactatattttcgg

SEQ ID NO: 4313 - DNA, 1881 bp, Unknown
  Kingdom: Plantae, Phylum: Streptophyta
cccccaaacaagaatccctttctttgaagtgtgaaaaaaaccttatagaaaagatgatgcaatcagaggatctgcaattccaatggccattctttgaagacatgaactcaacttttgatcaaggtgttgagtcctatggcttcaccaccatgtatggccacgttggtgattgtggaccttatgacttcactatgaatgaccatgttggtgattgtggactcaatactctattgagcacaccagaggattctacttctgaaatttgttccatcccctttccttcctcccccattttctccattgatcatattcatatccaatacccaatcaatgaagaaaccatgcaccttccatcactcatggaattggatgattttgattccatcttggatactcaaattattagtattcaaggtcatggagaaagtgaagggagcttcttcccttcacagaatttctcgagtgaggtggaaaatgcatggagtccaaccccatctgtgaggtcagagttgtccacaaatcaaacatcaccattgactttaccactagaaaacatggaagtcgaaaaccaagtgagtcttccacacttgttgaaggcctatggagaagccttggagcaaggacaaaaagcactagaagaagtgattttgaggtgcataagccagaaagctagcccacttggtgagtctctagagcgccttgcattctacttgtctcaaggcatgacaaatcatggagactatctaaaaggggaggccttaaagaactttgaggctgctttgagggcattatatcaaggattcccaattgggaaaattgctcactttgcagctgtttcagcaattctcgaagccttgccacaagattgtgatgtgcacatagtggacttttatattggacatggtgttcaatggcctccaatgattgaggctattgcacacatgaacaaaacattgacattgacatcaatcaaatggggtggtgaggttcctgaatgtgtttctagtccatgcaattttgaggaaactagaaggcagctctatgagcatgccaaatcctgtgggttgaagttgaaggttgaggagaaaggagtggaggaattggttagtgatattaagaaaatgaacaaaaagggtgagaagggagagtttttggccttcaattgcacgattgatctgcctcatatgggaaaagtaaggagcagaaaacatgccttacagtttctaagggtagctgatgaattgataagcacctctgacaacaggggaattatcacttttgcggatggggatgcttttgagaaagtgaaaaataacttgaatttcaggtcattttttgatgggcacttggtgcattaccaagccttgttagaatcaatggaatcacatttcccaaccagtttctcagaagcaagaattgccatggagaaattatttttgcaaccttgcatctcttctcttgattggttacaaacatgggaggagatgaaaaggggaggccatcttgaggaagaaactagcttagagggttgccaattgagcaaaaatatcttaatggaaattagagaagtgttgagaggaagtgatggttcctatcaggccaggattgaaggacaacatgacaatgaactagttttggagtacaaaggaactcaactattaagattttcaacttggaaaaactaaagctaagtagttaaggactagaattgacaatactcttttttttgtgtgtataataatccaaattatacaaatagatggtagtagctattataatttgatttgtacagattcatgctcatatcagttatgtgtactcccaaaaattatatatagacatatattcttttttcccataatataatagcttgtttgcaaa

SEQ ID NO: 4314 - DNA, 1230 bp, Unknown
  Kingdom: Plantae, Phylum: Streptophyta
aatcaactttggtgtatatatataaacaagagagagctagcagtgcaagctttcaacatccaaaacaacagagagtttttggctttagaagctgaaggaatatagttatcacaatggggagagctccatgctgtgagaaaatggggttgaagagagggccatggactccagaagaagatcaaattctcatcaattacatcaacacttatggccatgctaattggcgtgcactgcccaaactagctgggctattaaggtgtggaaagagttgtagactccggtggataaattatctgagaccggacatcaaacggggcaactttaccagagaagaagaggacactataatcagtttgcatgaaatgttgggaaacagatggtcggctattgcggcaaggttgtcagggagaacagacaacgagataaaaaacgtgtggcacacccacttgaagaagaggctgccacaaaattaccaacaaagccatcacactaaaaaacgaagcaaaaaacaaccaccaaagttggatgcggacgcctccaaatccaaccaagacgccaaactagaacaacaagaccccgttaatattcatggatcgaactctgaggacatgatgatgccactatctcctcctcattgttctagcgacatgtcctcctccctcaccaccagtgacaacaatagtaacgttaatattattaataataatcatgatatgtccttaaatgttaatgattatgatattgacaccccagagaataatcttgcattggacgaggatttctggtcggaagttttgtcatctgataattccggcgtgacaagcggatttccgacccttgactatgatcagtttcaaccaatgtctcctctagtgacagaagaaggggtccttatagattgttcgtcgagtacgtgcgacgatggcatggatttttggtgcaatgtttactcgagagctgaggaatttacccagttactggaattgtgatgttagctattgttgttgttcttaaatagagaccaagtccttcattcaacatgtcgttgttcttctgttgtttggacttgaattaattcccttgttagaaattaataaatcgtgtacattgatgattgttactggacgtcattatgtttttaccaaaagcgtcatttgtagcaaaacattgttccataatcctcatgagtgttgaaataataatactatgttcctttatatagaatagttg

SEQ ID NO: 4315 - DNA, 1723 bp, Unknown
  Kingdom: Plantae, Phylum: Streptophyta
gccttcttcattcagcaacaaaacataccttactcactagcctaatttgctcctttagcctcactcctgctctcttctacgtcaaatcctaagaaacccatttgaaatttgaaatctcgttctggctaattccatgttcattgtttactatacctcaccactccaagggtctcataaatttcttctgcttccaactctgctccagaaaaagaaactgttggttctagatacaagtgggtttccagagtagaagtgaggctattgggcatgagataaacagcaagcaccatcatctacgacccttttgactatattataaacaacacaaaaaatggagagtgacttgagctgggagcagaacacgctcataaatgagctaattcaggggatggaggtagcaaggaagttgaaggcagacttgaggatgccgtattcagttgactcaagagatttgcttgtgcagaggatattatcttcttatgaaaaggctctactgattctaagatgcaatgcatcatcaacttccgagttgcaggccatgagtcaagcaacaccaactttgctacccgagtccccattatctgtccatggaagtcctctgcgcgaggacgttgatgggaccatcaaggatcaccaagaagttaaacatgattcaaagaaaagaaaggcaacgcccaaatggatggatcatgtaagagtgagctgtgaaagtggtcttgaaggaccacatgaagatagctacaactggagaaaatatggtcagaaagacatccttggagccaaatatcccagaagttactataggtgcaccttccgcaacactcagggctgttgggcaacaaagcaagtgcagagatcagatgaagatcccacagtatttgacataacttacagaggcaagcatacctgttctcagggaaacaatgccgttctgccacctaagtcaccagaaaaacaagaaaaaccaacacacagtcataacattgatattcaccgtgcacaggcatctcaagaaagccttacaaagttcagaaacatcttgtctgtcaacacagataatctgaacaatggagatatggcatatcctttcactttcccttcaacttcatttggatgcatgaaacaagacaaccacagcttgattccttgggccctggagaacgagtccttcttaagcgacctataccaaacacaccttttatccacaacaataccagaatcaaactatttcccatctccaactttccagatgaatgtgtttgatgggatctacagcaagccacattcggaatccgatatcaatgagatcatttccaccaacacatcagcaaccaattctccaattcctgatttcaatttctcacttgatccagtggaaattgacccaaatttccctttcaataccccaggacttttctcctgattgcatttcactataaatggaatactataagcacatagtcttcctaaaatgggacaacttcagacagcagtaaaattgtagaataaagaatgagcaactgcagcacttatgaaggtccttgtggcttgtagtcaatatcagaattacaattttggcactgagttagcaattagcagtatgtacttttaaataaaatagtctctccaaatttgcattggtacaacctacaagacacatctttagcagaagagctgaagagcatagcagtcacaaagaacagctaactaaaccaaattaagt

SEQ ID NO: 4316 - DNA, 2253 bp, Unknown
  Kingdom: Plantae, Phylum: Streptophyta
actcgcagttagtagcaattaatttgaccgacttagaggtccactagccaccaagaaaactattctcatgactaattaaaacacgtgctccactctttttccacctgtattatagtattacacttcgttgcgcctacttttctcagcaattgtcacgcaacttccctcatttcctcaccctccttatataaatccccttcaaccccattcttcactctcactcaaaattaaccacaagcataagcacaagcacaagcacaagcacttctctaattccctttcacactctattacagatttcacaagtgcttacacttcaaatggctttggaagctcttcaatcacccaccacagccactccatcgtttagtccctttgaagaaaccagtctcagttacttagagacaccgtggacgaaaggaaagcgttctaagcgtagccgcacggagcaacaactgcaacacccttcatgcaccgaggaagagtacctcgctctttgtctcatcatgctcgctcgcggcggcgccggcagtgtctccaccgccaaacccgctgtctccgacaacaattctgcgccgctatccgccgccaaactgagctacaaatgttcggtttgcaacaaagccttctcctcttaccaagcactcggaggacacaaggccagccaccggaagctcgccggagaaaaccacccgacctcctccgccgtgacgacgagttcggcgtcgaacggtggtggtaggacccacgagtgctccatctgccacaagacgttttcgacaggacaggccttgggaggacacaaacgttgtcactacgaaggcggtaacagcgccgtaaccgcctctgagggagtggggtccactcacacaggaagccaccgcgatttcgatctcaacctcccggcttttccggacttctcagcaaggttcttcgtcgatgacgaggttaccagtcctcatccatccaagaagtcccgtttcaatttgaccatacccaagattgaaatccctcaatactgatccatagatccaaaaaaattattcagtgtttttttatatatttttttaagttatttgggattaatttgttcttgtacatatatagtacttgggccttattcgctagttttagcttttagattgtagtatacttttgacagtggtgattcaattcaattcatttatttttatttgtaagaatgaaatcgatgcctctcactttgccttttatcatcatagcgtagtagtatgattgatccagaagaatatgcctcggaatggaatagacatcatgaaacagcagaaccgcgtgaacggtgcggcaagtttgttttagttcagttgaggccacttgcgcgtgtttttttttcttttcttttctgttgggtgtgtgaccgtttttactgttggtgatccacgattctaattttttgaattttccttttaagaaaataaatgaacatttttttttataattttgatgattaagattgtgagtgaatagtgattaaatgagcaattggtagctggcctgggtggatggatgacatgggatgaacacaccggatgtttcgtgtttgatgtgcggataagaacgaggcattggccttttacacgctgtgatgataacgacacgtgaattacttatccttacattgtaatggttttataggattttttaagaaagcaacgtagcattcctattgtgttcgattggtcttgtgacgcgttattgaatggtcctacgatcgctgaatgccaaagttggtgtgatacgttttacagtagcatgaacagaaatgagtgttgaagcttcctttaatttgcaggagtaagaagtagtaaacttgccgtgtgattcgttttattgtacgtgtcaattagtattttaccatacttatcttttaagatggagttcacactcgcaattcacaattgtcatgcggcaattacacgcggtatcccaaaattagaattagtaaaagaaagttcgtcttttagttgggcaaggaggtgcccaattttataccaaactctggtggagtactcgaagattcgcgttaaatgaaccatattccattttggatttttggttttctagtttcaactctatggatatatgccttctccctttgcgtcttcattagagaaaaaaagtccaccaagagacccattatcagtgttcatacgggaaatttggaatgtcaatctttttggcaatcaactaactcgtgcataacgcgtttttttt

SEQ ID NO: 4317 - DNA, 1353 bp, Unknown
  Kingdom: Plantae, Phylum: Streptophyta
tcttcatcacatatataaagagccgcaacataaactctattcagaaaacgcagccaaaacagcaacaaacgacagagattcttcctcaacacaatcgaaaaaaaaaaagcttccgattctaaaaccagaacaacaaaaaagtaaaacacacacgtcattttaaaacatttcatttttttggttatttatttaaagagcgagtgttgtaacaaatggtgaagccgaagagcgtggagaaacccgcagaggaacaacaacaacgaagtgtttcatcgtacagaggagtacggaagaggaagtgggggaagtacgtgtcggaaattaggttacccaacagccgtcaaaggatttggttgggttcctatgacagcgccgagaaggcggcacgcgcgttcgacgctgccatgttctgcttacgtggcagcggcgccaaatttaatttcccgagtgacccacccaacatcgccggcggggggaacatgacctcctcccagattcagatcgcggcggcgcgtttcgccaattcggagccccgaaatgagcgttcggatcaacccgtggagtctttaacttcggatgaggaaacggcatcgtttccggtcatttcggatacggatacatcatctcctcctctctcagacgtgacgttccaaaacgacgccgaattagttactgggtcgttccctgatatgttttcggatttcgggtcgggcgattttgtgcccgatttctccgattttccgagcttcgacgatttcagccgggacttcttcttgcatgaacttccgggtttcaatttcggagaagagaacttggatggattgataattcaggactcgttcttgtggaatttctaagcgggtcagggttcggataattttattatatccgaacccgatatcagaatccggatcggatccgggtttgggttgggtcaaattttgcgtgccaagccctccatgtgttagtagttagtgatgattatagttttttttttttaacgtaccaagtagtcaaatgtttcgattttttgggatgcgaatcataattcatttatttgtcatgacttatgtgattaattgtaaagtcgtctgctgaatgatagtgtaatttttttggccattcgttcaattataaaaggataagatattttcgtctggatatattgattagtggtggcttggtttggcccattatattaatttatgtctatctactacgattgagacgggacatgtgatgatcaaagatacggaaagaaactcaattggaaagaactttatcacatttgcttatcttctcattcttaaaaaaagtgacaattagatgcatgttagtgatgttacaatggct

SEQ ID NO: 4318 - DNA, 972 bp, Unknown
  Kingdom: Plantae, Phylum: Streptophyta
cataaacataaataatatatagtggtgtcatcacatgtccatctccatccaatataataccttcctcaacttagctagctagaagacatagtatcgtaatatatacctaacacacataacaataacttagcaacattttttccttccttctttctttctttctatactttttgttgttaattctaagttctaagagaagaaaaatggagggtggaagatcatcagtttcaaatgggaatgttgaggttcgttatagagggattagaagaaggccatggggaaagtttgcagcagagattcgtgaccctacaaggaaaggaacaaggatatggcttggaacatttgacactgctgaacaagctgcacgagcttatgatgctgctgcttttcattttcgtggccacagagcaattctcaacttcccaaatgagtatcaatctcataatccaaactcttctttgcctatgcctctagctgtgtcagctcctccttcttattcttcttcttcttccacttctaattattccggtgatgataataataaccaccttgtgagaccagctttttctggagaaataatgcaaggtggtgatcatgatgatgatacttttgagttggagtacttcgataataagttgctcgaggaactccttcagatgcaagataacagacacttctaaaagtaaaatataacacaagccagctatgttgtgttagtcactggcatgaaataaaatgcaaagaaatattgttgattttatttaatatattttgtttgattttttttttttttttgtagctgatcaaagttcttcgaaatgagattggacatttgttgttattgtaaggattcagttatgagaataataagcgacatgcaaatttaatatatccttgttttggtaaagggtatttgctaagcattgtgtatgttgttgatttcttttatgttcacacccatacattttctga

SEQ ID NO: 4319 - DNA, 1063 bp, Unknown
  Kingdom: Plantae, Phylum: Streptophyta
cctcgcttcatcaaactctctcacacaacatagtacggtcaacctcatactcgcaacatatatatatataggccgcaacctactaagttttcagttctcacaaataaataaaaaaaattgttttcgtgtggaaacaaaaaaacaattcaaaaacaaacatatgatggtgaagccgagtagcgaaaagccagaggagcatagggattccaagtactacaaaggggtccgaaagagaaaatggggcaaatgggtatccgaaataagactacccaacagccgtcagaggatttggttgggatccttcgacacccccgagaaggccgcgcgtgccttcgacgccgcaatgttctgcttacgtggccgcaacgccaagttcaatttccccgacaacccacccgacatcgccggcggggaatccatgacgccgtcacagattcaggtcgccgccgcacaattcgccaacgctgggccccacgagggacattcgggtcgacccgaacattctcccatgcaatctctatcgccttctgtttcagaagggaccgttctaacggacagtgacgtcaccacacttaacggttcgctaacggatttgttcactcccgttgggtcgagtggttacgcatccgattacgggattttccccggtgttgatgatttcagtggcggtttttatgtgccggaaatgctgaactttaattatggagaagaaaacggggaagggttcatagttgatgagtctttcttgtggaatttttgaggggcaatcaaatccagtattaaccggcaaaaccggtcacggttgcggatagttttattgtttccggaaccgtggcaatgacccgggtttggattggttattttttagacgaccaaacctataaccaagaaactatgatatccatgcaactgtagcaccaaaagtaatgcaatttgtccagatagttgtgatttcttttttttaaacaagatatttgtaatttgtaaagctcttataacagatattgtgaaaaaaataatttctgattcattcgataatgaaaatatcagtttctccgtcgcc

SEQ ID NO: 4320 - DNA, 1195 bp, Unknown
  Kingdom: Plantae, Phylum: Streptophyta
tataaacagccgcaacacaaaaacacccattcagaaaacacaaacaaacgcagccaaaacaacaactaacgacaaagattcttccccaacacaagggaaaaccggagcaacaaaaaaagtaacacacacgcacacacgcatcatcgtataacatttgttttattttttttaaagagcgagtgttgtaacaaatggtgaagtcgaagagcgtggagaaacctgcggaggaacaacaacgaggtggtgtttcagcgtacagaggagtacggaagaggaagtgggggaagtacgtgtcggaaattaggctgcccaacagccgtcaaaggatttggttgggttcctacgacagcgccgaaaaggcggcgcgtgcattcgacgcggccatgttctgcttacgtggcagcggtgccaactttaatttcccgagcgaccggcccaacatcgctggcgggaggaacatgacgccctcgcagattcagatcgccgcggcgcgtttcgccaattcggagccccgaaaggagtgttcgggtaaacccgtggagtctttgacttcgattgaggaaacgacgtcgtttccagtaaattcggatacggatacatcttctcctctatcagtagtgacgatccaaaacgacaccgaagtagcaaccgggtcgtttccgggtatattttcgggtttcgggtcgggtaatttcgtccccgaattctccgattttccgagcttcgatgatttcggccacgatttcttcgtgcatgagcttccgggtttcgattacggagaagagaacttggatgggttgataattcaggactcgttcctgtggaatttctaagcgggtcggggttaggataattttattatatcccaaccgtgtttagaattcggatcggatccggatttgggttggtcaatttttgtgagaccatgccctctgtgttagtagttagtgatggtaatgttttttttatgtacctagtagtcaaggtttcgattttttgggatgagaatcataatttatttatttgtcatgactcatgtcattaattgtaaagttgtctgctgatagtgtaattttcttttggccattcattcaattataaaaatgataagatattttcgtctggatattaattagtggtggcttggtttggcccattatattaatttatgtctatctactacgctagagatggg

SEQ ID NO: 4321 - DNA, 896 bp, Unknown
  Kingdom: Plantae, Phylum: Streptophyta
tgtcccctccacgttatctttactcgtctccaattccaaccctctataaataccaaacacgcatgtttaagaatttctcatcgagtctcatatttttcatacaacacattctttctagacacgcaacacctagaagatttccttattctttttggtgctaaaccgttgggatatagcaacaacatgttaggaatgaagagacatagagataatgaagggtcagagagcttagatttggcaaaatgtcttgtgctgttctcttgtccaatagaaagcaacaaggcacaacagaaaggttttggggctgtggaatttgagtgcaagacgtgcagccgcaagttctcttcttttcaagcactgggagggcacagggcaagccacaagaggcagaagctagagggggaagaactcaaagaacaagccaaaactcttagcttgtggaacaaaccaaaaatgcacgagtgctccatttgtggacttgaattctctctgggccaggctctgggtggccacatgagaaaacacagagctgctctcaacgaagggtttcctataattccttctatcgaccaagttattgcgaaaatcccggttctgaaaaggtcgaatagcaccagagttatgtgcttggacttggagttacacctgtagagaatgaatgactgaactaccaagtcacccaagctcctttttctttgttcttattaacttttctacattttttacctgtttctggacacatgtattctttcattttttgtgtgaaaattttattgacttttcccttatagatgattgattctttattctggacacatgtattattttgttaatacgattatcaaaagttcttagtgttttaataatattgatttttcaattattttttggccaat

SEQ ID NO: 4322 - DNA, 1127 bp, Unknown
  Kingdom: Plantae, Phylum: Streptophyta
ttcaattaatctaagtacatgtatgtatacaagcaggtttatatatacgtatattagaaaagcaggctatgctggttatttgcatacatttgaagattaaagaataatgggttgttacagagttcagcttgtggcaataatctcgttcatgcttttgctttcaaatacccacggttggggagatgatgggcatgccattgtttgtaagatagctcaggctcgcctcagcactgcagctgcaaaggctgtgaagaaattgttgcccaaatctgccaataatgacttggcgagcaagtgctcttgggcagatagtctgagggttgtcttcccttggtcttctgctttgcactttgctaatactcctgactccgtttgcaattacaaggacacaagggattgtgtagataaaaaaactggaattaagggacgatgcgttgtggcagcaattaccaattacaccaaccagctcctcgagtatggcagtgacactaaatccaaatataatctcactcaatcacttctattcctttcacattttttgggagacgtccatcagcccctacattgtggctttttctcagacaagggtggcaatgaaatcaatgttcgctggtacagaagaaagcaaaatcttcaccacgtttgggatgcaagcataattgagactgaagttgaaagattctatgatgacatagaagacttcgttgatgcaattcaaaggaatattacggtatcgtgtgcaccatcttttaatttgttgttttcaattcaaagatttaatttgtttattcgttgaagtttgatgttttttcaattattattattatttgaataaacagaaagtgtgggccgatgaagtggaagaatgggagagttgcagtaacgatgacatatcatgcccaactatgtatgtaccattagaatctatatattcgtaggaccagttatcaaacaaattttatttcaaggaatgcttctaacgaaaatatatttttaacttctttttctactttttatttctaatacccttttcttttaatgcatgattggatttacttaatttttaggaataatttattttatttatatttttagtttcccttagtaatttagattctaattgcaaa

SEQ ID NO: 4323 - DNA, 864 bp, Unknown
  Kingdom: Plantae, Phylum: Streptophyta
ccattgtgttccccaaaaccacactggttttcccaatacaataccaatggccatttccatcattgctattctcatgtcatgtgcttcccagtatataaggaccacctcaccttcttttcatttcctcattcattcataaatcttagttactttatcagtatcattcattatcactacgattgttctaaaagcaattattactcttgagaagaattaaaagatcatcatcacaataacaagatgagttcaggaattagagcatggagtgtggcagctagtgttggagttgtggaggccttgaaagaccaaggcatatgcaggtggaatcatgctttaagatcagctcaacaccatctcaaaaaccatgttggctcattctctcaggctaacaagctttcttcttctgctatgatctccacaacactaaaacatgagaaggcaaagcaatcagaggagtccttcagaactgtcatgtacttaagctgctggggccccaactagatatcataagtccaataagaaaatattctttctcttttaatttctagaaattatcaagcttagtcacaaaggaagatgagggttgagatttctggggtcacattgtatagtatttgaagtttgttttgctcatgtgacaatcagtttgtaaattttgataaatgatagtgtttagcattgccaaatttcatatgtcttctttagcttcttttttttccacttccaaatgcccaattttatgatggttaaatatcagttggtattaaaatttgtcaactcaaacctccttaagttcgatcgatcttggcttgtgtgtacagaaaaagatgtcaattcttcaaatagatttcaatatcttgagga

SEQ ID NO: 4324 - DNA, 982 bp, Unknown
  Kingdom: Plantae, Phylum: Streptophyta
tggttttccaaccaaaggtgtcactagcaaatacacgtgttcctataatcccaggatgcatgtaacgatcatagcccattgtcttttaaaaaaccaccactttacttcccctggttttgcaacttttcccatgtgcttctctctatataataaagaccaccttcatttcatttcctcattcattcaactaaaagcaagaacaattactttagtgttttctcttgtcacataaaagtcatctaagaagaattacaagatcatcatcacaataacaagatgagttcaggaattagagcatggagtgtggcagcaagtgttggaattgtggaggccttgaaagaccaaggcatatgcaggtggaatcatgccttaagatcagctcaacaccatctcaaaaaccatgttggctcattctctcaggctaacaagctttcttcttctgctatgatatccacaacactaaaacatgagaaggcaaatcaatcagaagagtctttgagaactgtcatgtacttaagctgctggggtcccaactagatatcataagcccaacaacaaaatattcttttctcttttcaattctaggaatcaagcaagcttaattagtctcaaatgatgatgagtattgaaagaatattgcttgtctttatggcagtcattatgtaaattttgatattgatagtgttgagctgttgccaaattttatttgtagtgttctttatggtaaagattggcaaataactcgtttatcaattgtgattaactcgtgtacttacagaaggctctttttcattcatttcagcaatcttactcaagatatgttaaagattggcaagtaacacggttatcaattgtaattgtaagttcattaattaaaagacagaacatcacaaactattcggtttgattttcatgtataaaaaaaaatttgataactttatgcctttatattttataaatctttggataaattgcatttcca

SEQ ID NO: 4325 - DNA, 715 bp, Unknown
  Kingdom: Plantae, Phylum: Streptophyta
atgagttcaggaattagagcatggagtgtggcaactagtgttggagttgtggaggccttgaaagaccaaggcatatgcaggtggaatcatgcattaagatcagctcaacaccatctcaaaaaccatgttggctcattctctcaggctaacaagctttcttcttctgctatgatctccacaacactaaaacatgagaaggcaaagcaatcagaggagtctttcagaactgtcatgtacttaagctgctggggccccaactagatatcataagtctaataagaaaatattctttctcttttaatttctagaaattatcaagcttagtcccaaaggaagatgagggttgagatttctggggtcacattgtatagtatttgaagtttgttttgctcatgtgacaatcagtttgttaattttgataaatgatagtgtttagcattgccaaatttcatatgtcttctttagcttcttttttttccactttcaaatgcccaattttatgatggttaaatatcagttggtattaaaaattgtcaactcaaacctccttaagttcgatcgatcttggcttgtgtgtacagaaaaagatgtcaattctttaaatagatttcaatatcttgaggataaaggatctcaatattttgaagattagtctttttggctttcggtcgagaaatacctttttcacgctaaaaaataacctccttgatttcga

SEQ ID NO: 4326 - DNA, 673 bp, Unknown
  Kingdom: Plantae, Phylum: Streptophyta
cttagtttagtaataatcctgacatcacatgtcaagtgcttcccctctatataataacaccttcatttcaattgctctctcaaactcaatctaaaaatcttgctagagatttcttccatcactaagccacaccacaccacaattagcaagtatcaattgggttatttttggtcatctaataaaaagcaaaattaagcaagagttactttgaagaagacttgtacaaagatgagttcagcaagcagaacttgggctgtggcagcaagtgttggagttgtggaggccttgaaggaccagggcctgtgtaggtggaacattgctttaagatcagcacaacatcaagtgaaaaaccatgtgagatccttgtctcaggaaaagaaggtttcttcttcatcatcttctgctgtggtttctagtagattaaaggaagagggtgcaaaacagtcagaggaatcattgaggaaagtgatgtacttaagttgttggggtcccaactagagtcatatggcaattactaaatgtttgatagaacatttgcccctagggaaaatggggacagatttgtgaaccagtaatggggcttgttagcattcaaaattattgctactatttgcggcaaatattgatgtaaattatgataaatggaatatagaagtgtgaagcaattccaaat

SEQ ID NO: 4327 - DNA, 770 bp, Unknown
  Kingdom: Plantae, Phylum: Streptophyta
acttgattccaaatcttacacacaacaaaaccactggcctcaccaaaaccagtagccagctaactacaactttatgcctgtggtttttccaaatatttggccgtttccttagtttagcaaaataatactgacatcacatgtcaactgtcaagtgcttcccctctatataataacaccttcatttcaattgctctctcaaactcaatctaaaaatctcatcaccactaagccacactagacactacaatcattatcaagttccaattgggttattttttgtcatttaaaaagaaaatcaaagcaagagtttctttgaagaagacttgtacacaaagatgagttcaagcagaacttgggctgtggcagccagtgttggagttgtggaggccttgaaggaccagggtctgtgtaggtggaacaatgctttaagatcagcacaatatcaagtgaaaaaccatgtgagatccttgtctcaggcaaacaaggtttcttcttcctcatcttctgctgtggtttctagtagattaaaggaagagggtgcgaagcagtcagaggaatcattgaggacagtcatgtacttaagttgttggggtcccaactagagtcataaggcagttactaaataactaaatatttgatagggaaagttggggcagagatttgtagacttgtaatggtgcttgttaattagcattcaaagttgcgacagatattgatgtaaatcttgataaatgaaaaatagaagtgttaactgttaagcaattccaaat

SEQ ID NO: 4328 - DNA, 851 bp, Unknown
  Kingdom: Plantae, Phylum: Streptophyta
agtgaaaatgaaaacctctggctatccacacagttcaaaccacctgttaacaaaccaatatagcatccggtttttcccccctaagcctcacgtattaatctatataaacaccaaaactcacactcacttgtagtcatagtagcaacttcaactactgatatcatatcacaaaacagtgaaggattattagggaagttttattagtttgaaaccgcaccaatttattatataacatgtgtcgtggaacttttgtggttgcaaccactgttggagtggtggaggcgttgaaggatcaagggtattgcaaaatgaacaacacaatgatgaagtcggtggctcaacaagccaagagccacttagggtcagcaactcgggccaagaagctggcttctccttctccttcttcttcttcagcaacttcaaataatgagaagagaaggatggcagaggagtctctcagaacagttatgtatttgagcacctggggtcccaattcttagagttagaaaacattagattaatgataaatattagtataattcagcaaggcacaaaaatatgatgccagtgatgatcagctcagccacgtaattctataaaactggagagtgctcataacatatagcactgttgatggattgattgtgcaaggttttgatccttattgattgttggtgggtttgtatgtgactgtaaattgccatatcatatcaataaaaagttacgtgcttttgcacggaaattagtgtgatttctttttttttttttaatttcctaaaattttggtagctattcttacaattacaaattttcattcaaagctttctttaagttcatattatcatagagcg

SEQ ID NO: 4329 - DNA, 1675 bp, Unknown
  Kingdom: Plantae, Phylum: Streptophyta
ctcgtgctttaattcagcgcctttatagttataaaatgaagataaggttcaataatcgatatcatatcatcacatcttctgctctctcacgagaagaatactactaactgtgttgtaatacctcagtggagaacaagatgaatccatggaacatgagaacttccaagttactctctcaacaacttgcttatcctccttatcgcttggtagaagagattccaaacatgggaaattccagttgtgtgagcaaggagccaagaggttcacagatgacaatcttttatggtggccaagttcttgtcttggatgatattcaagctgacaaagccaaggacatcatgtcttttgccggcaaaggaatgtctcaaaaccagaacgactgtgcttacactttccctgctacaacttctgctactcccagtagaccattcccttttcttatgaatatcattccaaccactgccaataattcggttcaagaccaccctcaaacaccatccaaacctgttatttgtgatctaccattggctaggaaagcttcacttcatcggttcttggagaaaagaaaggataggtaagtaggctgagtcatggaaattaatacatcaacgaaagtataccttcaagttttcttcaaaattggttttagaccctacatcctaaaaacaatgattttgacctttgtattttctaaagtgtggtggatttggtatttggtatctgcttatgtcaaaatgaagtacagggtcaagtacaaaatctaccacatttcagaactacgaaagctaaaattatcattaataaaaaaaattaggatttaaacctaatttggactgaatatatgttgagtaacctaaaatgcattttaccttcttttttaatttactgctttggatcaaatcatttatatattattattaatgtttgtgcagaattgctgccagagcaccatatcaaacaagcaatcacatggcagcccttaataagctagctgaatccaagccatggctcaccttggcacctaaatcaccacaacaagacgaatctgattctgatagcagctccagctttgtgttattttaactacttttgttggacaaggtgaagaagaattgtggtgtcaacattttgataaacggagtcaacattttatgggcttctctatagctccgtgctgaatttttgggagggctatgatcaatgctgttgctcatggctttactattattatatttaagagtgtaatttagggcaaaaaagtaatgtaaatgtagtttggttagcatagttttagtaaaatattgaaatcagttcttctcaattctcattatcacgtgtattatatgtaaaacttcggttaggattatctttctatatgctagcctgtttgttatggttcaattggtttcctactagtatgtgagacacatttagtcaaattccatctttccagcgaattcagtttttcctctcaaattatcctagttcatgccatgcagcagaaaatgaggtagattgagcagcaataagaataacaaattgaactaattgaaagatataatgtgcatgcaattattatgtagcattgttataaaaatattgttgaatcctgtattttctgttttgtgttagtttctgttagttagttggtttttctattatagttagttggtta

SEQ ID NO: 4330 - DNA, 2351 bp, Unknown
  Kingdom: Plantae, Phylum: Streptophyta
cactaaaaattgcctcaaacctaatccttatctttatggaaaaaaaaagaagaagaagaagaaacagtgatctgtctcaaatgaatagtggcaggacgtcgcttttagattgtcattggtttttgttgagtccaccttgcctataaatggggaacctctcaccacaaacttaagttgtgggttgaagtttagaagaacaaagcttcccacctaggcctctctattgtagcacttaagtttcttttcttcgtggaacttaagaaaatggaggagaaaatgagttggacagttgcagacgctgtgaactataaaggcttccctgcagacaggtccaaaacaggtggttgggtacccgcagctcttattttagggattgaaatagtggagaggctctccaccatggggattgcagtgaacctggtaacatacatgatctcaatcatgcatctgccaagctcaactgcagccaatactgtgactgactttatgggcacatcatttctcctgtgtttgctgggaggttttctagcagattccttccttggcagatacaagacaattggaatctttgcttcaatacaaacgctgggtactgctacattagcaatctcaacaaaattgccagggctacgtccaccaccttgccatgctaacagtgacagttgcaaacaagccaacggattccaaatgggaatcttgtacttgtcactgtaccttattgcactaggaactggtggcctgaagtccagtgtttcaggatttggttctgaccaattcgatgagaaagatgagaaggagaaatcccaaatggcctatttcttcaacaggtttttcttcttcatcagttttggaactctggcagctgtcacagtacttgtctatctgcaagatgaagtgagtcgcagcttggcgtatggaatatgttctgtttctatgatcatagccattatcgtgttcttatcaggaactaaaagatacagatacaagaggagtttgggaagccccattgtccacattttccaagttatagcagcatcaataaagaaaaggaagaggcaactcccatacaatgttggttctttgtatgaggacactcctgaggcttcaagaatagagcacaccgaacagttccgtttcttggagaaagctgccattgtggcagaaggtgattttgagacaaatgtatgtggttctgaatcaaacccatggaaattatgctcactaacaagggtagaggaggtgaaaatgatggtgagacttctgccagtgtgggccacaaccatcatattttggaccatttacgcacagatgatcaccttttcagttgagcaagcctccaccatggaaaggaatattgggagtttccaaatccctgctggctctctcacagtcttttttgtggctgcaatactaatcactctggctgtgtatgaccgactcatcatgcccctttggaaaaagtggaacgggaaaccaggtttcacagacctacaaaggatagcaattgggcttgtattttccatttttggaatggcggctgcttcagtgtgcgagaggaaacggttatccgcggcaaaaagtgtaagtggtggaaaccaagcaacaacactgcctataagcgttttcctcctgatcccacagttcttcttggtgggttctggtgaagcattcatatacacaggccagcttgatttcttcataacaaggtcgccaaaaggaatgaaaaccatgagcacgggtctctttctcacaactttgtctctcggtttcttcatcagcagtttccttgtctcggttgttaagaaagttactgggacaagagacggccaagggtggctagcagacaacataaacaagggcaggctcgacttgttctatgcactgcttaccatacttagtttcattaattttgtagcgtttgcggtatgtgcactttggttcaagcctaagaaacccaaacaaccagctatgcaaatgggtccacagcagaggaaaagtgttgaaggctgaatagtttttaggatttcggaatgttatcatggttttattgctttgtagataggctgttatgtgtatgcatacgaagaatgggttgattttgggttttttttcgtgtgatattataataatgtttgggttggcttctttgtacgcataagcatgtaacatagtttctggtctttcaagtctgttacacttttctcaatcatcaggcttcctttttaatctcttactatttttttattctgttaacatttcataattgtttctttttgttgctatgtataatttgattgataaatcaaatacttaaatgtgtacaaaatgtctcgtgaagatgaacaaattgt

SEQ ID NO: 4331 - DNA, 1143 bp, Unknown
  Kingdom: Plantae, Phylum: Streptophyta
caaggaaccgtgtggattctgctccaaacagtgggtgcaacgcccctggttttctttttcctttattctcttccaccccgaaaggccaaaacagcctgtggttttagcattaaactcctatttgtaaatcactcaataacttacatatatataggaattaacaaatcactcaccttacacagaccaatattcattcatttagattcatcaaaagcttataacaacaattaaacatgagtgcagccagcagagcttggattgtggcatcaagcattggagcagtggaggcattgaaggatcaattgggggtgtgcaggtggaaccatgcattgaggtcactgcagcagcatgccaagagcaacattagatcctacactcaggccaaaaccttgtcttctgctacttctgctgctgtctccaataaggtcaagaggaccaaggaggagtccatgaggaaagtcatggacttgagctgttggggtcccaatacttcaaggttttagtgtgtggactattctaattgcattcatcattgtgctgcaaggtttatgaagattcaatactacctttgtagcctttttgtcatggcatgcatccctttggcctttaccttatgtatctatttgattcataatacaaagttttgtctatgaaaatggtaaatatttgatccaatgaaaagaaaactgaggtctgtttttcaattattttgtctgttaagttcaattttaaatttttaattaagtgcacatatggatccttgaatgtttttctaaacgatttatatcccctatagttatttagtcctaatcatggaaaggaaagagagaaatggacatgatctgtgtattatgtaagatttacaaaccccctttttgactgatgcttacaaaagaaaagggtgtgaaaatctattttttatataaaaaaaatcatttaataacgtttcaatacatgctatgatcagctgcaagaattgtggtcgcaattgcttagcccaaccataggtgattgtggtttcagccacataagttgcattattttgtactaattttcagcaatgtcaaggattacaatgaaatgtaaagggctgcattattttgtgatttcccgcaatgtcaagaattgacataaaatgtcaca

SEQ ID NO: 4332 - DNA, 1318 bp, Unknown
  Kingdom: Plantae, Phylum: Streptophyta
gcaacgcccctggttttccttttcctttattctcttccaccccgaaaggccaaaacagcctgtggttttagtatcaaactcctatttgtaaatcactcaataacttacatatatataggaattaacaaatcactcacctcacacataccaatattcattcatttagattcatcaaaagcttataacaacaattaaacatgagtgcagccagcagagcttggattgtggcatcaagcattggagcagtggaggcattgaaggatcaattgggggtgtgcaggtggaaccatgcattgaggtcactgcagcagcatgccaagagcaacattagatcctacactcaggccaaaaccttgtcttctgctacttctgctgctgtctccaataaggtcaagaggaccaaggaggagtccatgaggaaagtcatggacttgagctgttggggtcccaatacttcaaggttttagtgtgtggactattctaattgcattcatcattgtgctgcaaggtttatgaagattcaatactacctttgtagcctttttgtcatggcatgcatccctttggcctttaccttatgtatctatttgattcataatacaaaattttgtctatgaaaatggtaaatatttgatccaatgaaaagaaaaccgaggtctgtttttcaattattttgtctgttaagctcaattttaaaattttaattatgtgcacatatggatccttgaatgtttttctaaacgatttatgtccccaattagttatttagtcctaatcatggaaaggaaagagagaacttgacatgatctgtgtattatgtaagatttacaaactccctttttgacggatgcttacaaaagaaaagggtttgaaaatctattttttatataaaaaaatttattaataacgtttcaatacatgctatgatcagctgcaagaattgtggtcgcaattgcttagctcaaccataggtgattgtggtttcagccacataagttgcattattttggactaattttcagcaatgtcaaggattacaatgaaatgtaaaggactgcattatttcgtgatttcccgcaatgtcaagaattgacataaaatgtcacaaggattgcaatgaaatggagtaactattcccgatttggagttagtttgtatcaaaataacagccacgttatctgcactgcagttaagtcactccctttggcttaaaaccaattgcccttaacgtgatcaactttttgtacacttgctttttggcattatttttacagtatttgaaattgtaaaagcaacatttggtgaatatgctagaaag

SEQ ID NO: 4333 - DNA, 1216 bp, Unknown
  Kingdom: Plantae, Phylum: Streptophyta
ttttgtcggttccaatgagtgcaagttgaagttgtgtggtcctacaactactagtgaaacaaactgtggatagattcttaattggataacccaatttagatcctcacctaacaaacaaaacacacgcagcacaccccacaatccaaaaccatgagccttttttttccactgcctctggttttgctcacaaactaaactagtgtctgtgttttccattgtctcaatctcacactatatattaacaacaacctgcaacccattcattcatcttcaacttatattctccataaacacatcaaactattagcaatttagcaccttctactactttgtaatcgttcaagagttgtgaactgtgaagaatgagttcaacaagccgtgcttggacttggagcgtggcagcaagtgttggagtggtggaggccttgaaggaccagggtatatgcaggtggaacagtgtgatgagatcagcacaacaacatgctaaacataatatgaggtctttgtctcaaaccaagaagttttcttttcaatcatctgcgatggcttctgccaaattgaaagatgagaaagctaagcagtcagaggagtctttgagaacagttatgtacttgagttgctggggtcccaactaaacaaagatgctaagacttcatgcaattttggatttccctttttttttcgctcggaatatgatgaggaatgaaagagccagaaggtgcaccaatcacagaagtgtctcaactcccaactaacatgttatgttacatgcatgctgttgatttgatccgatcgaatcagaagcttaattaattgagaaatgagtctgaagcatgcattttgctgccttggagagacatgaaatggatttggaagaggggtcatcattggaatgatgaaatttcagacagaaattgctattatgtataggattttttatatgatgacaccaaggttatgtattatgctgaataactgtaagatgtaatttataaagctaaacaagtcttgagaaatgacttttctctatgaatttttcctgtgttatttttagtagcatccccatcttattatgaaaaaagttaattaaaggaaataagacttatgccgttcaataaacatcaagctttaggatttcactttttttcctggtttgtgctcctagatagtattgtaatattgaccaacacgtaatagtcactcaataaaagtaaat

SEQ ID NO: 4334 - DNA, 1517 bp, Unknown
  Kingdom: Plantae, Phylum: Streptophyta
actttgacccatcctccaggctcacacattgtctcctttaaatactccattttctcttcccctctcattattacccaaacaaaaacatacacaaatacaaattgaagaacaaagaagaagcttcatcatcatcgttacaattgctaacattaacatgtcttgttctgtggcagttcccacttccccagtgttctctttctacaacaacaataacaacgttaactcttccaccgcagaacctctcatgctctctcttcccattccctctacgacgccgtcttgctcctcattatctccaccctcctctcccttgttgaagagaaagagacccgccaaaatcgacattcccgtcgcttctatcgcttttgctgtctcgccgacggcggcgccgtcgccggcgagggacgccttcgaggtcgacggacctgggttttctgtgttttgcaaacgaggaaggaggcatcatatggaggattgtttctccgctgccgttgatcttcacggtcaaccaaaacaggcctttttcgggatatttgatgggcatgggggaacaaaggcttcggaattcgctgcacataacttggaaaagaatgtgttggaggaggtggttaggagagatgaaaatgacattgaggaggcagtgaagcatggttacctcaacacagattctgaattcttgaaggaggatcttaatggtggctcttgctgtgtgacagcattgatcaggaatggtaaccttgttgtgtccaatgctggagattgtcgtgctgtgattagcatagggggtgtggcagaagccctaacatctgatcacaagccttctagagaagatgaaagggacagaattgagactcagggtggctatgttgatgtgtgccgtggtgtatggaggatacaagggtcattggctgtttctaggggaattggagatagaaacctgaaacaatgggtcatagcagaacctgagaccaaagttcttaaaattgaacctcagcatgacttgttgatcttagcttcagatggattatgggaaaaggttagcaatcaggaagcagtagatattgctcgtcctttttgtgttgggaacaataaacagcaacctttgctggcttgtaagaaactcgtggaattatctgtgtcacgaggctctgtggatgacataagtgttatgattatcaaattgcaaaactacatttgaagtctcgtggtacaagagagaagaaaggttgggagggtaaacgggagcctccaccttaattaaatacttcttcattctaattagcttgaacagtagaatcagtcagaatatgatgaatgtgattatgattaagggaaagaaggtggtagcctgaaattaagagtacttaatttttaatctcaatatatcggacgaatgacaatgttattgttgatgatattaattagcactaacttgagtaattatttggtagattaatgatcttgatgtagttagcatcttttgtagtgtataaaaagggttgaattttgtatccgat

SEQ ID NO: 4335 - DNA, 831 bp, Unknown
  Kingdom: Plantae, Phylum: Streptophyta
atggcatcatcatcatcatattcatacgctcaatcccctgcagcaccagcagtggctcatgtcccttccaccagagcaacgcttcccatgttactcgtgatcttcctcttcgccctcctcttcaccgcattctgctccatcttcattcgctactgctcccacgaagaacaaccccacgcgcttccacaagccacgcgcgccacgccgcgcggagtcgacccgcgcgtgctcgccacgtgtcccgtcacgtcctactacgcagtcaaaatgaagacgccgcaaaaggctgcgtttcagtgtgcggtgtgtttggcggagttcgacgacgccgacgcgctccgcttgctacccaagtgcggtcacgtgttccacgcgcactgcatcgacgcgtggctcgcggcgcacgtgacatgccccgtgtgccgcggcgaagtgagcgtggaaatcgagggggaggcacgtgcgcgccacgtgtttgaagaaagttccgtgagaggctttggggtgcttctgaggtcacattcgacgggtcactctttggagaggttcactctgaggatgcccgaggaagtaatgaagaagattctggaagatagtgaacgcgggaatgtgacgaggatgatgaagcgttccgcgagctacgacgtcgttttgcggagcatggaagaagggggtgaaggtagtagtaatagtggtagtaatagtaaagagaagagtagtactaataataataaccggtgggttttatcgatgacgcctccctttgtttctcgcgccgttcggggattccgagagtgtcaagagagaacggttttccattgtgaagtttga

SEQ ID NO: 4336 - DNA, 2200 bp, Unknown
  Kingdom: Plantae, Phylum: Streptophyta
tcaattgcatatttttatgttttttttcttagaaatcgatccctcagctcccactatatatatatatatatacaagtagcataatgcatggtgagcagataaacacttttaacactaaaaagatgaaatcctctcttatcttgttatttatgatctgtggtggagtgattgcaactcctccagaggatccaattcggtgttcttcaaagaacacagactgcaccatcacaaacacctatggcgtctttccggaccgaagcatttgccacgccggtgaggttatgtacccaaacacagaggaggagctcatatccgcggtggcctcagcttcgaagaacaaaagaaaagtgaaagccgccacgcgcttctcccacagcatcccgaagctggtttgccctgatggcgaaaacgggttgctaataagcactaaaaatctgaacaagatattgaagattgacaaggaggcaaggacgatgacagtgcagagtggcgtgtcgctgagagagataatcagcaagggtgcagaggctggattggccttgccatatacaccatattggtggggtttaaccattggtggactcatgggtacaggtgctcatggaagcactttgtggggcaaaggaagcgcggttcatgagtatgtggttgagctacgcattgttactcctgctggacccgaagatggctatgccaaggttcgcaatcttgacgaatctcatcaacaacatctcaatgcagcgcgagtttctctgggggttcttggagttatttcccaggttaccctgaaattagagcctctcttcaagcgatctcttacatatttgaccaaagatgattctgatttaggtgatgaattggttacttttggaagaaagcatgagtttgctgatgtaacatggtacccaagtcagcagaaggccgtgtatagaattgatgatcgtgtctccattaataaatctggaaatggtttatatgatttctttccatttcgccccacactctcggccgcactaactgttgtcagagctacagaggagcttcaagaagcaacccgcgatgctaacgggaagtgcgttggtgcaaagttgataactgcaacactgtcaggcattggttacggattgtctaacaatgatgataaaggtatctttcttgggtatcctattgttggatttagcaaccggatgcaggcatcagggacatgtttggatagtctaaatgatggattgatcacagcatgtccatgggactccagaatcaaaggggaattctttcaccaaacagcatttagcattccattgtctgctgtaaagaacttcatcgaagatgtgcaaaagcttgttgagctggagccaaagtcactgtgtggcttagaaacagcaaatggaattctcatgcgctatgttacggcttctagtgcttaccttggaaaatcagaggatgctgtggattttgacatcacatactatcgcagtaaagacccattggctcctaggcttttccaagacatacttgaagagatagaacaaattggattgttcaaatatggggggttaccccactggggtaaaaacagaaacttagcatttttaggagcaatcaagaagtatcataatgcagataaatttttgaaggttaaagaggagtatgatccacaaggactgttctctagcctttggaccgaccaaatgcttggacttcaagaaggggtgacaatattgaaggatgggtgtgcgatggaaggaatgtgtatttgctcacaagatagtcactgtgcaccaaagaagggatacttttgcagaccagggagaatttataaggaagcaagggtttgtacacgggacgttaagaaaaccaaagaagcagatgatgtcaaggacgaactctgaaagaccaaggacaatttataattttttttatagtagttttgcacttttgcttctcttacaaataaaagaatcttattttccatttaaaaataaaagtgttgtcaatgtcatttaattggttcaaaattatcatttttgaatcaattgacgaggtttgtaaaacaaaaagactacacaacactcaatcaaatgggatttatttattctgagaccatgcaatccaatgtaaccagtaaattagtaatccatatgtgaagatgtatgaatatttattttcagcatctaaaataacattattttacaaatta

SEQ ID NO: 4337 - protein, 393 aa, Unknown
  Kingdom: Fungi, Phylum: Ascomycota
MVPAISQGYAAVSTDGGHDGIGQTPQRALADSWALNSPGNVDLYALQNFASVALNDMTVLGKQLTEAYYGKSISKSYWVGCSTGGRQGLMLAQRYPDAYEGILAQAPAINWAEFIPSMFWPQWKMQQLGYYPPQCELDAITAAAISACDELDGRKDNVIGLTGLCDFDPSTVIGQQYACGSVTGTISKKAAELAKTVWEGATNAEGKLQWPGVAAGSPLSGNCTGAPFTISTDWHRLFIQKNAGFDPYNYTQAGWDAAFHASVQQYTSMIGTADPNLSAFKQSGGKMITWHGMADQLIPFNGTVHYFSRVLSHNADATDFYRLFSAPGVGHCRGGSGAVPTDPLAQLVSWVEGGEAPQTLAANRTVEGRNWEQELCQYPLSSIYKGGDPAVAS

SEQ ID NO: 4338 - protein, 151 aa, Unknown
  Kingdom: Fungi, Phylum: Ascomycota
MAQSGVSVAPECISAFNELKLGKDTKWIIYKISDDWKEIVVEETSKEADWSVFREKLLNAKSKDRKGKEGIGGRYAVFDVEYELENGEGTRSKITFISWTPDDAPQYPRMMYSSSKEAIKRALNGLAADIQANDADDIEFDNIKSRVSKGR

SEQ ID NO: 4339 - protein, 556 aa, Unknown
  Kingdom: Fungi, Phylum: Ascomycota
MRVKTVSLLVAAAAGPASAFAAPPIEARHYGNSTTCLKTTVAVLGAGVAGVTAAQALANQSITDFLIVEYNEQVGGRMRHTNFGSDAAGNPYVVELGANWISGTGTLNGPENPIWTFAKQSNLSSTYSNLSNIATYDETGASDYLDILNEYDEAAGAVEQAAGRILSENLQDRSQRALYSENGWKPKRDAHRKAVEWWYFDWDAAATPEESSAVFATTASNLTYYQFKDEDFFSIDQRGYNAWLKAEAAKFLQPNDHRVLFNTTVKGIEYSDSGVKVTNDDGSCIEAQYAICTFALGVLQEEVVQFTPALPDWKESSIATFGMGTYTKIFMQFNETFWPTDKEFFLYAHPTTRGYYPQFQSLSTEDFFPGSNILFATVVDEQSARIEAQDDETTKAELMEVLRQMFPDIDVPEPIDFMYPRWGQNPWTYGSYSNWPAGTTLEMHQNLRANVDRLYFAGEHTSAEYFGFLHGAWFEGHEVGKRIAGALGKECLNEGSGCGDYKRYEVLHGTTDRLEYNGYNGMGADPFFVSEGDEDNIGTITRRSLKRSGHKRRHHK

SEQ ID NO: 4340 - protein, 1408 aa, Unknown
  Kingdom: Fungi, Phylum: Ascomycota
MPPVLNPFLRAFFRSALPSQCSPAQHHVLLVPTTEVLLGARDKDSGSAYADLSGSEEFLASHVLRVPGGVGPNNHVRDASSFRETRGKAKQFTTANGRTVIVKDAFVYSNKGFKTLNQAQLLSDTIFYPDTFEAQPWLVYYISRPLIGTYEPTPIIPATLHAPQHVQPAAAPAAGSSQGPSVASGSSMPRKKEVKSFGDLLNHFPMIARQMQPGLERLFKEFAKELEKPLPPTPSTRSRRSSQSSRRRGSVSSVETAGSRPLSMHSSMSQGPNGFISTLEIGDEEDAMRNSLETAVTAAIDLFQMVDKQQLSLLGATTDLTGPIVERMIERYIAEQVHHTLLFPRICDIRRLEDLDLERQTRQMQDIDISQVGIDIGNGRKGKQELAIRLSKAVDMFKKMGVAGSPQEMLEIVLAVTKHITMPDATSVANDPTAQATLNGQQLSEKHDHLLTINADTLVSLLLVVVIRAPVRHLQARLSYMRHFIFIDDVETGEMGYALSTFEAVLSYLQNDSGGLRRASRRNRKLWQATQSGDLATMQGILEPDRSFHEAMNDSSSEDEAPERHHPVRFASFSDLNSLASSSMNGDFEPRRRRRRSPSNSRSRNEDGPLAHIFPFQRAQTPTLPDRPKLKKTVSYDTRSMSSCSARSFRSRTTVDSRYSAIEGDTSIEKLVMTQGTDGESILMMAIESKQDKALQYLLSLTEYYIPTFVFEDCNNEGTTLLSLAVQLAHAKSTDTLLAYILENSASPEMLAAYFSKQDSKGRCMAHYLFNQPRLIQRIGHLVPWRLKDKNGQTPVFALCRSYDHEEYHSMVDQGLLAATFAQEDGQPLHLDEHVDAKGNSLLHVITDPQLANKLLYRCDSDANATNDKHFTPLMVASKYGRTDMVRVLFQDPRVDLSVRDARGLTAVELAKDDDVRNRIDDLVLLSNEPGADGRITTVVRSFFVEDGTVRLVLKSGAPNSNGTITVTTCRRSSHDFENLAKWLAQENPASWLPVIANMASPYLIPSRPSRSVLRDLQLRLDAFLKILLRHPTFSMHEMVWEFFLVPDIDSSMLAARSARKAELRVERLREDFAPIYDVREVELFVQHARENVRSLHHASKSVLRRTNKLRMVTSDLVDAHRLSNTAVHSLTFLPPAHLDAFERYTKCIGSSEASPIAGFYYSMHALSSTISAVLTALARPSNLIAQMNTTQKTIDRHNVSVRRSDRWPLGLLDDARSRVQRDALDKMARSKLELEDLGRELRYSQTVVASELASWQERRVEMGRSAVRDLARRMVVTERARLESMKRAVRGLGIGRKETLANGSAVEAGVGPTRQTFDYVDEQLVNGVSGKGSAEAPSQELGDEVVEPPQELPVEDLIEDPNSASSAPETDEEPPLLDIAAEATKQLDGTTAAASPDSAPPDTLSKD

SEQ ID NO: 4341 - protein, 1891 aa, Unknown
  Kingdom: Fungi, Phylum: Ascomycota
MRSSVFAALIGLVGAQSPAQNSTISSSSLTAIASSVSLTLPSSATTSSASPAITVALDGSGQYTAINAAINAAQNSGVPTVTILPGTYTEAVTIYGTATVTLVGATATAAADWSQNQVVISNPAAPLTIGTSNTKGVTLKNINFVTTASTANAVAVSLRGSNIAFYGCSIVSPGATAVTSSYGLTLFANSRIEGTDKIFYNVPSMYIYKSTIVPLASGASIVYSKGATVGIFYNSTVVFDSSSVEQKPGYSNTGVFLAAPNGAGATVIYRNVAMGSFISTQGFHPTAATVPSFYGEFANTGAGSYASNAAARPSYDNLLTTDQVSQYNIDKVYGTAFPPYGSFSTSWIDSSVLSSIADSDVAQLSTVAASSTAISTASVMPSSTSNATTSATASPTASSCAPSATLTVSKNPGPCDYQNVSAAIAALPNDSNAYTIQIGAGIYDEQISITRKGKVTLIGVTNSTRDYTQNQVTIRTSNGVLTSAGQNEITPVINAKKVYDNSGLALYNINFANVYPQTKNTAALAADFYGANIAAYGCSFTGFQDTLLANKGTQVFSNCYIEGSVDFIWGFSTAFFHQCMIVSNTPGACIAAQSRQTATTAGGYVFDRSVITYSSTYGSSFGSTYLGRPYSEFSIAVYTNCFIDKHISAAGWSVWSTSSPQTSGVMFGEYGNIGPGSWQANTQRASFATNLTASQASQYELAAWIGDTSWLDQTAYNYVPSYSLTGTSTSTSPASNTTTSPGSTTTSTINAHPDSGAVPPANAIVVSVDGSHNASFTNLTAALASLPNDNTNQTIFLYAGSYNEQVPTINRPGAVRIIGYIAGNSGQSYKDNTVTVTFSRGLSVSPLPAGHSDAETATVQTASSRISFYNIAMINTDNLDGAQASYVTLAASIYGNDIAFYGCSFDGWQDTLLTGSTTGYQYYESCYIGGAIDFIWGYSKAYFKGCTIGAKRKSSAITAHNRASSSAIGGYIFDNCLFTTAPGVADDLTNKVYLGRPYSAYAQVIVKNSYIDSTIAPAGWKIWSATDPRTDHITFAEFNNSGPSNWENNVAARQAFGFATLLTSDTYSLSSVMDSTEWIDMTYWNSIVTPSPAIVVPSGPTNITVGGNSTVDGTTPPAGALIVSKSPIAGTTTYQTVQDALNAAPASSKTNATIFIYPGVYNEQLIVNKSGTTIFMGYSNATDDYSQNQVSIEFNHGIDTQGTEGSNTDGATVYATGNYFYAYNINFRNTAGTTQNIASLGFAVKSSKYAALYGCQIYGNQDTLDISGYLFTFKTYIEGNVDFIFGNGAAYFLDSTISPNEDGISITADKRTLNTTAGGLVFDQCTLKPAPGTGPFKNIGLGRPWNSNARVVFVDCYLDSMISAAGWNQWSKSTPNTNGVTFGEYRNYGPGSSICGRASFSQQLSDAEVVQFQLGNFFASTKFIDFSRVDTQPFTLGIGSAQTCATASSSIVSATSTASVSSSSLSSSLISTSSLPVVTVYTTTTAIVKLTASTTVTAPDAISTTVVKITSTASVSGADVVKTEIDKETATVSYTSPDVTSTSTLLVTEDAGLTITPDPVTKNSVVKATTTIGGTTTAKAPTLTIKGTTTVLSIQTVNPKPTTITQSEGSTATVISSVKPKGASTTIKTTISLEPSSTKTTTIKAKSSVTVSSVSLRTVTKKTTITESCIPTEPARMVRRGAVIPRAAATAITTTLTVSTEVTSFVKTATATQAGSTALVTETSVAKIKTYTQPGATNTLSVTSFVKTTTIAQAGSTAWVTETSTKTVGKTTTLKASTVTVLSTSYITQQQLQTVTPDALTISNLQTRTSTQVVTAAQQTVIVTKSADVTSTIRTTLPVSTNTVYQTITQGGGVATSTVTAPPGTKTVVAKSTITVWSTATKVAKNAQACE

SEQ ID NO: 4342 - protein, 310 aa, Unknown
  Kingdom: Fungi, Phylum: Ascomycota
MKATFASILALATAASAQVKGFNYGATNNDGSCRGYSDFVRYFNDAKSLPGASGFQTARLYTSIQCGTAASPIEAFRAAIDTDTKILIGLWASAGRGVYENELNALLAAARDLGPAFTDRIVGISVGSEDLYRSSPQGVANNAGVGATGAEIEGYIGWMRDWIRGTALESKPIGHVDTWTAWVLPENRGVANSVNWLGHNSFPYFESTKPNSIGLAAQNFRDAVAQTESVAGGKEVWVTETGWPRVGPNSRDAVASTENSQRYWKEVGCSLFGNRNTFWYTLKDANTAQTDLSFAVTPLESNTPYFDLTC

SEQ ID NO: 4343 - protein, 249 aa, Unknown
  Kingdom: Fungi, Phylum: Ascomycota
MKLSTLFTCASTAALALAAPTTPASVLSKRADFCGQWDNQVQGSYTIYNNLWGRDQATSGSQCTGVDGLSGSTLKWHTKWSWAGGAGHVKSYANVVTKISQKAISSITSLPSTWTWTYTGSNIIANVAYDIFTGATATGSAQYEVMIWLSALGGAGPISSTGSAIATVTIAGKQFKLYKGPNGQMTVFSFVAVSPINSFNGDLNEFLVYLRGNQGLPKSQILQSVGAGSEPFSGSNAVFTTTAYNLSEK

SEQ ID NO: 4344 - protein, 206 aa, Unknown
  Kingdom: Fungi, Phylum: Ascomycota
MKTAILTFALATIAAAAPAPLVPRAPPNVPTTAAAKTALAGLTVAAQGPQTGYSRDLFPHWITQSGSCNTREVVLARDGTNVVQDSSCAATSGTWKSPYDGATWTAASDVDIDHMVPLSNAWKSGASSWTTARRQAFANDLTNPQLLAVTDNVNQSKGDKGPEEWKPPLTSYYCTYAKMWVKVKDVYGLTITSAEKTALTSMLNTC

SEQ ID NO: 4345 - protein, 317 aa, Unknown
  Kingdom: Fungi, Phylum: Ascomycota
MARFISLMLLGAAAVSASPLVAREATTVTVTADPAAATGSAWDAGAVHQYPIHASCNATQHQYIRNGLDETITLCRQARDHILRWGNSSAIYQKYFGNAPTGEPIGWFTKIVDGDKADVLFRCDDPDQNCATQNNWAGHWRGANASSETVICDRSYILRRPLEGMCMFGYDVANGATNFYWASDLLHRLLHIPNVGEGVVEHYGDASEYPGVLALAESNPSEAVRNSDTLQYFALEVYAHDVAVPGVGCPGHYREVSSSAAAAPTSSASAAASSVVASATAAASATSAAAGATASCTPHNDHWHCPPGVPEPTSPPA

SEQ ID NO: 4346 - protein, 873 aa, Unknown
  Kingdom: Fungi, Phylum: Ascomycota
MHRTLAQTLLAIGLVQAQTYPNYTNPTNSSSPLENAQSPPFYPSPWMEPVTGDWAAAYAKAQAFVSQLTLLEKVNLTTGTGWQSDNCVGNVGEIPRLGFKALCMQDSPLGVRFADYVSAFPAGGSVAASWDRGEFYRRGYQMGSEHRGKGVDVQLGPVVGPIGRNPKGGRNWEGFSPDPYLSGHAVAETVKGIQDAGVIACTKHYILNEQEHFRQPGNFGDFGFVDTLSSNLDDKTLHELYLWPFADAVRAGTGSIMCSYNKANNSQVCQNSYLQNYILKGELGFQGFILSDWDAQHSGVSSTQAGLDMTMPGDTDFNSGFSFWGTNLTISILNGTVPQWRLDDAATRIMAAYYLVGRDQDNIETNFNSWTRDTYGYRNYYGKSDYELVNQHIDVRDEHFRAIRSSAAKSTVLLKNNGALPLKGNEKWTAVFGEDAGENIYGPNGCSDRGCDNGTLAMGWGSGTADFPYLVTPLEAIKREVTDAGGVMTSVTDNYAYSQIQATAAQASVAIVFVNADSGEGYITVDGNAGDRNNLTIWHDGETLVQNVSSLCNNTIVVIHSVGPVLVNSFYDSENVTAVLWAGVPGQESGNAIADVIYGRVNPGGKLPFTFGADAAEYGPDLIYEPINGHDSPQDNFEEGVFIDYRAFDKKNITPVYEFGFGLSYTTFSYSNLNVEKKNAGQYTPTTGQTIAAPTLGNYSRDLNEYQWPANLTRYGTFIYPYLNSTDLAEASFDPEYGLNYTWPAGSSDGSPQPRIAAGGAPGGNPQLWDVLFTVTASVTNNGTLPGDEVPQLYLSLGGPEDPAVVLRGFDRLSIQPNQTVTFSTDILRRDVSNWETETQNWVISEYPKKIYVGASSRKLYLEADLDLSEYQS

SEQ ID NO: 4347 - protein, 425 aa, Unknown
  Kingdom: Fungi, Phylum: Ascomycota
MPSSRLFFVFALLAALALAAPSQVRRRSLAKRSFKVPRQLNLAHPTGPNGAAAMRKVFRKYNFVVKEDFAGFSRAATNNTATAAAAGGNKTGSVAANPEQNAALFLSPVDVGGQTLNLDFDSGSSDLWMFSTELDKQTIGQHAAFDASKSTTFKKVQGAQWKISYGDGSGAAGTVGTDTVTIGGVKVEGQTVELANAVSQSFVEDTNTDGLVGLAFSSLNTVNDGTKKTPAKTFFDNVMGSLDMPVFTADLDPDGTGVYEFGKIDATKFEGQMAWIPVKAETGFWQFPSTKFAVGNQLFENPQGSDAIADTGTSLLLVDQQVAEAYYSQVKGAQLNAQVGGFIYPCAATLPDMSVAIGDSYMAKIPGNMITFAAVDQANTTCFGGVQGNQGAGLQIYGDTMFKAQLVAFNGGNQSLGFGQKPVPK

SEQ ID NO: 4348 - protein, 360 aa, Unknown
  Kingdom: Fungi, Phylum: Ascomycota
MRTSLLNLALFAGYALARPHEHAANGTYEQETRSIDEIYQAALAEGGVVTLWHGGDEKTQQNFLKQAFEARFPNMTLNVTVDLSKYHDGNLDLQLAAKDVYVDSIILQTLHDFPRWKKENALLNYAPLNFDKLYPVFRDADAAYAGLFILAWSIQTNTNKTASALTSYNDFTKPEYKDKLALTYPNDDDAVLWQFDLLLKDPKFGYKWFDALLANNPRWVRGTATPKSLLNKANSSSVATFTSGHSFSATPGYNYALPTEGSFVSWGQTGAILKDAPHPEGAKLLHNYLLSDEYQKNVRWSTREDIPGPVGGQKILQQPNTNAPEFIEWMADREYVERLRFYFEDRIGTAQGLSPLEDDL

SEQ ID NO: 4349 - protein, 557 aa, Unknown
  Kingdom: Fungi, Phylum: Ascomycota
MRFTSSVVASAALLSTANAAIKGFNYGAQFNNDAAKTLTDFEYEFNNAKTLPGTDGWTSARLYTMIQHGTQNTVIEAIQAAINTKTTLLLGLWASAGQESFNNEIAALKAAISQYGTAFTDLVVGISVGSEDLYRVSPDGAGGNPGAGPDVLVSYIKQVRDAIAGTPLSGAKLGHVDTWQVYVNASNSDVIENLDWIGMDAYPYFQSSFANSIGNGGDLFFDAYNQTVAATKGKPVWVTETGWPVSGETVNQAVPSADNARIYWEDVTCKLVKDNVNLYYYILQDVQWGNPSPSFGIKPGGDLAQVSPLFDLSCPNNTLSLPTALSSSVGAVESSSRSSLGGFTWPSLRASSTTAQFAIATAPVITSNTPAPTELVPTAATSQSLLDIESLPEASASHVGLQGPFETPNLIVPVDKSDPSKIIGNGYVGQLSSTLATVFVYDVRPEYQGRTCNLAFHMPPASPWPDMSPVKIRSPGGIIVSSVGQQAVSAETSASNVISSGVVGWIPSISPSNQYDLASFPCPAGQRVAYQAESTGGLAMDFFQMTMPPLGMFMSVS

SEQ ID NO: 4350 - protein, 305 aa, Unknown
  Kingdom: Fungi, Phylum: Ascomycota
MKTTAFWTSIALARAVLAQGLRQATGGDEPTSAVQWYPTPTPEVSNCTASLITTLCDYKEPGSAFAVASSGKAHCWEYCNSHQPCNFVIFAAGNPYTGTGTCWLYPDEQFDKSAGKEGCDYLSVYDKPTCAEPTPTSGACTATASPSAIASICDYPTPDDNCWSSCTASGGATDCLSQCAESASCSYVVFNPRNEDLSPFSSGTCWMYPNGTYDATKAGSCSGKPEQFVYENSCPKPAPSSTPSGSAPASASASAPTATGTNVDAERASESVVTPTAKPNSAALVDVSDGGWLVVGVAVLLWPAM

SEQ ID NO: 4351 - protein, 388 aa, Unknown
  Kingdom: Fungi, Phylum: Ascomycota
MKSSVLLSLSAVALAAAVATPKEPQVVLQNPQVTIDEPDQYLIELSPGETRWVTEDEKWALRRQNINFFDITNTDDLSILSKEIAAKKVTFPSKPAHNKTVVPLLKELEKDNMRTHLETFTAFHTRYYKSQYGAQSSAWLLKQVDGTLKDAGAKHASVKAFPHPWGQSSIIATIPGKSNKTVVIGAHQDSINLFLPSILAAPGADDDGSGTVTILEALRVLLKSEDILKGEAENTVEFHWYSAEEGGLLGSQAIFQSYQKERRDVKAMLQQDMTGYVQKTLDNGEPESVGVITDFVDPGLTDFIKEVITEYCDIPYVLTKCGYACSDHASASKAGYPSAFVIESDSKYSDSKIHTTEDKIEYLSFDHMLQHAKLTLGLAYELAFAKFE

SEQ ID NO: 4352 - protein, 540 aa, Unknown
  Kingdom: Fungi, Phylum: Ascomycota
MRQSLISSAALVGAAQALKSTCTPSAIQAALPEGASVNFAYPVPANGTFETPKGDTGYPASPPNLPALCAASVRVKAVGNTTFGFGIFLPEEWNGRFLAVGNGGFAGGINYADMASGVRYGFAAISTDTGHNSTSSDGTWAYKQPNKVENWGHLAMHGSVVIGKEITAAYYKQNATYSYYSGCSTGGRQGLKEAEFYPEDFDGIVAGAPAWWTSHLQPWTVRIALYNLPATADYHIPAPLFATLNAEVIKQCDPQDGLVDNIISDPKGCNFQPITLLCGSNSTANATSCLTGPQLDTVYNIFSDYVGENNTILFPSYYLGSEGQPFLIAGNTPNPLGTQYVQYFLDKGPQWNFTDYNDEIIALSEAINPGNATVGFDLSRFQAKGGKILSYHGMADPLIPTGSTPYYYDHVSRTLKPKGVDVDEFFKYFLVPGMSHCSGTQTSMNAPWYFAGGNQQVALAPDVYSVPGFEDEEHDVLKAMMAWVEKGRVPEYIIATKYVNDTTHDEVLRQRPVCIYPKQAKYTGEGDANDAANWECKGLY

SEQ ID NO: 4353 - protein, 487 aa, Unknown
  Kingdom: Fungi, Phylum: Ascomycota
MKYLPILLAAGAVAELSQVPFQDTPEAEGFQTFQSQFSEHHSIRIKQQQNDTLCDARSKQYTGWLDVGSKHIFFWYFESQDKPSEDPLLLWLTGGPGGSGMIGLLQENGPCLINEYGNGTVYNEYGWSKNANIIYVDQPAGVGFSYIDEGTPVPSNSFTAAQDMHHFLQLFTTDVFPKLKGKEFHITGESYAGHYVPALGAEIVSQNLLYPKRPQVNLQSIFVGNAYVSPLDTAFGYWETLCTTNPGVESPVFNQTRCDIMATHMPRCLELSRVCYDHPDPAICQAAEQVCWNGVIVHYDGESGEGGNRNRFDITHPCETHDDLCYPQIPRIGEYLNLPSTYEALHVPKAVGNYSVFSAEVAIAFELTNDLGISTQPQVFYLLENGIDVLFYQGNLDLACNTAGNLQWANSFQWKGQPAFVAQAKQTWKDGKDEVGWFKEVKIVTGSGKETTFALSTVDGAGHLVPFDKPKEALALVDKWLTERSFK

SEQ ID NO: 4354 - protein, 421 aa, Unknown
  Kingdom: Fungi, Phylum: Ascomycota
MKFLGITLASLGLVSAASVSNKQKVSYDDWKVFRVNGPSNTAKFQEVVKKLQLDVWKGKPSSGDVVDVSVAPEQLSAFEEATKDFETKVMHENLGASISDENNFSVYAAGAVPNATWFNSYHSLADHYQWITDLAAAYPSNAEVISAGKSVEGRDIKGIHIWGSGGKGSQKAVVWHSTVHAREWITTMVNEYAAYQLLTSTDATTAAFKNKYDFYIFPVVNPDGFYFTQNSNRLWRKNRQSTPSASCIGRDINRNWAHKSWGQAQGASTSPCDEDYKGPSAGDGVETKALKAHLDGLAAGKGIQLYMDIHSYSQLWMYPYGYTCNGAVPNSASYASLTKGAIAAVKAVHGTTFTGGPICNTIYQVSGDSVDYALENAGTKYSMTVELRDTGNYGFVLPANQIKPSGEEMWAGLAYLLKNMT

SEQ ID NO: 4355 - protein, 566 aa, Unknown
  Kingdom: Fungi, Phylum: Ascomycota
MKYAYTMTALAALATASPMLQVGTIHNDAAPILSSTQAKEIADNYMIVFKKHVKHEHTKDHHQWVQNIHEKAQSDRMELRKRSQFPVTETLFEGLKHTYNIAGGIMGYSGHFDEDTIEAIRRHPDLHAGVAMLEPGDKAAQPKRAIELYQHVDYIERDSIVHTLGSDDYETEKNAPWGLARISHRDSLSFGTWNKYLYSADGGEGVDVYVIDTGTNYKHVDFEGRAHWGKTIPSGDADEDGNGHGTHCSGTVAGKKYGVAKKANVYAVKVLRSNGSGTMSDVVKGVEWAAQSHSDAVSAAKKGKKKGFKGSAANMSLGGGKSTTLDLAVNAAVDAGIHFAVAAGNDNADSCNYSPAAAQNAVTVGASTLLDERAYFSNYGKCNDIFAPGLNILSTWIGSEHATNTISGTSMASPHIAGLLAYYLSLQPAKDSSYAVADITPKKLKANLIAVGTVGALSDVPSNTANILAWNGGGSSNYTEIVEKGGYKSTKGSSKDEPSGYTITIPSVSEIEDEVADEFEKAKGAASRTAHQVGGKLSKLEAEIEDFVAEEMEHMFQEFKERVARE

SEQ ID NO: 4356 - protein, 376 aa, Unknown
  Kingdom: Fungi, Phylum: Ascomycota
MRFSVFAAVAALTGSAFGADAVKGSAEGFAKGVTGGGSAAPVYPSTTAQLISYLSDSSPRVIVLTKTFDFTGTEGTATSAGCAPWGTGSTCQKAINKDGWCDNYQPNAPKVSNIKYDKAGVLGMTVGSNKSLIGQGSKGVIKGKGVRIVSGAKNVIIQNVRFTDINPQYVWGGDAITLDGADLVWIDHVTTDLIARQHIVLGNSASNRVSITNNEINGATSWSATCDGRHYWGLYFTGSSDTVTFKNNYIHHTSGRSPKVGGNTLLHAVNNYFYAIAHAFEADSGSKIVAEGNVFQNVDAPAQSGLPGKVFASTTNLAACKSYLGHNCEQNAFGSSGTLAGTDTSFFSNFQGKNVASASTAASAKNVVNTAGYGRI

SEQ ID NO: 4357 - protein, 190 aa, Unknown
  Kingdom: Fungi, Phylum: Ascomycota
MSSEPSPEEQKRLDAEAKAKEQAEQAALPYKWDQTIKDLDITVPIESKFKGKDLDVKIARNTLRVGIKGQAPIIDGELPHPIRVDDSTWTLSTTAAGKDIEIHLDKVNQMEWWAHVVTSAPKIDTSKIQPENSKLGDLDGETRGMVEKMMFDQRQKEAGLPTSDEQKKLDILEQFKKQHPEMDFSNVKMG

SEQ ID NO: 4358 - protein, 554 aa, Unknown
  Kingdom: Fungi, Phylum: Ascomycota
MKATQTWAALLSTALIASAAPIAQNCTSESDYDVIVVGSGPAGIIVADRMSEAGKKTLLLEQGGPSYYITGGRERPGWLNGTDLSRVDVPGLYKSIFSLGGNLTCPADVVNAFQGCTVGGNTAINAGLFFQPPASDWDLYFPAGWKNADMQSAIAKVHAMQPSTDLPSADGKRYLQSGYDAAREWLVESAGYAEVGLNDGWENHSKTKVFGHPIYNYEGGQRSGPAKTYLQSALKRSNFHFQTGTKVVRVIRDGQTATGVEIKLKGSDVTSIVNIAKNGRVVLSGGALQSPQLLMWSGIGEAAALRNLSASGNLTLPANQWINNSAVGDKVFDNPNTFIELYSESISSYIFNYTDPIPVDKDLYLKSRSGPYSFASQTSAFWDFIQQGNETIGCQGTTDSSGFGSFMENGTITLNVYGTSGMRSLGRVGLDAKGIATPSIEFYSDKRDVQAIGQFVYNIFQKLPKTLKPLNIAGNSTLEEITTWLGTPSEYTLGNVQHWSSSCRFETCVDADTRAIGTDNIHVVDASISAPLTTNPVLGTMIIAERAVEKILAL

SEQ ID NO: 4359 - protein, 523 aa, Unknown
  Kingdom: Fungi, Phylum: Ascomycota
MAPSRNSQRALLLSATLGLANAVYLPEATAAPAKVEVRAPVVTAAPIRFDERYSYVERRNILDDITSGVGGAIKSLESVIGTALPSFFTDGIPGWFENLPTGSQVMSSLGINDDDLSAIPTQVLNVPPYANWTDQGWNVRFHGNVYKIPNISQSKIDDLANIFLIDTSVEQLPAEQQANARNLTRSIFVVQQGDVNVTMTLEPAPMQGGDGEPGGGNSIQAPGGNQTIKLPYETTPEGDFDVFVPIQSNGLINGNETENVQRLNVHTLGTDSGNATAFLVPPTGITFISDIDDILRVTKIYDPKEGLLNSFARDFTPWMNMPDIYRNWSQSLPNNTHFHYLTTTPEQATRNYMDFIYKTYPGGSFDTRPLNFSDVSATLAIRDYLLRKIFATFPERKFVLVADTSNSDVMKDYPQLAHDFPNQVQCIFLRNTSSTDSSDWFPYNTEGFKGLNNRSYMFFHVPDDLTGLDIANGQCLNESIKQNVTFSRQAEVLGIHGSAGSKVGGGATISFVVALVAAMVLTL

SEQ ID NO: 4360 - protein, 1296 aa, Unknown
  Kingdom: Fungi, Phylum: Ascomycota
MTRSTSVWAAALVMASMSGSGPIAVAEAMPAPQPQQTQGKPRYYFPRHVKRQINTETANVTAPATPSPSSTSVSSSSSSEKREPQIPNFTSWFNSLINSQSSSSSPSTSDLFSTLSELESSSAAPSSIIITTSTPEQSQPQPPSSTGSSSSPAGLSSSTTPEQVSSAPAPSSAPVETTPEIVSSNLAAAPSTTPEEPTTTTIVVSSVPEEPTSSVVAAPSSTPVSTPEQQPSSSQVQNTPEEQRPASTGVLPPSSEIVLPTSSASPSAPAAATSKTPSDTEEPSTTPAAQQSSAAGTGILPQLSEILSPILSPATSSSPSPVPTSQAPEVATSSTARQPSVGLPASSDIIPPTTATTETEAATSAPVEQQSTGVLPPSSAIIQPTTGVLPPSSEIVQPTTSSAPSAPAQSIADEQPTQSSSGGGLLSSLLGGLLPSSSGLPASESIVQPTPAPATSEQQAAPTGTLPNVIISGTTSAAATSEAPSSAPSSFQGPFIVPGTSETPSQATTSDAVERPTSVASTGSMPPASEIVQPTTSAGLIGGLLSSLLPEPTQGASSGLLPPASEIIQPTSGLSSPVQSPEAVPTSQAASTGGLVGSLLSSILGAEPTPTSAVESGIIPSSGVVPTGASSGGIIIGITTALGTESASPTASATITSGASGAIPTSEGTPTSSALIDLSSLLSSLVSEVAPTGVLPSSGSANPTAPVSASVTPSPSASGLLPSVAPSIISELSSLLSSAVSAVPTGSALPSVISSLVSSAESALTSASILPTGTLPVPIPTSDISSIASSIASDFSSGLISSGILPSATVSGSITPLPTGTESVTPSASASLSVSSGILPSFTLSGSDVSSGIVPSTSVGTAVSSSATISPSETLSIPTSIPASESPSSSGLISSSAVPTASATESTSVATSIASPSASGTGSLASQSSVTPSATLSASETLSTASAPASSSVIVSASSTVISSVPVPTTPSATSSQSPIRTVAPTATNTETTLPILTSIVQENSSIPSPTASTSVGIPSSLPRMIAPPGGVPSEVSQDTFMGQVCFKWPLNYPFVAGSEDNGNQIFHYLPMAIANGLNISTSEVKNYGLKPLDTTQYQGFITTMAMFTIPKDLQGKLAAQLRNPADPFWHNKDSTVNDLTNLINTACPLAAGGTIPGGSNVAGNDPAATATGGAGDGGALGGDAGASRKINPTSAGIATGAIVGAMAYGAAMFFVARRYRNKRIAHSRSSSVPSTSRMTYGSIPGGAAAWMRGARDGRMTPGSRGSHGSASSRGQSIRTQQISAPVMAENSLGWN

SEQ ID NO: 4361 - protein, 609 aa, Unknown
  Kingdom: Fungi, Phylum: Ascomycota
MALLTRLFALAASLAVSSATTIAEINGNKFLSPLKDKTVSNVTGVVTAKGPDGLWIRSTTPDDDERTSESVYVYGRTFGANLTVGDAITLGGKVTEYRSNKDYIYLTQISSPVLGKVVSKGNKVTPLVIGKDTGNPPTEQYSSLDGGDVFAVPNNVSQISVANPTLEPKKYGLDFWESLTGELVTVKKARALTKPNQYGDTWVAGSWKVTGTNDRDGLTTTDKDANPEAIIVGTPLDGTKNPTETRMGDSLEEITGVVTYAFGYYRILPSTALKVTGSKKPLTPKPTKLDSKNDCGGITFGAYNVENLAPTSAHLPHVAEQIVDYLKSPDVVFIQEVQDDNGVTNDAVVSANLTLSTLTKAISAAGGPNYTFVDIAPVDDKDGGAPGGNIRVAYLYKPSLVRLYKPNPGGSLDKTEVINGPALSFNPGRIEPASEAWTASRKPLVAQWEVIGKKGVSSGNFFTINVHFGSKGGSSSIMGDARPPVNGGVDDRLEQASLTANFVKEILSKDKNARIITAGDFNEFTFVEPLKQYVQISGLKDMDAVASIDELERYTYLFDMNAQQLDHMFISPSLTSKAKYEHIHLTTWVSYDEQVSDHDPSVARMDVCV

SEQ ID NO: 4362 - protein, 614 aa, Unknown
  Kingdom: Fungi, Phylum: Ascomycota
MRDFLLASVATASVMFARNAEAVAANPLPKPSNITWGDAGCFSVASLTLSGSGHEVLQQAFDRATKTITDLKWVPQAIEAPMRQLEPFPTQTATKKTRRKRQYSAPPTGNCTGRVTTVNVEITNTYAALQHGVDESYTLDIPAGSQSIDISAKTVYGALHAFTTLQQMVINDGKGNLIIEQPVSIQDAPLYPVRGIMVDSGRNFISKKKIMEQVDGMALSKLNVLHWHIIDSQSWPLEVSAYPEMTNDAYSPNEVFSHDDLKEIISYAAARGVRIIPEIDMPGHASSGWGQIDQDLLTCQDSWWSNDDWALHTAVEPNPGQLDILNNKTYEVTGKVFKEMADIFPDNWFHIGGDELFLNCNNFSSRALDFFNSGKTMGDLYQYWVDHAIPNFRKQANKTFVMWEDVKLSADVAATGVVPTDIVLQAWNNGLEHISNLTALGYKVIVSSSDFIYLDCGYGGWVSNDPRYNVMINPNATDGSPNFNWGAGGGSWCAPYKTWQRIYDFDFTFNLTDAQKSLVQGAIAPLWSEQVDDVIISQKMWPRAAALAELVWSGNRDENGNKRTTELTQRILNFREYLVANGVQAAPLMPKYCLQHPHECDLYQNQTTLWDNSV

SEQ ID NO: 4363 - protein, 616 aa, Unknown
  Kingdom: Fungi, Phylum: Ascomycota
MAVFSRLAVAVQLFSILIAPTLGAAVQQYDYVIVGGGVTGLVVATRLSEDKSKSVLVIEAGDSVDTDATKIPYFANSLTAANGLMWDGINSNPEPGLGNNSYPVIVAKVLGGGSVINGMVYDRGSAADYDAWEALGNPGWGWNGLEPYFKKGTTYQPATPDVVKDFNITWDASTYGNGPLKVSVTSNQYADLKTYFKAWKSMGVHVPEDGNSGDAYGPSWYPNTMDATTGRRAHARYAYYDPIQSTRSNLKIALKTTAQKILFDDKDKPTATGVEIVGAAGVVSTVRARKEVILAAGSIQTPKLLQLSGIGPKAVLKAAGVKVRVELDAVGSNFQDHPWATIMFNTTPQAFPNVNSLATNTTFNASAWAQYEANKTGPYTNARGNALAFISLPDMISSQEVNSLVSSVGNQKEEDFLPAIYKGNRKLLKGFAAQRKLIADIFKRRDAAVTEFPVPQDAAFSIVGVEKPLSRGTVYLNASNPTGPPAVTHNAFVNPIDRKILGIGTRYYRSYLASPLLSSFKISEKVPGAQYKTDTEIFDSMLAQGLLSPTLAHPSGSCPMMPESSGGCVDEKLRVYGTRRLSIVDASIIPIIPSCHLQATMYGIGEKAADIIKARR

SEQ ID NO: 4364 - protein, 790 aa, Unknown
  Kingdom: Fungi, Phylum: Ascomycota
MEQVRPQPAAASGRRRSIFTEVGLIDEHTISTKRSPAPILVTEQALRQQRPSRTVRFRSRNSVFGEKDGIDEVDGESDWESVDEEEEVTRVNSTSPSHTITTSRLYRAGFFAIVLALMLPIIQMISVAPLSVYGSTIPRASITSVAERSTLVERADSSTDMCKRWSGQSAIVNGTLYMYGFRTTTDAQQKTDTWTNDFLTLDLTKSWQISNPSLTGMPQPSGPPAISLGYLYSSHDSLWLYGGQYSDSPAEKPGPNSIWEYNIDSKSWVEHADPKSSAGTNAEGDGQSIQRAAEGAGFGVTALGRGWYFGGHLDDFTTEGWSNQIARVYLKSLLEITFPGHTNDAVESLKDGKKADKEPVYRNITTGGIQDTGSFPERADGILTYVPGFGDEGLLIGFTGGDNDTFAQMNVIDVYDIAASTWYKQSTSGKTPPYRVNPCAVVAAAPDGSSYNIHMFGGQNLQPYGDQTQKDDMWILSVPSFTWVEVDQDSQSVPPARAGHSCHVWDGQMIVIGGYVGTELSCDSPGIYVFNMSSLSWSDQFTSLTGGKALQDYTGGDSIGNPLAQQANQRGFNASAGVEGSYGYRVPEAVQKVIGGDATGGATLTAPVQTPTGGPLVSGKPITYTMTGPNGASYTEIVASNGSGGSDSGPNVAAIVAGVVAGVFAVIAGYFAFCAWIYRKQVAIWKKHAAMVTAAAEKRDNTFNSSKISSERAPGTMAGSTAGGAAAGSFDIQRGSGENTSYGGAGRDWERRSSVGSVTEDLLDGNEPSFWGTRGVLLNPRRSLRVINRD

SEQ ID NO: 4365 - protein, 638 aa, Unknown
  Kingdom: Fungi, Phylum: Ascomycota
MLFRQFALAAATISLAKAADLTGYEYVVVGSGAGGGPLAARLAMAGHKTLLIEAGDDQGANQNYTVPSFNAKVSEDPNLAWNFFVKHYADEDRQAKDFKTSYETPDGGLYTGLSPPAGSVQKGTLYPRTGTLGGCTAHNALIAVYPHRSDFEYIQDLTGDDSWAPDNMRKYFVKLEKNAYLTTGKGHGYQGWLGTQYAPIDIVTSDPQLLSLVGGAAFALGNKTNAVVNLATLLAGDANADTVARDQNPGLFQIPISTKDGQRNGAREFVVAVRDAKFNNGTKMYPLDVKLNTHVTKVTFDGTTATGVEFREGQYLYKASPKNTGAQGTPGSVKASREVIVAGGTYNSPQLLKLSGVGPADELKKFNIPVVVDLPGVGTNLQDHYEISVQGTIKNDFSALNGCTFQGDSSDACIKRYNTPILGNRGLYASPGLGANMFYQSSVAENNNWDVFAFGGPVNFRGYFPNYSVNATAVHNLFTWAILKSHPRNNAGSVTLQSADPLDVPAITYNYFDTGVGDWEKDVTAMQEAIALTRDAFKRQLVPVTEVLPGADVKTPEQLSDYIRNSAWGHHASSTCPIGADDDEMAVLDSSFNVRGTKGLRVVDASIFPRIPGTFTAVSTYMIAEKAADVILAAAKAA

SEQ ID NO: 4366 - protein, 319 aa, Unknown
  Kingdom: Fungi, Phylum: Ascomycota
MASSLKLDFTTIDVFTDKPYEGNPLAVIRIPHGVSVTQEQKQRIAREFNLSESTFLHEKAPDATEDKWTVDIFMTSQELPFAGHPTVGTACYVLSRTAEERGIKDGVIEAKFQLKAGPVGLRYDVAKQTAKAAIPHDVHVHKKRWSRDELFKLQPGLAAAHEKGEAKAQEDYPVVSIVKGMTFVLVELESVEALGKVSLAGQSVEIDGLDQGWDKTFVGTYFYVRTGKSKSGATQVRTRMIEGPLEDPATGSAASDLVAYLSLNEGKAGETLSYELVQGVEMGRRSEIFIDVVMAKDGGIETVYLEGGAVQVMEGKLTV

SEQ ID NO: 4367 - protein, 884 aa, Unknown
  Kingdom: Fungi, Phylum: Ascomycota
MMLKAVIFGLSTCASALNARSYSADIPTNDGTSTKTATGTLSYLSPLNSKTSSLASEYSSVISSTITYASPPSSKNPTVAPYPTKANSTSTSSAPLSTGTSGSCAPYWLENIKHQGIASFNPNPSNYTVFRNVKDFGARGDGVTDDTAAIQRAVTQGNRCGPSACESSTNTPAIVYFPEGTYLISSSIIDYYYTQIIGNPNCLPTLLATSNFTGLGLIDGSPYLGTGTRPGRTGFGPTNTFFRQIRNLVLDMTNIPANVSATGVHWPTAQTTSLQNIIFKMNAANGTQHQGLFIEEGSGGFMTDLVFEGGNYGFNVGNQQFTTRNLTFTNVITAINQLWDWGWTYSGVKIDNCHVGFNISAGGPSAVNVGSITLFDSEISNTPIGIVTARTDNSEPAAAGSLYLENVKLNNVGVAIAGPNSTYLQGSTGSTTIAAWADGHRYLPEGPIEARGSIEPSKRPSELIDAAGNYYTRSKPQYGAVPLSSFLSARDVGAAGDGLTDDTAALNAALLQAKAEGKVLFVDAGFYKVTGTIYIPPGSKIVGEALASVILSSGEYFNDIDNPKPVVQVAKPGEQGSIEWSDFFVSTQGQQKGAILIEYNLGTYDATPAGLWDVHTRIGGFAGSDLQTEQCEKTPDTRITSANLVQDCIAAYMSIHVTKFAAGLYMENNWLWVADHDLDDARNNNTQITIYAGRGLNIESQRGTIWLWGTAVEHHVLYEYQFVDTRDVFMGQIQTETAYYQPNPDATIPFPPNPALSDPVFAPFVNGTGNSSASTASGWGLRIVRSNNILGYGVGLYSFFDNYSTACSAVGAGAVCQTRILSIEGDRLSYDIDIYNLNTVGATNMITRDGVDLASNVDNNSTFVDTINLFRIDGFGSPRESDSE

SEQ ID NO: 4368 - protein, 295 aa, Unknown
  Kingdom: Fungi, Phylum: Ascomycota
MLLKTVLGAAIMAVTALAQPSNGTNTTYVGPENGHLVIVGGNLQSDSIWQRIIDLAGGPDAPLVVIPTAGGEPTYTSNLSSAVSLRRLGATNVTVLHTYDPAVADTDEFVAPLLSAKGVFYGGGRQWRLVDAYAGTKTERAVQAVLDRGGVVSGSSAGASIQGSFLARGDTQDNQVMIGDHTVGFGYLKNTAIDQHFLVRNRQFDLFDILKVYPELLGIAVDEDTALVVNKNEAEVFGSTYAAFYDGGFWSREGSQLKNLPPPESRFYFLKAGDRYDLGLRKVIDAEMIAVRSEL

SEQ ID NO: 4369 - protein, 379 aa, Unknown
  Kingdom: Fungi, Phylum: Ascomycota
MIVTLVQVLALVATVQGAVAKPRNVVDDLQRQAITALKGVNTDGSQKCTLSNAAVRKDWASMSGKERKAYTTAVRCMLDSPSKSDPALVPGARNRYDDFVGQHINQTLTIHGTGNFLTWHRQFVHAYEKALREECNYAGYQPYWNWFTHQSNLKASPVFDGSATSMSGDGSYVSHNGSVGGGGAIFLPSGEGGGCIQSGPFKDMTVNLGPVSPTMRGQGRVNGSLSHNPRCLKRDLTTFASLNWLTEANLLNITTGSASSSIKLFQDELQGRFSDGFLGLHAAGHFSIGGDAGDIFSSPVDPVFFLHHAMLDRVYWIWQALHLAQANTVAGTLTLNNNPPSRETSLDDLIQTNYLNVEDTRIGDLTDTLGGAPLCYVYA

SEQ ID NO: 4370 - protein, 270 aa, Unknown
  Kingdom: Fungi, Phylum: Ascomycota
MRTSILSLIAAASAVTAQSSTIVPAPVVTGNPKGASYVATLPEQTKYTVRGSVAAVSAEDGNGVKFTVSISGLPAEGGPFMYHLHEKPVPSDGNCTGTGAHLDPYKRGEVPICDASKPETCQTGDLSGKHGNMTAQQWSQEYIDLYSATRPDSNAYFGNLSVVIHLSNKTRIACANFTQISAGGESGYPVSSINLSTGVSSGYAMPTGSGGYNSSIPVATPTGTASPTTAVPISPSSASSSAPAEFTAAATKFASGAAGAVVAAAAALLL

SEQ ID NO: 4371 - protein, 635 aa, Unknown
  Kingdom: Fungi, Phylum: Ascomycota
MFTSQSLLLTFAAFAASSPTYDLHLSLSRSNATTEQNVFFDVNGTEVETRIAKLKAEGYRPTSLNIHGSPDDAKYAGIWTKQDGNAYETILGANETAYNAWLEQWKAKGYVATHVSATGSASKARFAGVMEDISSISNWASVCGLDNAYAFDNATLGTPMTIKGISMYGNPNERQYCVLGHENTDNHQQLVFYQTDSFVRDYKTLEAQETSKRYWRPVYIDSTENQILTPIFDDTSVGQWAALTDLTTSQLGSEIALYKAKNMYPIHIAGAGSTGARYTVIFAERTTPLQREWHTTGTVTGFDDNAKVSNQLDEVMEAFMKRNSVRQAQVAASVNGTVIASRAYTWAESDRAVVQPSDKFLLGSVSKAFTYAATDHMLSAGLLNLSTPVYPLLGYNAPADPRSLNITVKHLLDHTAGFDRSISPSGDLGFIFTRVAQSLNQSTPATLRQLIEYVYEQPLDFTPGERSAYSNYGTMMLSYIITNLTGESYDSYIEKNVLNGMDVKLYATAADLHENDAIEQETKYTGINALKPLSEEKASSAHGGDGAIKEEAIAAFGLKASAATISQFLGNHAAYDIGGRQEWTYRDGTVPGARAIAYSLSELDFALTLNTREYLDENAWERLVLTDIVNAWGRY

SEQ ID NO: 4372 - protein, 933 aa, Unknown
  Kingdom: Fungi, Phylum: Ascomycota
MKKLVSFAALVAGVAGQSTFEPAEFNITEALLDNGVNVSALPDLAPLVDRASTSGCSAACMSLDLIFGRDKLESESESAYTSFVESYWSAQQREIAPRCVFKPSKALDVSTAILIARLTQCPFAAKSGGHSAVPGGSNVEGGITISFEKLGKISLAADKKTASFQPGHTWFDIYTALEKDDVAVIGGRVSDVGVGGLTLGGGISYLSSQYGLACDNVLSYEVVTASGIIINVSQTSYPDLYWALRGGGNNFGIVTQFNVQAVPQGRMWGGMRVYVGESTFPALIKAYVNLGKSAKKDGKAHQILSFAYNGMPVANVELEYAESNPNATVLSEYNAIGGAFRDETGVKSLAELTTALAGPATGAGLRQAFWTWSAKLDEDLATTTKDIFFEEVKAIADTANLTAALSFQVITEPILEKMTARGGNALGLSAADGPIMNLLIALRWIDTADDARLNQFAATVKDRAVAAAKAAGKHEDYLYMNYASPWQDPVAGYGAANKAKLQKISKKYDPTGVFEQLQPGYFKLGGAPKSGSPQIVKKLSARNHDLFPNFATSSQLQLRLSQFAASTSAAAMSSSPDYDEHSDSSSEGSDESAGTDYSYDLDGYDDDFNLKDDSPLPVANNKTNDSRTDFVDSTTDHATGAQEHRCNEAGASLVSLSPAFLSGFLALPLELKDRVLDYTLSFGNTEQAILVTEPPLIEIAEHRDRWRWDDCPGLNVSRPDQVFLNVSFEPAEREHWTCRWAGHVIFKEIIKAWYRRNTFILSDLGILADFAITDCWGMEVVPKHHLRKVEFSIHEDDLAHLEDPGGYARPSDRLRELRAELDLLCNLCEKTQITMHVSSQTFAGESVPVWNAEQHDRAEELMRKMDYGIFRQLRSLCAAKYMVTVVIDGGCIIKPDTEIKPGVWFFLLLDMCSKFTSGVDDVQKNQLQTGSSV

SEQ ID NO: 4373 - protein, 351 aa, Unknown
  Kingdom: Fungi, Phylum: Ascomycota
MVHFKSTVLAGMAAAPSAYAWGSLGHTTVAYIAQNLVSQDTKKFAQRILNDTSEAYLANVATWVIHSHFDQDDQALTSIQADSYRYTTEGAFSSPLHYIDALDSPPTSCNVNYERDCPEEGCIVSAIANYSTRAVTASVGLTEQQKALKWVVHFVGDIHQPLHVENLEVGGNLINVTFAGARTNLHAAWDTAIPQKFAGNFSLANAQRWAANLTSEIKRGVYKKESKTWTKGLKAKKPVDTAMLWANDANAFVCSTVIPNGADAVRNQEISGAYYETAIPVVTKQIAKAGFRLAAWLDAVVDNAGKGVIKGEDGKYGLSKREFKYEAWQIEAKEKRALFGDDCGCGEDHAH

SEQ ID NO: 4374 - protein, 531 aa, Unknown
  Kingdom: Fungi, Phylum: Ascomycota
MKARSLLPLAALVSHALAQDVFEPADFNVTEALLANGVDVSALPGLANLTEKRSLSNPCAVACNSLKLIFDKQVLTSGSAEYGAFTDSYWSSQTASINPYCVFKPAKSLDVSTSVLLSRLTQCPFAIKGGGHTGFPGASSIEDGITVSLEDMDEITLSGDKKTAVIGPGNRWGAVYTKLAEHNLTVIGGRASDVGLGLVLGGGVSHHSNIYGFACDNVASFELVTASGVILTVTPTHFPDLYWALRGGGNNFGVVTKFTLETVSQGLMWGGTRIHLQPDYPQLIDAFATMAESTESDPKAVQILSFAVTAGSPAAQIQLEYLQPVDETNPPAILKGYLDIPPVMKSTINRTLASDTDMLNAQMPAGHRYSFWAGTFKIDRDFMAWMQALHQKNVGSLPDQGSLTFQAFTVPTLKQMSKKGGNALGLDPADGPLFHVLLYMVWDDAAKDAALNKAASEFMEAAKAEAKNRGLCNRYIYMNYAGPYQNVVPSYGEENLARLKKIAEKYDPMAVFQELQPGGYKLEGAPYGEIV

SEQ ID NO: 4375 - protein, 336 aa, Unknown
  Kingdom: Fungi, Phylum: Ascomycota
MLHLLALVLSLAAAALAAPTLLTARAGRTSPPSGCLSVGGSGTYKTVSAAVAKLSTSSTTAQCIFIYKGTYKEQVYIPALKSALTIYGETTDTSGFASNTVTITQGKSQDDSANNDLTATLRAWTPNLKVYNINLVNTRGSGSQALALSAYADKQGYYGCQFKGFQDTILAQTGNQVYAKSYIEGATDFIFGQQATAWFDGVDIRVLAASLGYITANGRDSASNPSYYVINKSKVSAASGNTVKASAYYLGRPWRNYARVVFQNTALSNVINSAGWTQWQSSDPRTDKVTFGEYGNTGDGASGTRASFSKKLSAAVSISTVLGSSYKDWVDTTYLS

SEQ ID NO: 4376 - protein, 502 aa, Unknown
  Kingdom: Fungi, Phylum: Ascomycota
MALFDTYKRSLIGVLCLVPTIALGQTSKAESIHACLSNGGIQASISTDDTWSNDTASFQFRLPRNPVSVAFPQDKNEVALALRCARNASVKVSVLGRGHSFQGYSFGSAGNLVINMEAFTELSFDNTTNQLTYGGGSNVGPTAKFLWDTQKRHFPHVRGSHVGLVGSSFGGGYGTTSRFLGIPSDNLVSVEYMLYNGSIVTAGPGSDLLWAAQGAGANFGVVLSATTKTFELPQDGAVSYSLALGNVDADTASSALVRIQKWVLDGKAPDELSLRFSLVDFSSAGFFYGPEADFDSVFAPLVESLRSVVPVMNLTKTVIPSFWDSEVAAVGAGMNLPTGGSLGGRSSLVQSWTTTNKHPLNLKQAKALLNSYHALNRTDLTGTGFLDLWGGISRDIADGDHAFAHGDNLWLIRVDGVASSGAWPSDGVAYMQNLLKPFESALRKSAPLRSFVNYVNSELSVKEWSSRLYGANFARLQKTKAAVDPTELFSGYGLAIPVAGRS

SEQ ID NO: 4377 - protein, 336 aa, Unknown
  Kingdom: Fungi, Phylum: Ascomycota
MLFSNILAAAALVSTAFAAPSDKETRATRKLKFFGINESGAEFGEKNFPGVYNKDYTWYDTKTIDQFIGQGMNMFRLNFLMERLTPNTLTGAFDKAYLGNLTQQVNYITGKGAYAMIQPHNYGRFYGNIITDTASFKTWWKNVAAQYKDNALVVFDTNNEYHDMDQTLVFNLNQASIDGIRAAGATKQYITPEGNSWTGAWTWISSGNGASLVNLKDPQNKLIYQMHQYLDSDGSGTSEACVSATIFKERLQAATKWLKDNKKLGLIGEFAGGNNAQCISALQDGLTYMAQNSDVWTGALWWAAGPWWGDYIYNMEPSTGVAWVNILPKIKSYFIS

SEQ ID NO: 4378 - protein, 556 aa, Unknown
  Kingdom: Fungi, Phylum: Ascomycota
MVKLLGTAALFGAALAQYNTSSLPTVDLGYQIHQASNFNSTGGFYNFSNIRYAAPPVGNLRFAPPEAPAENRSSINTGTENRICPQAGPAWSALATPFLTSLILGTQYNGTAYVPPGANASSPVPAADPRESEDCLFLDVFVPQDVLAKAGKGYGAPVLVWIYGGGYTGGNKNNNPAGLIAASGNSTNGDVIYVALNYRLGAFGWQAGPSFQAEGGTANVGLYDQRFALEWVQKYIHLFGGDKNRVTVFGESAGGGSIMHQITAYGGLKGKSPFQQAIPQSPGWQQVQSNVQTEDTYRTFLNLTNTTSLAELRALPYDALRRANFQQVAYETAWGQFAYGPTVDGNFVPLQPGQLLAQGRFDKDVNVMVGHNANEGPLFTAPSIQSDAAFRKQLNTAYPYMPNSSVNYITDVLYPPVFDGSYPYTSQYSRAALAISEGIFTCNTYYLSKAYNNETYSYLFAVPPAFHGFDVAYTYFTGGATSLLPTGVTNRTVAIALQDFITSFAEEGAPEAAGIRKFDMYGENASVLDLNITGIHEIRDSNANKRCDWWQLALLS

SEQ ID NO: 4379 - protein, 231 aa, Unknown
  Kingdom: Fungi, Phylum: Ascomycota
MGFTDFVSDAGLTLLNNWVKTRSYIVGYTPSQADVKVFQQIKQIPAPEKFPYAWRWYNHILTFEGEFETLPGDPTKEATAYGPESSELTLNPAAAPEKEAEAEDDDDVDLFGSDDEVDEEAERIKAERLAEYNKKKAGKVKPAAKSIVTLDVKPWDDETNMDELKANVLSIEKDGLVWGASKLVAVGFGIKKLQINLVVEDDKVSLDELQQQIEEFEDHVQSTDVVAMQKL

SEQ ID NO: 4380 - protein, 183 aa, Unknown
  Kingdom: Fungi, Phylum: Ascomycota
MSSAPAQPMNVPEGAKAATVAAGCFWGVEHMYRREFGKKGLYDARVGYIGGDTQNPGYRAVCSGRTGHAEALQVVYDPTKIEYRSLLEFFYKMHDPTTENRQGPDVGTQYRSAIFYHDDEQEKIAKEITKKVNEQWWKGSVSTEVLPAGQWWDAEAYHQKYLDVNPGGYECPSHFLRSFPPLS

SEQ ID NO: 4381 - protein, 251 aa, Unknown
  Kingdom: Fungi, Phylum: Ascomycota
MQYKAMIAGLLASAVTAAPTPQDSVDIVGGTTAQAGDFPFIVSLQRSGSHFCGGSLLNANTVITAAHCTVGQTASSLTVRAGSLNRNSGGTLVRVSSIKVHPSFSSSTLTNDVAIWKLATSIPTSSTIGYASLAASGSDPASGSTSTVAGWGTTSSGGSSPTTLRKVDVPIVSRATCRNNYSVSEITDAMFCAGVASGGKDSCQGDSGGPIVDSSKTLIGLVSWGEGCAEAGKPGVYARIGALRSFIDANV

SEQ ID NO: 4382 - protein, 217 aa, Unknown
  Kingdom: Fungi, Phylum: Ascomycota
MAEASGNVPTFKLVLVGDGGTGKTTFVKRHLTGEFEKKYIATLGVEVHPLGFTTNLGQIQFDVWDTAGQEKFGGLRDGYYINGQCGIIMFDVTSRITYKNVPNWHRDLVRVCENIPIVLTGNKVDVKERKVKAKSITFHRKKNLQYYDISAKSNYNFEKPFLWLARKLVGNQTLEFVAAPALAPPEVQVDQAVLEQYQKEMQDAAQMPLPDEDDADL

SEQ ID NO: 4383 - protein, 243 aa, Unknown
  Kingdom: Fungi, Phylum: Ascomycota
MSRANQWFVLGDGIAREVITADIQRYLGPDALVRPGTGTGEYQGQPGYWITAYRTLTSQMIQDLKMDSQRWQQERQPGEGRGAYQDSRTHAARQHWGPTKPVEHPSSADPYGREPAPRASSGYATSTYAPSEGHYTTAPAGYGSSQSGYQAAPSSAAPRTQPADPYAGYSSRDQGYQSQAYGSYPSQSPVDPYGQRTAAPTAYATPSATPAPGYYIASDGRQYPLSQQPQPSSRSSQPGYKRH

SEQ ID NO: 4384 - protein, 320 aa, Unknown
  Kingdom: Fungi, Phylum: Ascomycota
MDNLGKISAFGKSFGASFTPFAARTQQYVKEQLGQAEDKTQLPPDYIELEKRVDALRKVHTTMLQVTSQYSNEAYDYPANLRESFNDLGRTVSEKVNLLSNATSPAEAQAALTAPPSAKPQPKTFSHAVARAALNSSHMLTAEQSGSSEDPLATALEKYAIASEKVGEARLAQDAQIQSRFLAGWSTTLNTNIQFATRARKQVENSRLSLDATKANAKGGAFTLPGQASKQNHGEEDLSEEARAKIEQAEDEFVGQTEEAVGVMKNVLDTPEPLRNLADLIAAQLEYHKKAYEILSELAPIVDQLQVEQEASYRKTRDEA

SEQ ID NO: 4385 - protein, 490 aa, Unknown
  Kingdom: Fungi, Phylum: Ascomycota
MHTQLSTWLAASATLWPAVTAFYPYQYNDGSATTSSSRRSASLEVSKKPRTSSGSITLPLRRVPTPLRSRQQNTYSIVNSKDPSQKNSVAVDQDGSDLSYMVAVTIGDSKEEYHLLLDSAASNTWVMGQDCKSDACGTHTTFGRGDSSSLKTESTPFSVTYGTGSVSGTLATDTMHIGSLSPTVTFGLATNVTDEFKSYPMDGILGIGRGDAVSGSAQIMTSLLDAKLIGSKLYGIHLSRASSSLADGELNLGEVNKARYAGDLNWLDCVPNDTGFWEVSVDDASVDSKNAGLTGKTAIMDTGTSYILMPPADALALHSQIAGFKQDGETFSVPCDTTSALAFVFGATSYNIMSADWLGGKLGSGLCQSKIVGRQTFNESQWLVGDVFLKNVYSVFDFEGSRVGLGVPPTEGEESSSSSSTNSPTATSTADITKSSGAASATQTAAVEGSANPSSSAVAESQGQSQKGGSALVTAPLSLALGAAIISLFI

SEQ ID NO: 4386 - protein, 596 aa, Unknown
  Kingdom: Fungi, Phylum: Ascomycota
MAPVLSFLIGSLLAARGLAEPFEKLFAVPEGWKATGLADDSQVLKLQIALQQGDAEAFEQHVMEVSTPSNKKYGQHFQSHEEMKRMLLPTEEASSSVAAWLKSAGVEEFEQDADWVTFRTTVGVANKMLETQFTWYVSEEAKPRKVLRALEYSVPDDVASYINLVQPTTRFAAIRADHETGKEISGLQIVEVAAAANTTVNCDVSITPQCLKQLYQIDYKPDAKSGSKAAFASYLEEYARYNDMALFEKNILPEAIGQNFTVIQYNGGLDAQNSSDDSGEANLDAQYMLGLAQPLPVTEFSTGGRGPWVADLDQPDEADSANEPYLAFLQNVLKMDQKDLPQVISTSYGENEQSVPKSYALSVCNLFAQLSSRGVSVIFSSGDSGVGSACLSNDGKNTTMFQPQYPASCPWVTSVGSTRYLNETATYFSSGGFSNYWKRPSYQDDAIKAYFHKLGEKNKPYFNRHGRGFPDVAAQGVGYRVYDKGVLKGYQGTSCSAPAFGGIVALLNDARLKSKKPSLGFLNPLLYSNPDALNDIVLGGSKGCDGHARFNGAPNGSPVIPYASWNATAGWDPVTGLGTPNFPKLLKAAVPSRYRA

SEQ ID NO: 4387 - protein, 1101 aa, Unknown
  Kingdom: Fungi, Phylum: Ascomycota
MGFQDSNMHDMEKQDGLSTGSRGSNGGAVPGETFVQGNSTYAKVQRLAARFHVEQRGIERVPEDERDDHSLLNVGTMWLSANMVVSSFAIGLLAQSLFFLGFVDACLVCLFFNLIGIIPVCYFSTFGPRFGLRQMVLSRYWFGWYGVKIIAVFNVLACLGWSAVNSIVGAQLINAVNNDVPGYAGILIIAFCTLCVTFFGYKIVHAYEFWSWIPTTIIFLIILGVFAHSGDFVNIPMGVGTSELGSVLSFGSVVYGFATGWTSYAADYTVYQPRNQSRTKVFFAVWIGLIIPLLFTEMLGIAVMTATTLNDGTNKYADGYKASGTGGLLGAVLFGPLGGFGKFCLVILALSIIANNCPNIYSVGLTIQVLGGRWTERVPRFVWTAVGTGIYIAIAIPGYSHFETVLDNFMNFIGYWLAIYEGIAFSDHFIYKRSMNAYDPAIYNQRSKLPPSIAAVFAFCCGIAGMVTGMSQVWWVGPIALKAGEAPYGGDVGFELGFAFAFVSYAVARKFELKYFGRLLSQASAINVEHVADTYDFIIVGGGTAGLAVASRISVGLPNSTVLVIEAGPDGRQEPGIYIPGRKGSTLGGKYDWNLTTTPQSNANNRTFAQNRGKVLGGSSALNLMTWDRTSIAELNAWEKVGNKGWNWNTLYPAMLKAETFLPSPEYGTEGVGKTGPIQTLISRIFPKHQSSWIPALNNLGLVTNRESLNGHPVGVSTQPNNVSPNYTRSYAPEYLKLAKANLEIKLETRVSRINFRGKTATGVTLEDGTTVHARKEVILSAGSFQTPGLLELSGIGNATLLKKLGIPVVKNLPGVGENFSDHIRIQSSYQLKPEYPSFDVLKNTTRAAIELAAYNAGQISLYDYTASGYAYFPWDIVSNETAAKFRALVQGDTSLTSPVDKVKKSYFSPPQSATVPQLEVIFSDGYTGLKGYPAVNSSLFGIGTFSLIGVVQHPLSKGSVHISSRNINDNPLINPNYLSHPYDLQAATNLAKFLRTIASTAPLRDVWTEEYEPGKAVQTDEDWKKYATANTLSIYHPIGTAALLPEKDGGVVDSQLKVYGTKRLRVVDASIIPLLPSAHIQTLVYGIAEVAAAKIILEHK

SEQ ID NO: 4388 - protein, 729 aa, Unknown
  Kingdom: Fungi, Phylum: Ascomycota
MPSSTADRQIILITGANGGIGFDTAALLASVSPYNHVLVASRNTTKGEAALKKIQDRNPRGTASLVQLDANDDESINAAVKHIEQEFGHLDVLVNNAGVATETYDGQWPSRDQLRAEFETNVFGPTVLTAAVLPLLRKSKAPKIINVSSGLGSISRCVGSTDQDPNGAIVRVPGYRMTKSALNMLTAYQYQQLKKEGFKVWSFCPGFVVTDLGKDREAREKMSTCESSETSAQGILEIIEGKRDEEVGMFLQRFQYQQINFNDERPLSVMCVQRLSYPAFPNALATASTSHTITIHLISICIIPEICYNVVCIPRGEARAVGLLDGAGVAVCWDPGTARKANEEWLLAHVGLASFMLIAQSALVASKTTNSDVRMNHIQVIGTHNSYHRQVSLAEQAVFEKYVPSPEDYYYSHATLPNQLEHQAVRSLELDLHSDEKGGLYYPPAIWTLSNLTNATTPFDGSVLQKPGIKVFHVTDFDPDSVCHTFVDCLTQLKKWSDANKNHVPIIIDLELKTDAPACAIGGVCPGEATNWTLSRLLNVDAEILSVFPKKQLIRPDDVRQGNLTLEQSVLQKGWPLLSEARGRFMFFFDNDPKPTDPNSPRELYKSGGHESLQNRTVFTNSLEGSTDGAVIKSNEPRGNMTAEIQRLVKKGYIVRTRSDVPLDTVLNKTTEMRDSAFASGAHIVSTDFPSWGMSARWGWDYVAQLKDGRVARCNPVNAPKSCKDSKLE

SEQ ID NO: 4389 - protein, 597 aa, Unknown
  Kingdom: Fungi, Phylum: Ascomycota
MASNGASTPQSQAQVQPCRYKTGKTLGAGSYSVVKECVHIDTGRYYAAKVINKRLMAGREHMVRNEIAVLKRVSMGHRNILTLVDYFETMNNLYLVTDLALGGELFDRICRKGNYYESDAADLIRATLSAVAYLHDHGIVHRDLKPENLLFRTPEDNADLLIADFGLSRIMDEEQFHVLTTTCGTPGYMAPEIFRKTGHGKPVDIWAIGVITYFLLCGYTPFDRDSNLEEMQAILVADYSFTPLEYWRGVSLTAREFIRRCLTVDPAARMTSHEALSHPWIADLGASKAEGEEDLLPTVKKNFNARRTLHAAIDTIRAINQLRAGGAAGMMDGIKASEPRRGAPPAPKFPQPAEEGSDPMEIDHVDSRGNGHGQTEAMIREQERRIRETQQGLWGGLRSTSTELNIDQRYTAPSCGSTMLPPLPPPRPSSRIHTNDRPSITSRSCTSKFMAASRLINQAPPSPSEATVQARSIIPHGTVRRILQYFEQTRAQSLQTALIDILERMNRTTVLAWSDAKAQFQTLEAFNKLWDRVGQTMAHLEDLCEQRRFGPQAATQFVGDFLLEVNYECFLNDIGYCVKYAGAAPLAVRVRRVDWHT

SEQ ID NO: 4390 - protein, 347 aa, Unknown
  Kingdom: Fungi, Phylum: Ascomycota
MIASSLLYGLLAAASLVDAASQKKQIKYEVVTGIFQQDDNATDPNTFNFLTSNFGLINRTYPSDPKSPDSKYATQWQRLGKYIKTLNKEKKTRYSLLFLGRHGEGFHNAAETYFGTPAWNCYWSELDGNGTVTWADAKLTQTGIKQAQDVNAFWSHLIADEKITPPESYYTSPLYRCLDTARLTFANLTLPKKSPFVPTVKELLREGISAHTCDRRSSKTYIHQNFPSYKFEKGFAETDPYWKELMAEPSADQDIRSKAVLDDIFSNDDSTYISITSHSGEISSLLRVLGHRVFKLATGAAIPVLVKQTTITGDAPATTTVPWNSQATCTAPPTIRDSSCNDCSCCL

SEQ ID NO: 4391 - protein, 449 aa, Unknown
  Kingdom: Fungi, Phylum: Ascomycota
MLARSGVLSLAFFLLAGHASAALDLDINSQDSIKSVAKTLASGIVSFYDATLKRDLIPGLFPDPYYWWESGLAFNALIDYSGLANDSEYNTRISEALQHQLGDLDAFMPANQTKTLGNDDQSTWGLASLSAYEVGLSAPASSSWLQFAKNVFDTQIARWDTASCDGGLKWQIFTFNKGYNYKNAISSGQLFLLAARLADHTGNATYTEWANKVYNWTTEIGLVSNDYHVYDGTSDMTNCSSINHIQWSNNHAMYTEGVALMYKLSNGSQAWEDTVKGFVNTSSTFTDDNGALYEVACERNGKCDVDQRAFKGIAARSFARAAQAAPIVADSIYKTLNASAKAAASSCVMNTELNVTCTFEWNQGTVDDSSDASNGLGERLNALQAIQALLWRTADFASGLPNSTAGPNATTSGSPSGASGAPQSTGAGSTLAASVTFVFAIAFAAALSC

SEQ ID NO: 4392 - protein, 367 aa, Unknown
  Kingdom: Fungi, Phylum: Ascomycota
MKSTIFSILPIVGFALAQEGCTRRTVTKTETERTYVTVQPSPVPSDITITSTIDITTTITVYPSSSVEASATGLHWGNGTWGNWTVRPRPSLSSVSLDYTDSAVTETPAPTTYVPGQGYGSPSETSEAAIPTSETPAAAETSSTPAASSPTAEAKAVEAQATSAAGSKRGEATFYGGNTSGGKCSFDSGYTLPAGLFGTALSDSNWANAGNCGACVSVTGPSGNSIKAMITDECPGCGTNHLDLYPDAFKKLADPSKGVIPISWDFVPCGISSPIVLKNKSGTSPYWFSMQVVNSNVAVKSLEVSTDGGKTWKPTTRQTYNYFENSAGFGTQTVDVRVTSTGGQSIVVKSVSVASTSTKTASSNFSS

SEQ ID NO: 4393 - protein, 672 aa, Unknown
  Kingdom: Fungi, Phylum: Ascomycota
MHFTFLSALSSLLAVTSAQSTSSPARPPSLPLAVKSPYLSTWFPAGSDGGNGGYLPGQWPQFYTGQVLGWTGLTAYEYTSTKSIFTIEVNDQVSLKVTFLSPITPNDLKRQSLVFSYMNVDVSSLDGSDHDVQIYTDVSAEWVSGDVTVTAKWDFGLINDVAYHKISRQDQQVFSEFNDRSEWGNFYYATDARNGLTYQSGADSDVRGGFVTNGQLASSNDTNFRAINDRWPVFGYGIDLGSVGSTPLSTLFSLGLCQNEAVQFLGADGLVTLPSLWKSYFADDINALTFFQQDFSESSKLSSELDDQISKDSIAAASQDYATLTTLATRQAFAATQLVGTDDKHYLFLKEISSNGNTQTVDVIYPASPIFFYTNPELVKLLLDPHFENQESGHYPNKWAIHDLGTHYPNATGHPAGDDETMPVEECGNNIIMVLAYVRRSGNTDYIKQHYTILKQWAEYLIEDSLYPAEQLSTDDFAGHLANQTNLALKGIIGIEAMSQLSSLIGEASDAHNYTAIAHDYITKWQTVGINSEASPPHAILNYGNASTWGLLYNLYNDKMLNTSLVPQEVYDMQSVFYPTVKENYGVPLDTRNRYYTKSDWELFCAAIASEETRDMFISDLAKFVNETPTSKPLTDLYQTNDATFPPGLTFKARPVVGGLFALLLLEQGKGT

SEQ ID NO: 4394 - protein, 734 aa, Unknown
  Kingdom: Fungi, Phylum: Ascomycota
MANFSKPQNMTTMLFALFAFLQFTAALGHGAHHQHHARHSGSSNDAILKRQIDEIADSLVARQSGGYTAITGVCSTRTGSDGTCDSNGRVSAPRLEIRQLAQNADQWNLYLLAMERFQAKDKNDRLSYYQVVGVHGRPFVTWNNFPTPLVNQAGFCPHSMTLFGSWHRPYLAIFEQALYQSMQEVINTFPQSQRGRWQEAASTFRMPYWDWAQDGGSATVPTQIRDQTVTVTKPNGRVTIPNPLYSYSWGSSLPSEIGGGPWNSWPSTLRRPVANPTRSNNNEMNARFNAMRTSLRDRVFALFSSKQSWGAASTSQIGVRTDLSGSGVDSFESVHDAIHNTAGGETGGHMYYLDISSFDPIFWLHHTNIDRLLAMYQLIVPNTYVANGNINHGMAQWSQGEPKNSYTPLKPFTKNKRGDYFTSEDVKETRVLGYHYPETSERSYSQVARAVSQLYGAGQRTLSRRHDNETSSETGQYQGRPLKEGDYHHVLNIIADKYAMEGSYTVHCFIGKPSTNSTSTSNSTAPFPISNSTAPFTNGTSGEADYDPSTDYTQDPNYVGAYGVLGGQMVMNSTYPVMTSGSLPLTTCLQGKEASGELKSLHPDDVEPYLAENLYYKVVGVKGELNPDDIPNFHVSAKCTKAVPAASEDELPDLSAPYQELPKATEGKPAGKPFVYKPTPIDIALPEGDDYNEPSSSAPGTSYPSMPWDEQGYCATKQTIEYVDQDGNFLYAEM

SEQ ID NO: 4395 - protein, 540 aa, Unknown
  Kingdom: Fungi, Phylum: Ascomycota
MGLLHGLISLLLGICIGAECRNPAPMRRKIVGGAPRVTLPQATVEGFLDLHNNTVFLGIPFAATTGGENRWRAPQPLPPARPGTVFNASQYGATCPQAISGTLYSQQGEDCLNLNVWAPAEGSNLPVFVYMYGGAMVTGSSSNPQFQGNNFARKGVVYVSFNTRESIFAYPNSAELQGGPESQNFGILDVNEALEWVRRNIAAFGGNPNHIVFGGHSSGSVQVDHYLWNHPDSWLVGAVEMAANAKSGPAVAPVNQALDIVAAEVGCPTGKGQLACLRKVNLYDFQTEMFNATYNTWFTPVVDNKTRYQDYESRFAAGKYASHVPLLTGNSNGEGNVFALVYGGENTDFSAWLDTFDADVAEIPKDLLLAAYNASDYETVSQMSGAQYGDARFFCPVDYLRDLRSTTQDTWTYRFFGDYANVWGLPVAAPTHGTEIPFFLGGNECFDAISNVTEAEQALADYQNDWFVSWIKNPSAGPGWDKVTPKSGTLAKLGVPGNELAIELANTDDYNGICQSVYNPYLPKYPVVQSVAGREGMISY

SEQ ID NO: 4396 - protein, 200 aa, Unknown
  Kingdom: Fungi, Phylum: Ascomycota
MLYSSILAACALPLAFAAPFCTRQNSTTNGTASCDLSKVSQPANALTPPSADLRLVLIAHGEGTQNYTCATPASAPSAIGAIAELYNASCAVANPTEAQNNIVQAAAIGNHFFADLTTPDFNIPNLGNTKSKKVEEVAAPNPSADIKWLRLQAQTEGSTSQVKFIYRLNTVGGLAPANCEGRAEGEVVTVQYQAQYWIYA

SEQ ID NO: 4397 - protein, 604 aa, Unknown
  Kingdom: Fungi, Phylum: Ascomycota
MAAFISASLCLVSLVSAYAPSTPAFDSLTILTHNDLYGNSSQRQESTIVIDKLQSYSAAVTSCAALGESLWSLEQCSQDIDFLGYLGYDSQGHGQNLYWVASTAGTKCNAVTPQGRSQQVPCDTPLPVLCSNTAPLSSPQSTDSSSKWQYSVSTSNATIVGYRDKYSFRFLGIKYATTPSRFSDSIYLTPTGSNISALSYGPQCIQGSCSSGKTPCSEDCLSLNIWTPTIPNGKGSKAKKKPVMLWIYGGGFVGGAASDTTFDGGAIASRGDVVLVTVNYRLGNFGFLALDGTSLTGNYGLKDQNIALDWLHANIEAFGGDKDKITIFGQSAGAASVRALLASPKTRGKFVAAIPQSTPQGLNYASTFAKYLTITEATNRTKSLLNETGCASNSGNALVACLRSVPVANLTSGTVASYPVIDGSFLTSSGLPLGSSAPKLNVTLLTGNMHDDGSPFISYPKTTNLTAALLAQSFPLSPTLDSSLFPLPENPNATLAIFNLTSRVATDGLFRCLDESTEVTATKNAIFINVYAYEFDRSYQLLSYSPNPPACEAPITAEYPYGDPNLPYYKCHSGELYYVFVHTGQLDGVCKDWVPGAGYEVLRS

SEQ ID NO: 4398 - protein, 229 aa, Unknown
  Kingdom: Fungi, Phylum: Ascomycota
MKLTTAAALSIIGLAAAGPVELTQRQSCPKVYIFGARETTVPQSNGYGTAGGLVNSVKAAYPGAGSEAIVYPACGGGSACGGISYDNSAAQGTAAVVKAVTAYNQKCPSTQIVLIGYSQGGQIMDNALCGGSGSTLTGNALKAVKAAIFMGDPHNRAGLPYNVGTCAAQGFAARPAGFQCSPASTSIIKSYCDAADPYCCNGNDANAHQQYVNKYGSQALAFIKTKVTA

SEQ ID NO: 4399 - protein, 491 aa, Unknown
  Kingdom: Fungi, Phylum: Ascomycota
MPRYESSSSVMAPFFANQSCDPFQPRERPCELGNYVRYAVNASGPADVQKAIAFAASKNIRLVIRNTGHDYLGRSTGAGSLGVWTHHLKEITHVPAYQDADYSGAAFRLGAGVQGFEIMAAARDKRLVVVGGECPTVGIAGGYTQGGGHSAISTSFGLAADNVLSWDVVTADGRLVVASKKQNPDLYWALNGGGGSTYGVVVSMTVKAHQETVFGGASLSFFTTDNAQDVFYDAIQAFHEELPAMVDAGTMVVHYFTSSFFMISPLNAYNKTAAEVKTILAPFVARLDANKVNYTASYSEFNTYYKHYDKYFGPLPLGNIQVGIAQYGTRLIPRSVVGNITETWKSIVEKGVTWIGVGTDVGAFGSEKTTSVHPAWRKAIVHATLTLPWNFTAPWSEALETQRKMTDVITPIVEAATPGSGSYVNEADFNQKNWQTTFWGDNYGKLLDIKKKWDPSSLFYATVGVGSEAWVVKSDGRMCRAKENQIHGPGI

SEQ ID NO: 4400 - protein, 616 aa, Unknown
  Kingdom: Fungi, Phylum: Ascomycota
MPVFSRLAVAVQLFNIIFTPVLGAAASKDYDYVIVGGGVTGLVVANRLTEDKRVSVLVIESGESVDSPGNMIPYKANDLTSANGLMWDGLTSLPEPGLGNSTYNVLVAKVLGGGSVVNGMVYDRGSAADYDAWEALGNNGWGWAGMEPYFKKGTTFQPPSPAVAEAFNITWDPEAYGSGPLAVSITDTQYPDIKDYWAAWKATGVHVPEDGNNGEAYGPSWYANTMDKKTGRRSHARYAYIDPITQRTNLKILTKTTAQRIVFGKSGKKPMATGVEIKDDATNKTYTVNAKQEVVLAAGAIQTPKLLQLSGVGPRSVLEAAGVEVKVELDAVGSNFQDHPYATVVFNTTPVHYPSPNLIMTNATFNASAWAQYETNKTGPYTYARGNALAFISLPDMTSNVSSVVSSLNSQQDATYLPSFYTGNKKLLKGFAAQKKIIAGLFQRKDAAVAEFPVPADGSYGLVGVEKPLSRGFVHINAKNPTGSPDIIHNAFVNPIDRSVMAIGLRFFRSVWARPELEEYKISETIPGAQYTTDEDIYSALLAQASLSPTLAHPSGSCPMMPENAGGCVSDKLLVYGTQHLSVVDASIIPIIPSCHLQATAYGIGEKAAAVIKSRA

SEQ ID NO: 4401 - protein, 575 aa, Unknown
  Kingdom: Fungi, Phylum: Ascomycota
MSFRYLFGAAALLSTALAHPSTSKHHSHPARLLSNRDVCSGNAASSRSEWCDYSIDTDYTTEVPDTGVTREYWLTLDDVTVAPDGVSRSAMAVNGTIPGPTLFADWGDTVTVHVTNNLVDSKNGTSIHWHGIRQNYTNDQDGVVSITQCPTAPEDTVTYTWRATQASERSFRYGSTWYHSHFALQAWQGIFGGIVINGPATADYDEDLGMLFLNDWDHQTVDELYIAAESSGPPTLDNGLINGTNTYDDGGYRYNTSFTSGTSYRIRLVNAAVDTHFKFMIDNHTMQVIASDLVPITPYETTVLDIGMGQRYDVIVTADQADVADNFWLRAIPQSACSENDNSDDIRGIIYYGDSPSTPSTSAYSYDDSCDDETDNLVPYISKTVEAESSTNVEAASVGFNSDSLFRWYLNSTTMVVDWQNPTLEQILAGNTTYETSNAVLELPDANVWTYLVIQTTLAVPHPIHLHGHDFSVLAQGSGTYSSSISLNLSNPPRRDTAMLPASGYLVLGFETDNPGAWLMHCHIGWHTSEGFALQFIERYDEIVALTDETRLTNGCDSWTSFTEEASIEQDDSGV

SEQ ID NO: 4402 - protein, 473 aa, Unknown
  Kingdom: Fungi, Phylum: Ascomycota
MRFDIATLLAAAASVSAQNVVGKPYGFAADVTGGGSAAAVTPTTADELAEYLSDDVARVVLITKEFDFTGKTATGSGCDRKSCSAKNGGQFYLGELSCAASDDNVPVSSITYDTAGPTALKVGSNKSILGVGGKGILKGKGLSLAKNAKNVIIQGLEFTNINPGVVWGGDALDFQGGNDGVWVDHNKFSLVGRMFLVSHYAGSRLTVSNNEFDGSTTTSASCNDNHYWTMMFYGDGDKVTLDRNYLHNVAGRAPKLGQDGTTGTFHAVNNYFENMKGHAFDAYTGAQALVEGNVFAGVAQPVTDKGASVSTFVVNAGSGCSSALGRSCLENSVDSASGKLTGGSSTSFIKDITNDVTPLDVSKVAAHVKANAGPANLGSASSGAEEKDADAPTSTRAATTSKAVATTKAATTAASAKTTLATVQKPAATQGAASGGAAVAAWGQCGGQGFTGSTTCASGLTCKKQNDWYSQCL

SEQ ID NO: 4403 - protein, 593 aa, Unknown
  Kingdom: Fungi, Phylum: Ascomycota
MWWSLAYLLLSASTGVAVESAAASNDTHLHSHDSTFTPDFYLSVTYENHAVACQYRMSVLVNGTSPGPTLRLPPGKTSWVRVCNDMDIYNTTMHWHGLSQRTAPFSDGSPVSQWPIAPHQCFDYEIHPEPEDAGTYFYHSHIGFQAVSAAGPLIIEDIAEPPYEYDEERMIFLQDYYNKTDDVIEQGLVATPFVWSGEVNAVLLNGVGVAIGQTAGSNGCPLPVIDVEPDKTYRLRFVGSLAISMVSFGIEGHDAMDVIGADGRYTKPHRVSHMQVTSGQRFEVLLKTKSAGDLAESGKSDWVIQFETKDRPAPYAGFGILRYSNASPSIKSAPAVAPLRLTNDTYDFLEYALEPLTPNGFPSAAEVTRRVHITNQQLTKSTIIWQLDGLNWTEDGAEPQNTPPYLVDIYKNGPAAMPNYTAALENEGWDPHTLTWPAKIGEVLEIILENTGSLVNDNGGVEYHPFHLHGGHFYDCGSGNGSYDATANEARLKDYNPVLRDTTNLYRYEAKGSPGQPASWRCWRLRVQDAGCWMLHCHILQHMIMGMQSVWVMGDYEQIARIPYSGASGYLDYGGTAYGGEDISPIVWHEWDD

SEQ ID NO: 4404 - protein, 764 aa, Unknown
  Kingdom: Fungi, Phylum: Ascomycota
MIVRTFAVLTGAAIALQPLPPVQWTNTNSLSNGFNGIAARNSSKTIYIQDSFADTSDTEGLTLIPPTAFQFAETFRQDLSNWTTANWTLQRVIQFPDNASGILLGPFRGSDDEVTYENGATTEEGYEIEITNRTVYIGGKGARGMFWGTRTLLQQALIANGSSIPAGRTIDAPAYATRGYMLDAGRKWYTPEFLKELCTYASFFKISEFHYHSSDNAPLNRGHNETWNKVFSHFSLYPEENTELQGIIERKNETLSRAQFEDFQNHCAQRGVTVIPEIEAPGHALAITKWKPELALAKKDLLNLTHPDAIPTVKAIWSEFLPWFKTKEVHIGADEYDSALADDYINFVNEMSEFVNSTAGKRIRIWGTHEPSDNLTISKDIIVQHWQYGQSDPIQLQNEDYSLINSNDWWAYMSLKNDHTPILPAPYPQFYNTSRTLNFADVPGWQWEPSLFNQVNTTEQLEPGASGNKGAILAAWNDNGPDATTQLEAYYAMREGIPVMAARAWSGKRGVNITTDNTNATIRFLAANAPGQNLDRRPASLRQTVATNRPVLTWNSRDGQMAQTFGKGSYGPPYTLSLNVSSSFNIKGPDTSLAISRVVSNATTNSTVQTLVFTTADGFPYPLRNVSYNDYDPGHPGRIWTNDSSSTHEPVPITLPVRLRIETDIYNGSRVWVNEKFAGRFEVFVFGGRNTVFSWSQMALVAPLDSVDGGVDSFKLENGIGMYNVTAGNGSYGRSPPEQNAASGKALSSVLQVLVGFVMIWMFV

SEQ ID NO: 4405 - protein, 289 aa, Unknown
  Kingdom: Fungi, Phylum: Ascomycota
MADLNLQEIHDFMISVAKSAADRITSAKPTTSSSGSKKNSVDLVTETDQAVEKLISTSLREKYPSFSFMGEETYKPGDKLTSAPTFVCDPIDGTTNFVHRYPYVSISLGLAVDLKPVIGVVYNPFTQTLYSAIKGQGAYLNQTTRLPLTPPTPLETLNTCLVAVEWGSDRSGNDFTVKSETFKNLAATKENGGGMVHGLRSFGSAALNLCGVASGGLDIYWEAGCWAWDVCAGWIILEEAGGLMVDANPGNWEPRVDERRYMAVRGGQGQKEIVEEFWGLVHGKFDVGV

SEQ ID NO: 4406 - protein, 417 aa, Unknown
  Kingdom: Fungi, Phylum: Ascomycota
MDYFRSKRSNAHQPIEDERPSKRISTPAGQRLSMVLESSHIRSKPTKPEPKSKIEVTTTSTYCNDPTHQHIGPTVHVHEHRKPGFLSVITGGRLGDTPRESMEDESHNGSNLSVSVWSDPHTPRSEKFTQFKAASKGNGRRRGWKRWALIGALIIALIIALAVGLAVGLKKKDSSSSSSTSTTGSDSQPAGSGTSTSTETDTPSKPTSTLTPPAVPSGFPLGAYSLVTFLDTVATGCTSNNATWTCAPYTDYYSDPQKAIAVINWEITGSSGSYKISSKDSSDLYMTFQNAPLDLLDKGKDTERYRFQISRTKTVNMTGTIGDSKGTFECDYGATNLQAYLYTKMQRTYPDDTIVVPNTPNTVWPYAVRVEQAVGGGENVPSCTKSTGEQIDSGLKAQDAGNLCSCLYKNWTPERVS

SEQ ID NO: 4407 - protein, 358 aa, Unknown
  Kingdom: Fungi, Phylum: Ascomycota
MISSTLLQLLAVATAFTPVQAGHPGQAWEECKIKTLVTFGDSYTDENRLGYIIQNNGSLPPVGWDQPVGLATASGGRSWARYASVYSSAKLYNYAVSGAVCSNNITPRQLSPTITFPDIEGYELPAFIADSKYIVPSTGQPFFTGKQDSTAYAIWIGTNDLGNNAFITNSQRPNKTVADYMDCVYNTVDGLYKNGGRYFVLLNLAPLDLLPQYQLPSQGGLNATQFWPADGRNMTDVHYRMQNTVAALNEVYEHRTPFAALVSKKYPGAHFANYNVNGLMTAIHSNPSQYLNGTAPLNVTGTAKQCPDTTGTNCTINASPDSFEWFDPLHPSEQTSRIVAREFVNVISGNGKWATYWS

SEQ ID NO: 4408 - protein, 433 aa, Unknown
  Kingdom: Fungi, Phylum: Ascomycota
MRFSNLNFAALLALPFLTGAAPVEDATSTKGYQMGVFYVNWAIYARKHFVTDLPADKLTKVTYAFANVNSTTGEVFLSDEWADLQYAYPGDVASNGTQLLGNFNQLYKLKQHNRNLKTSLSIGGWSFRDNFKTALSTSAGRAQFAESTLKLIKDLGLDGIDIDWEYPQNATDAANLVETVKMCRQVYDEYSAKYADEYHFAVDVSAPAGPTNYNKLDVAAMDPYVSTWNLMAFDYMGPGFSNYTGHLSNVYPPKSNPRSADFNTVQAVEYYASKIASPRKIILGMPLYGRSFANADSKDHGLGQKFNGSGDGTWEAGVLDYKALPLNGSTVYTDKKVVASWSYDNKTRQFVSFDTPEIQTLKAKYLKKQKLGGAWWWDSSSDRTDDKSLVGTVSKALGGVGGLELNQNNLHYPLSKYDNVRGASSNATYARLR

SEQ ID NO: 4409 - protein, 608 aa, Unknown
  Kingdom: Fungi, Phylum: Ascomycota
MRSFTLLLAAASLFDLSIAGYALEDDYMTDFYGAFDFFDTADPTNGFVKYVDEATARQTKLINTSVTTGASWGVDSTNETPDGRPSMRLVSKKKYNSGLVVMDVAHMPTGCGTWPAFWMVGPDWPTGGEIDILEGVNDQTHNGMTLHTAPGCRIGPDTSIFAGEVTTIDCDVNAKNQSKNVGCSIEHPSTDSYGVGLNKIGGGVYATQWTDEAISVYYFPRGSVPDDVLGDAPNPDGWGIPAAKFTGACNIESMFKEQQIVFNTAFCGDWAGNAWDTTGSCGQKAPTCDEYVQNNPEAFKDAYWTINALKVYQDNGNDTPAPSASGYPVQSTIISEPVPVPTENATESAVSSGYATIPPVVPTSAPILSFTSGSYVSASLSMSAELPAGTSAPNAEPTPPVVVPTSETLEPSKTQEGYPVASTSVAATSKAATPTKPAEDVGPDGMPGFQWPQAGSAPSSNATQPVDDAPAEQPAAPSSSGSQSLPVGTLPSATGPAAAPPSPPAGAPSAPLASGPAPSGPAPSAPAPPAGAPSAPVPPAAPTDAAAAPPAAPTITETSVAQKTVYQTIYKTVTAGAEATPAPGLNGARARRFMREHRKRSVGHHARM

SEQ ID NO: 4410 - protein, 699 aa, Unknown
  Kingdom: Fungi, Phylum: Ascomycota
MKLADTRAIGAPRLDSVSAAQCKQRSPKRNGSFQLRGSTSPGRFLNELARTALLLALATKQSGVMPVNRHARRYSAPAGAFKTTTAPNRPRSSWSPPLRKPGRASFATHTVIGAIVVLLALFFQVFAPHFPHTVLRFFTKDQHWTVSSPGITLRNPVLFTEPQICPKPEQIVEFKGTFRSHPKRSMALADQAKRVAAEFEFSDDGLNKAVKEFIREMDEGLTQEGTELSQIPTYVTAGLYMAVDLGGTNFRVCSIQLHGNTTFSLTQSKVAVPQELMTAKTSKELFSFLAKQIEKFLQAHHEDHYAGTLKRRQTGEQPQEIFNLGFTFSFPVNQVGINKGLLMRWTKGFDIQDAVGKDVCALLQAEIDELHLPVKVAALVNDTVGTLMARSYASPGKTGTLLGAIFGTGTNGAYVEKLDKVTKLTKSKDVGEFDKSTGEMIVNTEWGSFDNSLRTLPNTPYDVELDENSVNPGIQMFEKRVSGMFLGELLRLALVKLIKDPKVPLFQDDNSSSNDIHSTTSIDPNSPIFKQWGIDTSFLSICAGDNSAGHRVIRQTLDKDFGISAASTEDAEAVKAIAGAIGRRAARLSAVAIGAIIINTGRLEKSKGTATTEDKAGIDPPRGEVKVNEEDVVDVGVDGSLVEFYPDFEEHIREALRAVPQIGDRGEKHIRIGIAKDGSGVGAALIALVAGQVPEPQLD

SEQ ID NO: 4411 - protein, 250 aa, Unknown
  Kingdom: Fungi, Phylum: Ascomycota
MYLPAALLSLISLTSATNLPSPQRLFTNPAQHEVDFTIPSVHESAVQARRILRLESIGTLSTVFPLSSHHTTENRPSVDGAPIGLMDYFGDCEPDTGNPTILAISIATSFKNVDAGSNITLSMRWHPQDNAWRSPASLPRFSLVGHLEEINAEDVSKAALTTCFVKYHPDAAWWLPGNKIHESKWVRLVVDEVYWIGGFGDRAYIGWIPTKEWYSVTPEEIEGIRLPGEKKSGWASWKSWAGFGEEAIEL

SEQ ID NO: 4412 - protein, 757 aa, Unknown
  Kingdom: Fungi, Phylum: Ascomycota
MRYSLIFAGVAAAYDAYGYEAYPVSSSTPSYDTVKSSSTPAVKYSTSAPAYGAYGKEHKTSSAPGPSKSSSSSQLGYTTIYPGYGKEPVTVTSQYQPYPTCGSAGSDGKSCSKWNEDKYVSTVINDYNSKKVTVTCIDEPITVYQTKTTITHYPTASSGKAYPTGSYGSYDAKKNATQPWYEMNEKIHEIKYKDLGEHGLPGYGGSGLCKSCDEEQPYKVKEYKDGKWSEYETTAIYKAPTPETKTYDAPGVYTEPAKDVTVTYTMTKPSEATTTAKAGVPVTYGGYTTDFKSTGVQTCAYGAYETGKDKSGKDVTSTVVKTVTVTVSTTGKYEVAKPTTTVYAHDTEVKYPTVSVYQPGVYHKDAQTVTITKSGDSASCEYKQTKTYPAPEASKTPSYGGEYPHGGKSSSKPSVETKTESKPSYPASTPAYSSSVPVYESKTSSIHYPVYSASSSMPGYESKSSSVHYSTYPASSSTPSYDTMKSSSTPCASSTPVYSSSVPVYESKTSSVHYPEYPASSSVPVYESKTSSVPVYESKTSSTPVYSASTPVYSQKSSSTPCSTSSKPSVETKTSTKEYPHSTPVYSTSTPAHETKTYPASSSTPVYSQQSSSTPCTSSVHSTSTPVYGEYKPSSSVPSVETKTKSEEYPQSTPVYGGEYPPAKTSSVPVYSATSTVPNYESKSTPCPSSTSPAGYKSTPSAEYPAASSSAPAYDAKPTPTPSAGYPEEKGYGYAKRAGVVQRRQAAVAKRSNREIV

SEQ ID NO: 4413 - protein, 426 aa, Unknown
  Kingdom: Fungi, Phylum: Ascomycota
MFIRRAVTALSLCAAALTAPAEKRRVDFNWGSEKIRGVNIGGWLVLEPWITPSLFDKANQGRPQKDIIDEYTLGEKLGHDAALAVLREHWNTFVTWQDFKRISDAGFNIVRIPIGYWAYDTLGSPYVEGAKVYIDASIDWARSLGLKIVIDLHGAPGSQNGYDNSGQRLNVPQWQSGDTVKQTLQVLKTISDQYAQPKYQDVIVGIQLLNEPAMYFDNISEEVTRQFYRDGYGQVRDTSDTTVILHDGFIRPNEWNGYLTPSDNNAQNVAIDHHEYQIFNNDLIQLKPSQHNHKVCDLADAYGGADKWTFVGEWTGAMTDCAKYLNGLGRGARYDGSYLGAPYQGDCSFANDVSKWSQTQKDDTRKYIETQISAFEAKTQGWFFWNFKTENAFEWDALALVDAGVFPAIKNGQVEYKYPKVCTNFY

SEQ ID NO: 4414 - protein, 652 aa, Unknown
  Kingdom: Fungi, Phylum: Ascomycota
MSITPATALAEEAVIAFATSVTPLFVVYSRLSVDLGIDLGIDLEVKARASDTYDYVIVGGGVTGLIVANRLTEDEKKSVLVIEAGGAYDNPNIRLPYGATYALNTSLLWNGYVCQPEPELGGRTWNTRVAQVLGGGSVVNGMMYDRGSAADYDAWEALGNEGWGWDGLYPFFKKGTEFIPPPQQLVDDFNITWDPSAYGSGPLKLGISDFQYPDLKSYWKAFEGQQARHLVDGNNGDNAGLSWYPNTMNPKTGERQHARLAYYDTVASRSNLYTLLETVADELVFDLNSSKRLVARGVKVTDKNTGTSKTVYAKREVILAAGAINTPKLLQLSGIGPKSVLEAAGISVKLEHDGVGSNFQDHPYISMAYDIRADLMSKPNPTSMSTDPAFNASAWAQYNKNKTGPLTQARGNALAFIPYPEVARGVSGSLSSASISSAVTAQANDAYLPSIYSASKKLLAGVAAQRKILASLYSNSKAGIVEYGIPAAGNGLLVALQKPLSRGTITLDPTNPKGPPQIRYNAMTNPLDKSLIAACVRYIRQVWQRPEISRFAPAPGPVETSPGAQFQTDDEIIGAVVERGTLWPTLSHPSGSCPMMPEELGGCVSSELLFYGVEKLSVIDASIIPLVPSQHIQSTMYAIGEKAADIIINKRH

SEQ ID NO: 4415 - protein, 404 aa, Unknown
  Kingdom: Fungi, Phylum: Ascomycota
MHLSFTTAVLAVAGSAFALPQNPAPAQGTSLPANVDLPPALPLDDFKTPKFARPLSLEEALQGVNATVTTIKENLQDAKNKLPELLLPDTPSSKIITDLLPNVVPSILPRNPAELDEELEKFEKRQSTCSNPRIRREWDSYSNSDRQAYVDAIKCLQSRPASGQFRQSQSRYEDLVALHQTLTPNVHGNAKFLLWHRYYLWTFEQMLRSDCGFNRDLPWFDETRYAGRFGASSIFSSQWFGSVNIGGQCVTNGQFAGLAINVGPGSGNTRHCLARNGDDSRTANTGSAIVDACNSRSAYPDMASCAEGGAHAWGHNGIGSVMQDTYASPADPVFFLHHAFIDRNFRIWQNNGGNARVTQISGTDSQGNQLRLDTTVNVYDFRPTVRIRDILNTQSSTLCYKYNY

SEQ ID NO: 4416 - protein, 449 aa, Unknown
  Kingdom: Fungi, Phylum: Ascomycota
MKYAFAQVAFGLGANALVAREASQCVQLKASGGQSGVLGQLGDGQNRVGGGHPTGCYCLSNHGFTDSNGRGCILTPPTTQFQCDVGASSTTGFAIGSSGSVTYNGSSKFYACPATDTEYNVYTTPVAGQDKCVEITMSSAGSCGAGSGQPSAPVASMPAKSSAAPVPSQPAQSYPAHSPPVQSVPAPRPSASSAPAPKPSAPASQPAMSQPVPKPSQPAQSYPAQSMPVPKPSAPAMSQPAMSQPAPKSSQPAQSYPAQSMPAPKPSAPAPAPSTPAPMPSAPAQSGNQCPTDLNGDYQFPHLIIPVDSQQPTKAYGTQYNGKINSHTCSIFNFDIPSSYSGKTCSVVFLFPEQKDLETSSFTVSGSGKVDFTQLQSPANQQTTYANQPGKKADLTSMSIAPGNSYAITSAACAAGQTVSYEICSEGDFSLDYFQDYNPSPIGLYVRSC

SEQ ID NO: 4417 - protein, 511 aa, Unknown
  Kingdom: Fungi, Phylum: Ascomycota
MFTRFITSSVVAAWSLTSVLSGVSCGPTSPHDVFPRTSAAGIDLKPLASQLSKTAQIYYEGSELFTNYTVRWSNLSPPTPNVVIAPGTEKDIAKIVKFATKQNIPVLAYNGHHGTLTSLGRMDYGIQIYMPTLNTISVSKSKSSVTIGGGTNSKKLIDALWAAGKQTVTGTCECVSYLGPALGGGHGWLQGHHGLIADQFLSMNVVTADGRLQTIDSKSDLFWAIQGAGHNFGIVTSVTSKVYDIENTDWAIETIVLSGDKLEDIYKTANEVFINNGTRSTKIHNWSYWQNDVTLDAEKPVIIMYIIQEGVKIVDSQYTAPFHALSPLKATPQSGTYHDLAAWTGIALDSPPCQDFGFNNPRFPIYTRAYNATAQKQAYDVYATAVGGADSPYTNSIFMFEDYASEGIRARPADASAFAFRDAHILAAPLIIYGSTGAAEDESVKQLGNQLRDIIREGTGSKELHTYVNYAYGDEGSKSWYGYEDWRQKKLKALKEKYDPQGRFSFYAPIA

SEQ ID NO: 4418 - protein, 560 aa, Unknown
  Kingdom: Fungi, Phylum: Ascomycota
MRVAERAWKWSALSCLLAGVASAVEPTVKVLNGTYEGRYLPGFDQDLFLGVPYAQDTGGQNRFLIPQSLNTTWNGTRLAKQYGNACPDPEPDRDGEFGMSEDCLSINIVRPAGLSANESSKLPVAVWIHGGSYQVGTSALPNYNLTYIVQRSVEIGNPIIATSINYRKGGWGMMYSREIQGTGNTNLALRDMRKGLAWISENIGAFGGDKDTVTIWGESAGSFAVGQLLMSYSGRTDGLFHRSIQESGSAATAWYNGSDWYQPIYDNIVSKTNCSDEPDTLACLRTVPYQTLLPLLAEPIQGPGWYPTIDGDIIPNFPTELLHSGRFAHIPHLYGSNSDEGTDNAPAGGVISTTQQLYDYVKGSTGFDFPDAVVSKLLELYPDDPAQGIPLNTGSERFAEQGYQYKRIAAIMGDVFYHATRLDDARQYAKYAPTYIYRFNTRPWQAGTNGTAGGLAPAHKGVQHFSETQFVFANPAFYGPWPEYKALSDVMSAQWVNFVASGDPNGKDLPVWPRYSEGEKGLNLVVQATGRGQNGSYVEEDTYRLAGREFLSKWARRRHV

SEQ ID NO: 4419 - protein, 551 aa, Unknown
  Kingdom: Fungi, Phylum: Ascomycota
MFPRSLILLASAGAVMAQVAPECEHLTDVAALLNTDDGKTYCSAVRDIGTTTETVVESATATETTTITTPSQVTLSITTTQTDTVTEGFVTETAATATATETVTESSTVYSCTTALKRREYGEAQSTSCTKGKTTSTPTPSSTSCTKSKTSSTPTPIVTSTSCTEGKGQQHATSAAYGASQPAYSQGAASSVQGGYYGSDASKAAYPSKAAEGSYSAPLYTDSGVKVYPTAGAGYYHNSSSAAYPTAGASSAHYDSYEEYPTTSSIYEQISSLISSYAGYPTISSSVYYSSEIASSSVSEIVSSSIYTPSPTPTPTPVPSCEAAPSAVQTGYGCDEIYSACGCLGLASATAQVTTTTTLTEAVSVTEAMLFTTTTQLTETVFTTVPATTTVTPSVTVTTTATATATVCPCTSSQTLCGSTPDTCKDLQNDANNCGTCGNVCNSGQCSAGKCLDCVPRTCQTFSLGRCNNAGLCYCVTGSTGKPLCGDLSVGNCGSYKKCDADSNCGSGQICTKDTCCGYGICISVNSCGNPQNAKRMFQPRGKSANELIGF

SEQ ID NO: 4420 - protein, 513 aa, Unknown
  Kingdom: Fungi, Phylum: Ascomycota
MLFTVSLSLLALPVVQVIAKPTPSSTPAPVNVTTCNGKTYTYSALAGYGKLASDARDKFGDTIGGIGSAIALDKKSWKSKKGKSEAYTGIVYGLPDRGWNTEGTQNTQSRIHKFSFDFEIVDATVEKPASPNFKLTYLDTLLLTGPDGTPLTGLDPTGTITYPGFPDLPLAKYTGDGFGNNGTGGARVPLDTEGLVLGDDGSYWISDEYAAYVYQFDGKGKMIQAIRTPDAFIPLRNGTESFSAASPPIYDQNFEINPEDPSTGRANNQGLEALTSSPDGKYLYTMLQSATIQDGGSKSSTRRNTRLLKYRVKSKSVELEAEYAVQLPVLSTGKVAGQSEIHHLSETQLLVLARDSGAGHGQDSSTSIYRNADVIDISNATNIKGKYDAFNAQIASNKGALKSDVVPATYCPWLSYNVNSQLNRFGVRNGGAQDANLLNEKWESFAIAPVDSDFQTKGEGKEYYLISFSDNDFITQNGYINFGKQPYKDSSGYNLDSQVLVFKVRLPKGANPL

SEQ ID NO: 4421 - protein, 478 aa, Unknown
  Kingdom: Fungi, Phylum: Ascomycota
MKYALGAALILQSTVALGELLPVHLKAPTTAHFRDIVRNDTYDFGCRPVAHPTDDGHFTLHALLTEDQIAHLTKEYESVDEVTIHRQMVKRAATAPIGSGDRFTSGTVSPVGLGQQASGTTISSIMNVNEVNSAFNALVANYGVGKVTLPNKTFNGATSYAGFVGAGTDKSAYRLYLSAGVHARERGGPDQLLYWISDLLAANKAGTGLTYGKKTYTNAQVKSVLAAGIVFFPLVNPDGVAYDQSSGSLWRKNRNTRSGSSGSSVGVDINRNFDFLWNFRKYFDSGEAPASTSPSSETFYGTAAASEAETKNHVSIYDSFPKIRWFMDIHSAAGDILYSWGDDDDQTTTSTMNFLNSAYDGKRGVTGDSVYKEYIPAADYTNIKNVAAKTVAAMKAVGGRSYTAGQSVGLYPTSGASDDYAFSRYWAKPGANKVYGYTMEFGYSTNFYPTLSEFNQNILDTNAGFMDWALAAIAVGLD

SEQ ID NO: 4422 - protein, 902 aa, Unknown
  Kingdom: Fungi, Phylum: Ascomycota
MLVKSLIALAACTRFALAAPYPHDATSLVLPRQANSTTCPGYTATNVDVTDSGLTADLTLAGTACNAYSEDLQELKLVVEHQTDDRLHVKIYDAGLNMFQVQEEALPRPANNKTASSGAAVRLDITAQPFGFKVVRNSNNETIFDSTGTPLIFEKQYVRLRTSLPKDPNLYGLGEHSDSFRFHTKAYRRSMLNSESINIPNNANLYGSHPVYFDHRADKGTHGVFMLNSSPMNIVIDEDDTGNQYLEYNAIGGIIDLYFLAGPGPADVSKQYADVVGYSAMYPYWTLGFHQCKYGYWDVNMVAEVVANYSTAGIPLEVMWTDIDYMDARQDFTLDPERFPLTKMQELVSTLHSRDQRYVLILDPGVHAIEENAPYKSGHDLDIFLKAADGTDLLGVQWPGAVAWPDWFHPDTQKWWTDEVLSFFDAGSGVDIDGIWVDMNEASNFCQDTQTCNPRQKAIDDGIPPKPGNAPRPNTGRPIPGFPASFQPNSSTKRDVEARQTMGQMKGFADREWFNPAYTVFNHVGGLSDLTIPFNTSNYDGTRQYDTHNLHGLMMAMTTQKSMVTRRPELRPFVLTRSTWAGTGRKATHWFGDNASDWEHYRTSIRQMLSFVSMHQMPLVGSDVCGFNGNTNENLCARWAMIGAFQPFYRNHAELSTIQQEFYQWASVAEAAKKAIDARYKLLDYIYTALYYQTTTGKPMINPLFFLYPEDANTFGIQEQWFYGDSLLISPVTTDYSDTVTYYLPNDVFYSYWTLEKVQGQGQNVTESNLTTSDIPVHIRGGAILPMRGNSANTTKALRQQDFEILVAPGKDGSAKGRLYLDEGEKIVQDGVSEIEFSFEGGKFSVSGKFDYAGAEGESITVAKVVVVGQDKAGATGTFDAEKGTVEVEGPWKLDAGFDFQL

SEQ ID NO: 4423 - protein, 973 aa, Unknown
  Kingdom: Fungi, Phylum: Ascomycota
MAPYESHELRRGKYARLDAPTDDDLEPTPTRFSSESNATLEDLEEHDPLAFDSKLKRKKSAGDLKVRKASFKDAEAAHARPFARKKNFSPGRCCCWLLTFVAATVLLLAVGGIWAYKASVPRDGLSPAWYPSPKGGADPAWEESYKKAAELVRQMTLIEKINVTTGTGWSMDMCVGNNGAVPRLKFPQLCLQDGPLGIRFADNITAFPAGITVGATWNKELMYQRGKAHGKEARLKGVNVLLGPAMGPLGRMPAGGRNWEGFGSDPVLQGIAAAQTIKGIQDEGVMATAKHYVGNEQEHFRQAWEWGIPNAISSNIDDRALHEIYAWPFADSVRVGVTSVMCSYNQVNSSYACANSKLLNGVLKDELGFQGFVQSDWLAQRSGVASALAGLDMTMPGDGLRWAKGDSLWGAKLTQAVLNGSVPIDRVDDMVTRIVASWYQVGQDKWPDEGPNFSSWTNDEVGKLHEGSPSDKTTGVVNKFVNAQGDHKDIVRKVAAEGTVLVKNEDEVLPLSRKGHKNKAKSKRQTKFRVAVFGEDARLPHDGINKCPDQSCNDGTLASGWGSGAVDFPYLVEPMSAIRDAFDKDSVYVTDWLENKLPKQKEIVEDQDLCIVFVNSDAGEGYLKWADVRGDRNDLSIQKDGNQLIKDVAKGCGKGSGDVVVVVHTVGPVILEEFVDIPNVKAVLIANLPGQESGNAIVDVLFGDVNPSGRLPYTIAKKEDDFGPGSKVKYLPSPSDGLAPQQNFTEGLYIDYRHFDKQSIAPRYEFGFGLSYTSFELSSLLIHSTHAKSLLPSPRPAGLAPPTYPADLPSPESALFPKDIKKIEKYIYPYLTSTHGTTFHAPDPVPQSPLSAAGGGPGGNPDLYTTFLTVECSVANTGARDGATVVQLYISFPRDYKDPETREPVDFPVRVLRGFEKVHLQAGGERQAVKFEVTRRDLSYWDVTRQNWVMPTEGEFGISVGFSSRDLPLQGTW

SEQ ID NO: 4424 - protein, 397 aa, Unknown
  Kingdom: Fungi, Phylum: Ascomycota
MRFSDLSLAVLSCASTTLAARNQTKHSAYGQWMATSFLSKNQVIRHTYVPAVTLEGIQRVAAVNNNEDLLEYARSSVSSLVSANGTVTGYNDTYYTLDDIRMGNNILHWWNEGGRNETKYEIAAHRYRDQLNRWPRTPSGGFWHRAPTYANQMWLDGIYMADTFYATYTSYFDNDNVTAWQDIELQFDLIEQHTRNHTTNLLYHGYDEAKKAVWADPETGASPYVWDRAVGWYFVALVEVLQVYPKELPGYAKLASYFSTLAEGIKNVQDAEGGWWLLMDPELAGKAGNYIESSATALFTYAYFKGVRTGLLEKEYLPVANKAYDLMINDFIIYEKNGTLSWNGTVEVGSLKGDASYEYYTTVPLSLNDGKGAGPFMYAASEFNLALKNETTVAHLE

SEQ ID NO: 4425 - protein, 476 aa, Unknown
  Kingdom: Fungi, Phylum: Ascomycota
MMKVFTAAIAAASAISAVAADDFNLLQHVGGNGQWFPGPEVTGISSDVPAGCKVELAAFFSRHGSRYPDNGAYNEWTNLFDRIQAASNLTISDKSLAFLKTWKPVLSDPSNQIGQISTTGYRELTSMGANWRLRYPDLYDYNTPFTMWANYYKSGPRVRDSARMFAHGFLGPNATNLGTIYALNASDPRSWGNSLATSDLCTAYNDNGGSPYTDIWANIYLPPIRARLNAGIHGNFNLTQSDVSIIPYLCGFETQITGRRSPFCDVFTEEEVLQYEYAQDLRYWYGTGLGTDIEKYNMLPVLNGLIQRFVDGPNATYQTTNGTFVPPKIMASFSNDGQINQLVAALGIFDNEPQLPSNRTLLERKFRASRLVPMRGTVAFERLSCPATSGYPTTNSTNQAYLRIVLNEVVYPVVNCTSGPGSSCPLSQYQSIVQGKVNAVGDLTEACNTTDPSFAARPTATFFRDNTLPWQIVVKP

SEQ ID NO: 4426 - protein, 459 aa, Unknown
  Kingdom: Fungi, Phylum: Ascomycota
MKASVVAASALVASAAAFEHKNHAGFHLRRGAYEPAKDEICTVYTTVYVHAVPSVVPNVTASFELYSTPAVETSSSASISTSCTEGEKSSSIYTPIVISTKTPEASHPAYPTVPAVPEVSKPAVPEYPTKPAPEPSKEVPQPSKPATPEYPTKPVDTPKPKPSSSKPADKPKPTGSYSNGGRIVTNGNKWAMTYTPYAPDGNCKTESDIKSDIKQIADLGFTTIRSYSTDCGVFEYVVPACQEHGLKIIYGIFLEAGGSGGKGPFSQYANDQLDDIKNNAPKDGVAMVIVGNECMFNNNCAPGELASYIDHVRETLQGAGFPKDIAITTTEPVGTWEEKGAELCSHIDIFTVQVHPYFTASVSPDMAGDFAAQQLDQAAKVCPEAAAKGKFISEIGWPSAGNNNGKAVAGVAEQKEAMKKIMEKVGAEACLFSFKDDPWKHPGALNVEQHFGCADALSY

SEQ ID NO: 4427 - protein, 601 aa, Unknown
  Kingdom: Fungi, Phylum: Ascomycota
MLSTTAKATTLLALLPLSTWALPGAHLDVPWKKSGLFSGSAAKVVAKRDDGYPTGCNHGPAARSCWKDNFNVDTDMDLEWPTTGVVRKYHLEITNVTMAPDGFERPMSVFNGQYPGPTIEADWGDEIEITVTSYLETNGTGVHWHGLRQLGSNEMDGVGGLTECPLAPGGTKVYRFKATQYGTSWYHSHYSVQYGDGLVGPIVIHGPATGDYDLDLGVLPFSDWFHATTFTVNHATLHAKGPPTADNLLVNGSMTSSSGGQYAVTTLTPGKTHRLRLVNMGINNWVHVGIDGHPFTVIAADFVPVEPFQATSINIAVGQRYDVIINATQPVGNYWLRVGTGGRCDGPNANAANIGSIIRYAGADNANPNSTAAAPLPAGCYDEPIIPYVKTQVPQELPEELKLTFTDTGGFNGSDLVQWKVNDVPMLIDFENPTLQTVFEGFTGNETWGKTENVIEVGEKGHAWQYWVIQQDNVTAPPVPHPIHLHGHDFFVLAQQANAVWNGDISTLNMNNPIRRDTATLPALGYLVLAFESDNPGAWLMHCHIPFHISGGLGVQFVERKSEILKDNGDLGAMQQGCADWQKWSEEYHPNGILIEGDSGL

SEQ ID NO: 4428 - protein, 320 aa, Unknown
  Kingdom: Fungi, Phylum: Ascomycota
MFSKAIIATALLGAASAHQNFHQFWVNDETPGYQVGIRMPPSNSPVTDVKSDDMACNVGGSKVPSGVETVAAAEGDSIKVQWDNSGHPGPITHFLYGPVDDASQATGIGAGWFKIDEQDQVGGKWASEVMQANNMTHEFKLPTGLASGEYLLRSEMLALHSSQTVDGAQFYIGCAQLKITGTGSKGACGPTISLPGAYNADDDNIYIPKFYNGFDASTYTAPGGPVATCGGSGNAAPAPATSAASNGTAIATPTAATSASAVATSAVASAPAATSAAPTSVAAETPVASATASAPASSGSALPEEFTLETFIAWLKEQAA

SEQ ID NO: 4429 - protein, 263 aa, Unknown
  Kingdom: Fungi, Phylum: Ascomycota
MRSSAVTSLLAALAFTSAQQINIEAALAVPTPNLSIDPLAAPSALTYDVASATSSIAAAAAAAGETPAILKRGVLIERQDNTTCTNRTGGAGPVPSPDTSSAFLSFQPFADAAKNATTPTNYTAAFTNLHASTTAKTYLGVLELSTYDVANCTASCDATSGCTAVNIFFERTPTLNLGPGCTDAPSSTVIKCVFWGDAVTTQNTVNSGFTDNGFVVVIAGSNGYNKGEAAKEAAKSSGSARVEVAGVMLGAIGAVGAVMAFAF

SEQ ID NO: 4430 - protein, 302 aa, Unknown
  Kingdom: Fungi, Phylum: Ascomycota
MRYSLLIAAALPLAQGIRIVQSNDDGWAEINIRTFFNTLNAAGHQVVLSGPAENQSGTGSSDATPKTVDSDGCEFSSCPGGSPATGANATDPRLNYVNSYPVTAIKTGISTTAPKLWNGATPELALTGPNVGSNVAVQVPFSGTVGAAVYAAKTAKIPAIAFSGSSGDPTAWNQPTPLYSQIYADLALNVTSTIINSGKPYLPDNTWLNVNFPPVSSTKCNNVNQFKFIFTRINTGLIGSAADITVCGTTARLPWEADVAVIRGGDCYVSISPGDANDKTTAAAAQQQIIYNKLKPILSCLP

SEQ ID NO: 4431 - protein, 523 aa, Unknown
  Kingdom: Fungi, Phylum: Ascomycota
MDTLLTAEIYANSPRVRRRSSTFVDAIHDLPGKEEMAPAQLYSTESGRLFHSGRIVIATVGLPARGKTHTSVAVARYLRWLGVKTHVFHLGDYRRATLGPDQDVPEDYFFLNATPQSVLLRNKILKKCRDDIYHFLENEKGQVAIYDAVNAISQGRRSLAKEFAKKGIQTVFIESQCTDERIIQENVRRVKISSPDYQGWNDEDAVRDYLARINSRIPHFETMEEQDLHWIKMINAGERVHVNNCAFGYLSQRIVFYLLNLHIKSRQTYFARAGTTREEDSYKADAELSQEGKEYAKQMSDILLKYREEERQKLIDQGAPDAALKPLTIWTSTRRRTVQTSEYLASKGYRVRQRSQMSQMNPGVCEKMSERKIRQEFPDEVRKHEADPYHHRYPRAESYHDLAVRMEPIILELEREENDLLIIAHESVLRVLYGYLMACNAADIPKLQFPRDEIIEIIPSSYNNVAKRIKIPDLPKSMIPASPEDIQIPVPPSGAVRYRYRYDSTFDNERSSQQTDFESSLDG

SEQ ID NO: 4432 - protein, 543 aa, Unknown
  Kingdom: Fungi, Phylum: Ascomycota
MKVATSALLIGAASAAIPQQQVLKAPESFKGFDTSSWTKPLQNLEENLKSLTGEARAIWDEVAMMFPEQMEKAAFFSNPKPHTRKHDSEWDYVVKGADVQSVWVENESGEREREIDGKLENYSLRAKHVDPSVLGVDKVKQYSGYLDDEEEDKHLFYWFFESRNDPKNDPVVLWLNGGPGCSSLTGLFMELGPASVTKDQKIKHNDYSWNSNASVIFLDQPVNVGYSYSGGSVSNTVAAGKDVYALLTLFFKQFPEYSKQSFHISGESYAGHYIPVFASEILSHKKRNINLQSVLIGNGLTDGLTQYPEYRPMACGEGGWPAVLDESSCRSMDNALPRCLSLIENCYNSESVWSCVPASIYCNNAMIGPYQRTGQNVYDVRKPCGSNSLCYDELDWIQGYLNKKEVMKAVGAEVSNYESCNFDINRNFLLGGDWMKPFHRVVPGILKEIPVLVYAGDADYICNWLGNKAWTEALEWPGQKEFKKASMEDFKIDGDGKKVGEVKSSGNFTFMRLHAGGHMVPYDQPEASLEMVNRWLAGDFWES

SEQ ID NO: 4433 - protein, 408 aa, Unknown
  Kingdom: Fungi, Phylum: Ascomycota
MVWTALAVGLLALGSRASPVEPEKLAKRSPLFDYNGEKVRGVNTGGWFVLEPWITPSIFEGNAAKDEWTFTEIFGKDAAKSKLQDHWNSWITQDDFNQMAKAGLNHVRIPIGYWSVIPIDGEPYVQGAYDKLGEALDWANDAGLKVMIDLHGAPDSQNGFDNSGKYGNVGWTQGDSVSHTTKVLNKIRDDHASHPAVSAIELLNEPLGPNLDMNTVRQFYMDGWGNLRDSNVAVTFHDAFQGVTSWNDWGSGMWNLLLDTHHYEIFTLDAVAMSIDDHIKTACDFGNQMKSNNKWTISGEWTGGITDCAKWLNGKDKGARYDGSFGGGSKIGDCTGKSTGSVAGLSDADKSNIGRFIEAQLDAYEKATGWIFWTWKTEGAPEWDMKDLLANGIFPQPLTARKYPGQCG

SEQ ID NO: 4434 - protein, 307 aa, Unknown
  Kingdom: Fungi, Phylum: Ascomycota
MFLTCINIKMYASTLASSLLLFASTASALSLLPRTDSCPKVWSAVLPELQTAFDGCGRDAHGAIRAPFHDCINNGCDGSLILTDECSRAENAGLSDICGKLLSWTQKYNTSAADMIEFAAAVAISSCPLGPRVRALVGRKDSSEAAPLNSMPGSRDSISSILDKFKAKGFSGDDVVALMGTHSVAVQVNDDPAQAGKSLDSTPSIYDLKFYQETMDGTAPYSLQSDKGLANNTETQKKWKEFADGDTSAWNTAFTDAWNRFSVIGNDVDSLQDCSSIIPSGASERRLAKRLGGSAAARAFVRRLYDS

SEQ ID NO: 4435 - protein, 229 aa, Unknown
  Kingdom: Fungi, Phylum: Ascomycota
MDYQAPAPAAGGRGCYNCKNPEIRLQIHETRHMEIRLLAIAFQRTFTANRSKQARFADSGDNSHRAAECPTKGTPTCYNCGEKGHVSRECTSPQAEKTCYRCGGTGHISRECTQAGGAPGGRAGGQECYKCGQQGHIARNCSQGGASYGGGFGGRGGFGGQGGYGGARQTTCYSCGGFGHMSRDCTQGQKCYNCGEVGHLSRDCPQETSSERVCYRCKQPGHVQSACPN

SEQ ID NO: 4436 - protein, 249 aa, Unknown
  Kingdom: Fungi, Phylum: Ascomycota
MKFGASIAFLAASLFSAVRGDAVPWERIDKNNSLLLILDLQVGLYQLARDWDATLYKENIMAHAELGKLFDLPVILTTSADTGPNGPLPKEMIEMYPDAPLIRRQGEVNAWDNPEFRAAVEASGKKQIIVAGIVTDVCTAFLALSLRAEGYSVFANIEGSGTTTQLIRDTANSRMERAGVQLVSLFSIVCDLMRDWRATPGAAEVLPYLDKYLPVYGMLARGHAAAIENGTVIPGEAGLITGQNGTVVI

SEQ ID NO: 4437 - protein, 957 aa, Unknown
  Kingdom: Fungi, Phylum: Ascomycota
  misc_feature (102)..(102): Xaa can be any naturally occurring amino acid
MATFLENAYSLVHQDNAADVPSDNELKTALEKGNDEQKIETMKKILAIMLNGDAKTGLLMHIIRFVMPSKSKPLKKLMYFFFEVCPKHDAQGKLRQEWILVXSNAIRFDLQAPNEYVRGNTLRFVTKLRDAELVEPLLQPVRQCLTHRHAYVRKNATFAIASIFTHLPELMPDAPDLLTTFLDEENDPTCKRNAFAALTSISHEKALEYLSTVFDAIPNHEELLLLAELEFIRRDAAINPGNKAKYLRLIFDLLESQVSTVIYEAAHALTTLTSNPVAVKAAAGKFVELAVKEPDNNVKLIVLERVNQLRDKNEGVLDDLTMEILRVLSSTDLDVRKKALHIAMEMISSRNVEEVVLLLKKELMKTVDEQYDKNSEYRSILISAIHQAAIKFPEVAASVVGSLMDFISDVSSNASAVDVISFVKEVVERFPDLRPSIIERLVSTLGEVRAGKVYRGVLWIIGEYALEVKDIQDAWKGIRASLGEIPILASEQKLLDDASEGKEGEDQVNGHSKAAAPTGSRKVLADGTYATESALTSSAAAKAKLDAVKNSQKPPLRQLVLDGDYYLATVLSSTLTKLVMRYSELSQNAARTNALRAEAMLIMISVIRVGQSQFVKTLIDEDSVDRIMSCVRSLSEFSQKKELEIVFLEDTRKSFATMVQTEEKKRAAKEASERMKSAVNVDDSFSIRQLKKKDADGNDEIEQDLERATGGDTATEDLSSKLSRVVQLTGFSDPVYAEAYVKVHQFDIVLDVLLVNQTTETLQNLTVEFATLGDLKVVERPPTQNVGPHDFINLQSTIKVSSTDTGVIFGNVLYEGEKGVDSNVVILNDVHVDIMDYIKPAQCTETQFRTMWTEFEWENKVNINSKAKSLREFLKQLMACTNMSCLTPEASMKGDCQFLSANLYARSVFGEDALANLSIEQEGTNGPITGFVRIRSRSQGLALSLGSLKGLNKVGVA

SEQ ID NO: 4438 - protein, 843 aa, Unknown
  Kingdom: Fungi, Phylum: Ascomycota
MTTPLCLAGAIAFLSQLVTAFVDYGVVTPKAFSQRPTLLDTDLTSWTNKSLTLTPSDPLVTLDYGTEVAGFPFFNIAALSGLVQIEVKYTEEFSGLLQPYSDGPWTFSNGLANTFRVETFNVTTSGYIESFFVQGGQRWQSAKLITNGSVTIDGLGLRSTADNVAVDKLPGHLKTQDEVIDSVFNLGGRVVQAACVDAGNAPSTWEITHNGAYVRGQASAQSALGVTAANYTLEFDVKIVRGGAGWRVASAIQPLGPYFVLTSEYPEDNTFANTNLTLLPSNSLVFNSGWSLVNQSTLPTPENQYYRVNKTIKEDTWYRLSTTIEAVGYRVRLDGDEIVFVPLPPPAAPGNFGTPSRYEGTWGFGGMQEHLTYYKDVKVTARNGSIIYSKPLTSEDALAEYQVAPLDASVCLDGAKRDRLVWAGDFYHTVRVLALSSARWDYVLGSIEYVLSYQLDSGPYAGFLPISANLGSRPEYKESNPGNYAGLVDYQDLFLTSIGEYYRYTGNADSLRPHWGQIKKLATARLAFIDPSSGLVAGSPQVPSPFSFLGPANGTATTGLFAYMLEKIAPLAHALGDEEASVQYTQTASQLRQALNQKLWNAELGTYSLSTTSSGNFSLTGIAWAILSGAANRTQAESSIAKLEELRFAVGYKTSSSDEETDDYQLAPNPSGFLLEALFMSRRDFAANSTTAIDHLLQNLWGSMVKNNEYYSGASWEYVKPDGSPGIGLFTSLAHPWGAAPTYVLPEYLLGVAPTSPGYKTAAITPLIGYLDLPEVSGRVPTPHGPIKVAWAVKGSSAELTLVIPEGVTATLQLPSGATVSGYNSHNGQMEVSCGTSTFQLSL

SEQ ID NO: 4439 - protein, 360 aa, Unknown
  Kingdom: Fungi, Phylum: Ascomycota
MRLKTSSAVSAAFWFAVNAAPSCGTTLNATRIEFKHWPANASRALSDMIIKNANQSNYAVFDMDNTSYRYDLEESLLPFLENRGILTRENLDPSLKLIDFKDTANFTETLYSYYLRLCEDDDFICYPWIAQVWSGFTLRELKGYVDELMALNSTIPTQYWDGDEVANSTVNSPQVFRGQAELYNALMDNGIDVYVISAAHEDLVRFVASDPKYGYNVPPKQVIGVQTLHRNATTGYLTNARKEIIDGTYDPEVYLDLVFGSYLWTPATWFAGKWAAILTYIDQWKRPVLAAGDTPGSDSYMLFHGVDTAKGGIHLWVNRRDAYLEQIRGEIRNNTAAQIANGREVTADKNWVFVKPADIL

SEQ ID NO: 4440 - protein, 953 aa, Unknown
  Kingdom: Fungi, Phylum: Ascomycota
MKSFTNALTWVLAGSALVTAQVAPVKELVVSHDGACGNGITCLGSSFGGCCSASGQCGSTSDFCGRGCQIQFGHCQDTVGKPSPDGTCGGRIGYTCEGSKFAGGTCCSQYEYCGSGPEFCGDGCLSGFGDCDSSLKNSTVTPSSSIASSSALASPTSSIAPSTSPVVDETRNATAEATKGPFKLSVRQEAGLPCPGANGTIYTAANGAQYEVECGIDHFGNDICWPGNGFTTETLQKCLDECSKWPNCKSVSWVNQWKPGGPCYIKSSTITPPMYADHVRGAKLIKPCTDCPTTTPDLNLPPYATPSSTIRTVTSSTQSSDTPSSRVPSTQSSATISRTASSSASVITSGTVSFSATHTITPTTFASSANPSASFEASASASATACAHSFPKRTFDELSPVFRRETFDKDCVPCDGQSGLLPYCGADVTTDNYKFTPKTCRTVHYNLDITNTTIAPDGIERIALTVNGQLPGPLIEADWGDTVIVTVNNKLQDNGTSIHFHGIRQLNNSEYDGVPSITQCPIAPGDSFTYKWVATNYGTSWYHSHYAIQAWEGVVGTMIIHGPTSKSWDVDAGTIFLQDWAHKTVDSMYDDAQDAINGGPRTMDNGLINGKNTWGVQGTRNQTGERFELPVKFKPGKSYLLRLINGAIQSTYKFYIDGHELEVINMDFTNIVPYKTNIVNIQIGQRYMVLVKASQPAGNYWMRADNQAACSRTTQALDIKGIVRYQGAEDLPAVPTTTAYNYTSECVDEPLASLVPMAKVNAFGPDQRFTSDVTVLPNSENLFKWYLSGTTFYSKYEDPTLIRVIANDSAPTYSGNLILDLPDMHKWIYIIVQSAIPLSHPIHLHGHDFLILGAGDGTYSNQELNIFNPPRRDTANMPAAGWLAIAFETDNPGAWLMHCHIGWHTSMGFALQILEGQSMIKDTVQDECALYGTCTQWNKWVAERGFKQHDSGV

SEQ ID NO: 4441 - protein, 227 aa, Unknown
  Kingdom: Fungi, Phylum: Ascomycota
MKAFIVLSTILAGAFAAPLTPGVSAPLEARTLRLFTDLLSPKCPANAAQPDGKLPYGSVSTSALVPISSKNPNTAYPNSEWAKVTPGDFCTIFNLVLDSDATQGKVCNLVFDLPDYLQAPGDFVFVGSGRFTFTGYDINAGAVPGETTYAKQPRPGPSPPNPPPVMKPGNSYVVNSAPCGIPPGIGPVTVSGSLCSKDTTFFFRQSQKSCPVGFYVVLTDDGGMSAS

SEQ ID NO: 4442 - protein, 366 aa, Unknown
  Kingdom: Fungi, Phylum: Ascomycota
MVAIKASLLLGAGALVSAVPTGLDARASCTFSDAASAIKGKTSCTSIVLNNIAVPAGTTLDLTKLKDGTTVTFQGTTSFGYKEWEGPLISVSGNKITVTGASGHVIDGNGAKWWDGKGTNGGKKKPKFFYAHSMTSSTISNLNVKNTPVQGFSINGATGLTLDHITIDNTAGDVTNGGHNTDAFDVGSSTGITISNANIKNQDDCLAINSGTNIHFVGGTCSGGHGLSIGSVGGRSDNTVKGVVIENSKILNSDNGVRIKTVSGATGSVSNVTYKDITLSNIAKYGIVIQQDYENGSPTGKPTTGVPITDLTVTGVTGTMASKGVETYILCGKGSCSNWKWSGNKVTGGVKSSSCSNIPSGSGASC

SEQ ID NO: 4443 - protein, 414 aa, Unknown
  Kingdom: Fungi, Phylum: Ascomycota
MPSTNTFLAVTAAVGCALAQRVPAAAQVVDQKIFNVLENVPPPAIANDSTLFVWPGVTEESLLAKPFHIYDEEFYDVIGSNPSLTQIASSESDPIFHEAVTWYPKRDEVFFVQNAGAPAAGTGLNKSSIIQKISLADAEKVRNGTLKAAPVTIVNTTNPQVINPNGGTNYKGNIIFAGEGQGDNVPSALYVMNPEAPYNTTSKFTASEPATVLIRPALLNNYFGRQFNSLNDLVVSPKNGDLYFTDTLYGYLQDFRPVPGLRNQVYRYNFKTGATTVVADDFTLPNGVTISPDGNKAYVTDTGIALGFYGRNLSSPASIYSFDVAKDGTFENRKTFAYVPAFIPDGVHTDSKGRVYTGAGDGVWVYNTSGKLIGKIYTGTVAANFQFAGKGRMIITGQTKLFYVTVAASGAPIQ

SEQ ID NO: 4444 - protein, 407 aa, Unknown
  Kingdom: Fungi, Phylum: Ascomycota
MKGFTYMSYALLTLVSFSAAHPGMGDTMAAMRREANKVKRAESKQLIGDLRTLKDSQLTPTGKDIKAILLDQLDAESNVIDTSIPAGSLGSAACKADLCCVWKWISYEMSSKFNGTSGRCNKFARQAVRLGFHDAGVWSNTSSYGGADGSILLSDEISRADNNGLSAIATQMQAWYKKYSPYGVSMADLIQIGATIATVVCPLGPRIRSFVGRKDNSRAGPTGLLPGHTDSADSLIKLFAAKTIDAHDLVALVGAHTTSQQHFVDTGREGDPQDSTPGIWDFDFYPETTGNAAPRVLKFTSDINLSKDPRSAGEWKEFSDPSSGQNHWNEDYAKAYTRLSLLGVNNINDLKECTKVLPPHRPSYVAEDQPILDLWLQGQFDQLNNLVDEAIMLTGVGGGGSGTIINP

SEQ ID NO: 4445 - protein, 555 aa, Unknown
  Kingdom: Fungi, Phylum: Ascomycota
MFNLLVSLLAAYATLTSAKTVTYDFNIGWVTAAPDGYSRQVIGINGQWPVPMIEADVGDTIVVKATNMLGNQATSLHFHGMFQQGTAQSDGPVSLTQCAIQPGDSYTYTFIANPAGTHWYHSHNKGQYPDGLRGKMVIHDKAWESSLNIDAQMTYSMSDWYHRQMSDIINDYMSPSNTDGSFASPDSILWNDKKQAQDIQVAAGKRYLLRIVNIGGLACGQFHIEGYTLSVVEVDGVQVQPQNADTIVICAGQSYGVVVQGKSSSLGISANANYIVRLSTDMFTQGIPPANQITIIGNIVQSLLGSLLSIITNLLSLSWVPAATFDDFNLKPLDGQKLLSPVDNKIELSTNQTYYSGIGTRISLGPQPWVPPKVPSLFTALSTGDAAMDPATYGPGVNPWVVKYNQVVQIHVQNPNPYPHPMHLHGHVFQAVARGVGTWNGDESSLPSVPLKRDGFVVPANGYIVLRFKASNPGVWFFHCHIDLHLVSGMAATIVEAPDVLQGQQSITSASQGICGSKPSKGNCNAGPGAISAMSAATQCNNVLNYKGPYNAVVS

SEQ ID NO: 4446 - protein, 606 aa, Unknown
  Kingdom: Fungi, Phylum: Ascomycota
MKVTHALIATGLVGHAAATWNMFGSPFNSPNYNNNECSDKQKAGFDWSDLKDGDSNFSYGDFDFSGGWKCSNSFGKRDLITKRTFGSKCIKNKVSKEKPASFGCDKRKSGFSITHIDVSVEFDVDLELHYTMEDGSKCKQVAPCSSSGSTIQNTQCGGAKSVDVYLPKHDKSDKECEIGFHNIGFDCNPGKGYTPPSPPSPPSPPSPPSPPSPPKESSSSAPVVSQPASSAPASSAPATEVTVSSSAEVSVPTPPATETPSTPCGGYGQESCEGISSAPVETPTSHVPGTFSSVHYTNSSVPATTAPATQETPASQPPVESTSAPACDGSYGASCEGTTAVTSASTLASTVSSYSVILSTGVPQPSPSSPSYPPVSPPDVLPKCMNTWLEVSGNCKNNADASCYCKNKDFTKNVIDCVSAWCGTDDETRQSLQYLIGICAEHVPENPGLVTDCPSYIPLNPTPASPTAPAGGASTPAGEVGSSTAAPGTTPAPTSTPCTTITYGSTTLTIPQVHFTTETNEAGAAAPTEPVGLVAGTAPAQTPASTTAAAPYPTVPVAGTTLATLKPTGTGALSPTSPAEFTGAAVPFKLEAQHAILGAMLAFFAL

SEQ ID NO: 4447 - protein, 170 aa, Unknown
  Kingdom: Fungi, Phylum: Ascomycota
MASRSSVIRAARQLTSVAAKRPSPFACQQWRQTAQMPRLFTVSAQLKEKKYTEDHEWIEASADGKTYTLGISEYAAKALGDVVYIELPQIDLEVGEGDAIGAVESVKSASDILTPVSGTVAEVNEALESKPGDINKDPEGEAWIAKITVSEEPAGKLMSEAEYKEFTEEA

SEQ ID NO: 4448 - protein, 262 aa, Unknown
  Kingdom: Fungi, Phylum: Ascomycota
MFTKASVVAFFASVAAAQLHAPVGEPAGNPITRPLIEVVPACKAFTITWQPTTPNTVSLLLLRGPSTNVVPIQTLAEGIQNSGSFVWTPASTLEADSSRYGLQLIDDVTGQYQYSTQFGISKEDCAVVVSSSSVAPVASSTPAGYPVASSSPAGYPVKSSSAGYPVASSSVVKSTPVAPYPTTVKTVGTSSAPVASTGAPVYNSTIIKPTGSMTVPSSLRPSATGAANGTSSATLPESTGAAGSIKAGLSLVGAAALAALML

SEQ ID NO: 4449 - protein, 390 aa, Unknown
  Kingdom: Fungi, Phylum: Ascomycota
MRFFAIAALASLAHMASAVGVVGKAEGFAAGVTGGGSATPQYPKDINELTTWLTDSTARVIVLDKTFDYTNSEGTVTGTACASWGTGAKCQRILLDSCDAGQVKETVTYYKAAKQPIKVGSNKTILGIGSKGIIKGKGLSFGGKNVIVQNIQVSDLNHKYVWGGDALSFAGADLIWIDHVTTARPGRQHYVFGFTPSTRITLSSNFINGLSDYSTGCDGYHYWVFEMVGTGDSITMKNNYITKTAGRGPALSGKTLLHAVNNVWFDVKGHLLEGGDAGARGIFEGNVFNNVQNVVADYAGKLFGSPDVTTNKQCSSALGRDCQINLFQGTTTTASSLTSKKDTSFFSEFNGKTIASAKAASEIAVRIPNAAGIGKLSALAGRSASVKFRE

SEQ ID NO: 4450 - protein, 434 aa, Unknown
  Kingdom: Fungi, Phylum: Ascomycota
MLRSIAACALAGAVAVDAIATISAKGSKFFTSDGDQFYVKGIAYQLVPDDPLIDATQCGLDAALMKTIGTNSIRVYHVDPKQDHTKCMSAFADAGIYIWLDLDTFDTQIEQIAPKWNETQRDAFAAVMDEFQQYDNLAGFFVGNEVLTTANGSVAAPYVKAAARDMKAHRDSKNYRKIPIGYSAADIATLRPMLQNYLACGSNASEALDFFSLNAYSWCGDSSYQTSGYNMLEANSTEYNIPIFMSETGCNVARPRTFQDQNALYGEMADTWSGSIIYEWIEEANNYGLVSYGEKVDPASPSAPPDGFPRSGTPTPVQPDFSNLSGVWKTLNPTGVQESAYNPTNPAPECPAEMSGVWEVNPTSPLPTLGQTYNQQVATATASGSGTSKPSGTASGSAGQASASSTGAASDGLSRELTGAGAALVAVMAVFAWL

SEQ ID NO: 4451 - protein, 399 aa, Unknown
  Kingdom: Fungi, Phylum: Ascomycota
MRCDVAVTALLASGATAAAVKKGFVTTKGTTFKLDGKDFHFAGSNAYYFPFNDLASDVEAGLAAGKKAGLNVFRTWGFNDRNRTTVAGGLPQYGGEGAGPSPNVLQWWNNGTAEINLAPFDKVVKAAEKTGMKLIVALTNNWADYGGMDVYTTNLGGRYHDDFYRDPKIKNAFKKYVKAIVQRYKSSPAIMAWELANEPRCGADAVRNLPRSSNCTPDTITAWIDELSTYIKSLDKDHLVTWGGEGGFNIASSDWAYNGADGGDFDKELSLKHIDFGVFHSYPDWWSKTVPWTVQWIKDHAASGRKAGKPVVHEEYGWLTDDKRQEYLGRSDNQTRVDVLGLWQKTSLDEKMSDMYWQFGYSGYSYGRNHDDGFTIFLDDAEAKPLVYEHAKKVNALNK

SEQ ID NO: 4452 - protein, 354 aa, Unknown
  Kingdom: Fungi, Phylum: Ascomycota
MMTINAILAVGALLSAASASVLPRDHPVARPSLTWDLKPTNSTQQFRGLSPISRDEVWVSGTNSTVLLTTNGGTSWISVSPSLAENFTLFQFRDVEAFSSKSAVVLSIGEGNASRIYRTTDRGRTWKATFINTEPTAFYDCMAFENKKHGLAMSDPVDGKFRLIETWDSGATWKIVDPAGIPATLTGEFGFAASGTCIEAAAGRWYIASGGVDAGRIYRSDDGKKWKVSNSSIAGGAAAGVFSVRFRDEKNGIAVGGDYEKPAGNVDNAAWSKDGGKTWLKAQSFPGGYRSGVSWVPGRGQTAVAVGTSGSDITYDGGKNWQIIGNGTFDSVECVSKDTCWASGSGGRVARLKL

SEQ ID NO: 4453 - protein, 619 aa, Unknown
  Kingdom: Fungi, Phylum: Ascomycota
MNTIRTSSITLLGLVASVQAAVSSTGFTVSLTDIDYFLPPKPVATIAGCDELKASFADGPFVPFTVLKAAGYGTLDVASLTAKYAEEDDVWQDGFLDALYVQGGSAGSVSSTVITGTVSGELKPGPYFINAAGQVFEAWRLYSDATGAFTESVIASGDGSYSVLPAGTVGQKLALAVPSRLYFEKTAEKPLAGLRLGIKDIYDIKGLRTSNGNRAWYWLYPPANATATPVQNLIDAGAVIVGKMITSQFANGEVATADWVDYHEAFNPRGDGYQDTSSSSSGGGAGTAAYAWLDISLGSDTGGSVRAPSQVQGLFGNRPSHGLVTLEHTMPLAPVLDTAGLIARDPMIWKAAAQAMYGSNITISNAYPSSIKTLAWPTTANNPANTLLIDFLANVTDFLGANTTAYNVTASWETDNPTLEPLLSMMNLTYPLIITKQQTELVREPFFKDYAAAHDGRTPFVNPVPLARWGWGDNQTATLEEGIANKTTFMSWANSTFLAPSAETCSESLVMYVGSTGRTTYRNTYLDAPGVPFGFSNSRISVFSEAPDFVVPIGEAPYNSTITNHVEYLPVTVDFMAAKGCDGMLFSLISDLTEAGILTEALAGRSGVTGGETLYRRGF

SEQ ID NO: 4454 - protein, 168 aa, Unknown
  Kingdom: Fungi, Phylum: Ascomycota
MDAYKNAGNRKDEPPKHEMVHFPGLLSSKREFGDFRTVLHTGLYSQVVAMEVPVGGDIGDEVHTVDQILMFTSGRGLATVAGKDQEVKAGDVVVVPAGTQHQFVTKGDQPLELITVYAPAEHLPTSVHKTKEIGDKEEEDGIDEAPEWSQRSKKENEEKGLVNESGKY

SEQ ID NO: 4455 - protein, 938 aa, Unknown
  Kingdom: Fungi, Phylum: Ascomycota
MSVEPEYHLKHTNVSRPQLSHSSSQRSIAASQAASEGYYSASEHNSSDSDDRKRLYQTPTSRTPTGSHEQLQTQQQVPVTSLRGVGIPRGQPQQPHAAHTLHGRPISTITEERRSMDTRRRSNMDPDSQATTPGQDTTPYIRFAIDQLTRDEEVRGSRVYPDVRYEDDYPVDRIVPDGDLGYMAQEQQTQKRMSEHMPPNSNRHSKRHSIPRKPVATPQQNVQFSSPAPAYESPARTRQQPPYYQHRTPAQMQAEPLLHDDPRVQYPQASAFSADKDVFVAHDLDHMPLHFVPAILRPVWLGLFTFLCLLMLAGLIASAVLSLRDGGNGLWNYNSFGDGRYFVFEYLPTLLGMVLFIWLIQIQTALQRVIPFLSMASDSFHRRSEAVFLELHPTQFLLPRIEHFRAGHPAIGICYVIFWLFAWTIPLLAASFNVRYDLTESVWRWVTVQGVIWTVVALYILLVIALIVVLITLRKPTGLRWDPRSLADIIALLERSNVMAEYEGSETFSKNDWDRLRNRADRIGYWSTSNRTNDIFYGIGEENGETRRFSIEDGRIREKMSDRAYPEQSQNQPGDFHIRTDIRSSTVRLRFLPWYLKDGAVIAYIVIGIILLIAFYVISYVNSAVRLGFLPSVTARTNAAGFSTSNFLYSFVPAVIGMFLFLALLSVDYSRRVLQPYMSLSSPGGATAETSLLADYPCRLPLSATLAALINRHLATALLSFVSLASLAIPVLAGGCFWTQYYTNEDTVRVAADLPGYYALCFFLALYIVGLFALLPGRKQAKLPHRSNSVAEIVSWVYQSPILGDRAFNRPQTKPELVTKLMGTAYADRSFSQSVRSLVRGDSPTDPALGEKEKRRVGVPQRDSTVDPGAIRYGFGIFVGRDGLEHLGIDRVHRRERPTGLVIWEEQQSHSKAKKSRRSKKSKHDRKERNNSETENMV

SEQ ID NO: 4456 - protein, 885 aa, Unknown
  Kingdom: Fungi, Phylum: Ascomycota
MASDRDILPSWAKPSHYAISLYDIEFGGKFSYKGTVSISTKITKDDGFSELVLNAHQLKVHSAELKAGDATKSAKDISYDGKRQRVTLDFGEKINYSGEATLEVKFEGTINNIMAGFYRSKYTPKGEVPVSVAKDDEFHYMYSTQFEACDARRAFPCFDEPNLKATFDVEIEVPKDQVALSNMPEKESKESKRDGFHTVVFETTPIMSTYLLAWAIGDFEYVEAFTERKYNGKNIPVRVYTTRGLKKQGEFALDNCHKIVDYFSEVFQVDYPLPKVDLLAVHEFSHGAMENWGLITYRTTALLFDPETSADSYRNRVAYVVAHELAHQWFGNLVTMDWWSELWLNEGFATWVGWFAIDYLYPDWNVWGQFVTDSVQQAFALDALRTSHPIEVPVYDGLEVDQIFDHISYLKGSSVIRMLSAHLGEKVFLQGVADYLKAHQYSNATTNDLWSALSKASGQDVTSFMDFWVRKIGFPVVTVAEEPGQIGIRQQRFLLAGDVKPEEDSTVWWIPLGLHAGSSPSTASVHETGALTQKEETIRNVDSGFYQLNKNLTGFYRTNYPPERLVKLGESRHELSVQDKIGIIGDAYANSIAGFGSTAGLLALVEKFQDESDYLVWSQILTNIGNVRSVLSGSDDVSDALRKYHLKLITPAVEKVGWEFKDGEGFLTGQLRASLILSAGLVGHKATVDEALKRFEAYTSGSDKSAIHPSLRRAVFGIAVKNGGESAYKAVQKEYLSTTSIDGKEICLVSMGRVQTPELAQDYLKFIFSDKVATQDKHSGTIALANNSKVRPEVWKYVRDNWDQTVHPALSGNLVVLERFLRFGLNKFADDKVADDIAAFFKNKDTRGYDKGLEVIDDTIRSYAKYAKREEAVVREWLKANNYLS

SEQ ID NO: 4457 - protein, 349 aa, Unknown
  Kingdom: Fungi, Phylum: Ascomycota
MRFSLSTVLTAALGLASSSDALRILMGNDDGFGSGNLRELYKLLKEAGHDVAPAQQQSGKGGTVIWAESANLTVASQYNIVPAGSKSVGRDPSDDDIWYYDGTPAACTFVALDYVLPRYYPEWHGTADLFVAGPNYGTNLGAFVMGLSGTVGATFAAVSRSIPGIATSASNKAVPYFNVTGPSHPAALAAKVTFEVVNEFIENTPSGQSVLPLGYGVNVNIPELVNGTTPPIVKTRLTGNANTDVAVYNETTGLFDWDNIDPVAAGINAAYNGDTSLPGETWVVAGGGVSVSVFTMDFSAPENTYTDLVFNKVESLFSEDNETKTGYSKRMVEERMRKRGVMMTGRDAL

SEQ ID NO: 4458 - protein, 645 aa, Unknown
  Kingdom: Fungi, Phylum: Ascomycota
MSAIGIDLGTTYSCVGIFRDDRIEIIANDQGNRTTPSFVAFTDTERLIGDSAKNQVAMNPINTVFDAKRLIGRKFADAEVQADMKHFPFKVIEKAGKPVIQVEFKGEEKTFTPEEISSMVLVKMRETAESYLGGTVNNAVVTVPAYFNDSQRQATKDAGLIAGLNVLRIINEPTAAAIAYGLDKKTEGERNVLIFDLGGGTFDVSLLTIEEGIFEVKSTAGDTHLGGEDFDNRLVNHFTNEFKRKHKKDLTSNARALRRLRTACERAKRTLSSSAQTSIEIDSLYEGIDFYTSITRARFEELCQDLFRSTMEPVERVLRDAKIDKSSVHEIVLVGGSTRIPKVQKMVSDFFNGKEPNKSINPDEAVAYGAAVQAAILSGDTSSKSTNEILLLDVAPLSLGIETAGGVMTALIKRNTTIPTKKSEVFSTFSDNQPGVLIQVYEGERARTKDNNLLGKFELTGIPPAPRGVPQIEVTFDVDANGIMNVSALEKGTGKTNKIVITNDKGRLSKEEIERMLAEAEKYKAEDEAEASRISAKNALESYAYSLRNTLSDSKVDEKLDAGDKEKLKAEIDKTVAWLDDNQTATKDEYESQQKELESVANPIMMKFYGAGGEGGMPGGMPGGAPGGAAPGAGGDDGPTVEEVD

SEQ ID NO: 4459 - protein, 235 aa, Unknown
  Kingdom: Fungi, Phylum: Ascomycota
MKLTLLSLALLSGALAAPAPAADAEAFPISELLTSNLSPEEHALSKRQYSSSTYNQLTDGTACRPISVIYARGTSQAGNVGDSAAVGPLFFNQIASRVGGTSQLAIQGVTYSASVAGFLQGGDPTGSTTMTNLISTTATRCPNTKIVLAGYSQGAQLVHNAAVRTSAANAARVAAVVVFGDPKRGQSFGSIATSKTLTICHSGDNICEGGATITAAHLNYQQDAPTAGAFVAGKV

SEQ ID NO: 4460 - protein, 353 aa, Unknown
  Kingdom: Fungi, Phylum: Ascomycota
MKVTLAATLIPLAFASPTYPTGQKPKPAPGLADLAKKAGLKYFGTAIDNVVLDNKQYTSIAFNKSEFNQVTPANGQKWVSVEATRNVFNFTLGDQIVDPSKKAGQLRRCHNFVWHQQLPDWLTSQKWSKQELLSILENHIKHEAQHYYNDCYAWDVVNEAFNDNGTYRSDIWLDTLGPSYIESAFKFAKKYTAPGTKLYYNDYNIETVNNKSLAVQTLVKSLQAKNIQIDGVGLQSHFITGSSPSYDQIRAAQQLFTSLGLETALTELDVRTQLPDTAALQATQATNYADSVRACVDEKRCVGVTVWDFWDPVSWVPSTFPGQGDADLYDANFTRKPAYYAVADVLKAAAKGH

SEQ ID NO: 4461 - protein, 198 aa, Unknown
  Kingdom: Fungi, Phylum: Ascomycota
MAAPASVNVKNLQGKWVMNKSLSDAFDPVLALQGIGWLTRKALGAATVTLHLKHHTAEDGTSSQIDIDQLISGGLKGSSEKRTLDWQWRGHSDYLFGTVKGRTRYNTLSAILEEAKGKGVTEEDAKFLAEGWLKETEEGEVVESFVDNEGNKWTARQVWGFAEIGGERRYVRRIVVRKSDKNEVQRVRLVYDYAGELA

SEQ ID NO: 4462 - protein, 1065 aa, Unknown
  Kingdom: Fungi, Phylum: Ascomycota
MSLSTVANQDNSDPVTYTCTCAAQTEGGYVLLFYRYWGNTPALPCEHATNSQDPHALAEYHRHLASELELGGKFRFATEGYNITLGGTKSAIERYIQACCTHWSFAGIDLSTPSARDAYFKPTPGCACAFGGKASVRTTAEITPLGVTNYSPSSWSNVISLPPAEFHDLLEKGDIPLIDVRNHYESRIGYFVTSEGTVAVRPAVRRFSQWPGYVVRHVLGNDAYKKPQGIATYCTGGIRCEKGARWMQEALAKDGGSNEAPVYTLHGGIVAYQAWMQEEIDVGRKMPEDSFFKGTNYVFDARGTIGAQQAVSTCHNCNKSENRLGKCEMPGCHLVLVVCELCEQQGGIACCEDCRQIGSEQQDSSTRSRRMYLLSRAANLNLQYDHMLQTRHEHVFNARHPIGLGLSPNVYLNAVYIMKDDRPSTLNQVQLNTSPSFEHPSMGLDMPKIMRRHLQKRDYNVTIDPSTLNFTHGVASGDPYPDSVILWTRISPQLENDHSNVTVAGTVPLYSHETERYVRASTSPICVDYQVSTNKNITGEVVSKGRAYTTSDIDYTVKVEAKNLSPFTTYYYRFNVCGSSKASPIGRTKTSPTADDDTTELGLAVFSCSNYPSGYFNAYGNAARRDEVDYFVHLGDYIYETSSGVLGRDARATNPPRTIFTLYDYRARIAQYRTDLDLSLAHQNFAWITTWDDHEVSNNGYRDGSSAVNNTESSFLRNGGVSVDQRKMNAVRAYFEWMPIRQVNLDDNLRIWRNFQMGKLFDLIVLDTRNYDRSITDLNWNTDYVTSIRNDAGRSLMGSNQENWFYRTLSESKERGAAWRVIGNQIVFSRVNISSWFGSEEEPYNVDQWDGYTSNRNRTYQHLYGNQIDNTIMLAGDSHANWVSDLLWVDPESAPYASLNNGVDIPAYNQATGEGAIGVEFAVTAVSSSGFSGNIATTNAQAQKLVRDNSELMWNEGYFRGYLALYLNAREARAEYYGAPTVRTRNSYDIPLANFTVQAGANHLQRPIAGGSVNSGYLKNADQPGKVAGVNSTLALDTATGAWGPVPNALLAGGNYITYARTNST

SEQ ID NO: 4463 - protein, 278 aa, Unknown
  Kingdom: Fungi, Phylum: Ascomycota
MSLKYFTLALAATAAAAPGSPFQALEAQASSDNPCEPCQPSGATGMDPPAVGSDLSSLYVNVLDSVKGISFSKRDGMTARATSGFCCVQSLNCVNVQSLNIPMCYDKFTTNFKFPDGSYGSLTTGEYNSNNQQINLLTGEYSGGNIYSADPQDKPNTSTLSIPAQYTGTGVGGAIPASELGSVVVYTTTIPGTTFTAPTTVPGTVRAATVNGVAVSTTIAPQTITEATTVAPQTTVVTTQVPDASASASSKGAAGAVSYDSSKSFGVSVLGALMYFLM

SEQ ID NO: 4464 - protein, 744 aa, Unknown
  Kingdom: Fungi, Phylum: Ascomycota
MKFHSSYSSMLAPFLLLASAPLGALANDVLKTNGYSSCLSGNSDITVNKLDIQFDRTTKKIKFDVSGTNGKEQKVMATLKVNAYGKEVYSNTFDPCEGDMKVDQLCPVPAGTFGASGEQSIPDKYISQIPAIAFSVPDIDSQATMQLTAKDGGAELACITSQVSNGKSLSTTGVSYIAAGIAGAALAVGGLSALAGAGHTGVAHSSPTFGDVVFWFQGMAMNGMMSADVPGVYRSWSKNFAFSTGLVYWEGMQTSIDGFREKTGGNLTTDSVKFLSNATLVHVDQNMTLTKRSFDGISDVLLWTRDELSTNVNGTTDSSEDNKIIHAVKGIQGYVEEYKIPNGNTFMTVLLWFAIVIAAITVGILLLKVILETWALFGTFPKRLTSFRKRYWWTLAKTITNLILLLYGIWTLYCVYQFKNGDSWAAKVLAGVTLAAFTAVLAFFTWKIWSIAHKYKKMEGDNSALYDDKEVWRKYSIFYENYKRSYWWIFVPAIIYAFARGCVIAGADGHGLAQAAGQLIVEALLLCVLLWARPYSLKSGNWINIIIQVVRVLSVVCILVFVEELGMTQTTKTVTGLVLVVVQAVLTGVLAILIAVNAIIICCKENPHRKKRKEAEKARDLDNLTPLDARNSLLMDPQEYKRSSLPSPFGPRAAGYDAVPLAEQNTAYNSGRRFEEDRGHLLADASTFGRTPSHNASFSDDRDRSSSPQPRLPDLDFGHSQTGYTQPNNAPWQPQRGNQGGNAY

SEQ ID NO: 4465 - protein, 228 aa, Unknown
  Kingdom: Fungi, Phylum: Ascomycota
MLCKTVLLAGALALGAFAAPIPDCPDKENSYTAPSTDNKATTGSITAEQLTQIAPETASCSGAPFPEECADATTAATALNKSFDTYGIKTAGEKAALVAYTLFESGNYKYSKNHFPGRPGQGTRMMAMPPFIAKYATAVAGADAVATASAAGGDAGLVAVLALVNSDDEKSFGSAAWFYSTQCTDDVKAGIQAETVEGWHNFLTACVGTTLDEARDTPWVAAKAAILA

SEQ ID NO: 4466 - protein, 616 aa, Unknown
  Kingdom: Fungi, Phylum: Ascomycota
MAPSTIWLTAFLAATTSASPLLISRDLNVLVEADLEGITSSVKNLFLKGSNTTVPKNETRCKVYPGDAAWPSDEAWSQLNELTGNRLLSRPTPLAAVCYPAHPDYDAEQCATYSATWTQSYTHMHDPIEIMSPVAQGMTCTPPVIFDSHNCTRGGFPAYVVNATEPKHVQLAVNFARNSGVRLVVKNTGHDFLGKSGGKDALSIWTHYMKDVEYIEEYADEKLGYTGPAFKAGTGVQAFEIYKAADEKGRIVVGGEGETVGVMGGYIQGGGHSPLTGLYGTGADNVLAFEVVTADGEFVVANSTSNTDLFWALRGGGGSTFGVATSVTVKAHPDVPVTASRFSFSSKQTSNEIFWSAIRSYLDINIQNADAGTYTYWMIIPSNGSFTFQFSPFFAPNKTLSEATALLQPWFNTLDSLNITYAPNLTYFGTYYSAWRSSFPLESVQKANVATGSRLFPRTNFETTEKRQELYEHIRASSEKGRVQVHFNMQCKSDADNAVNSAWRPLVSFSMQSVRWGLNSTAAEILKARKDFQAIDMQAWRDISPGAGGYLAEADRLEPNFGQAFWGEKYPRLLELKAKLDPHDVFFATTAVGSERWKVESVDGLPNENGKLCRVE

SEQ ID NO: 4467 - protein, 337 aa, Unknown
  Kingdom: Fungi, Phylum: Ascomycota
MVKLGALAFGLLTVVAQVSAQQTVKVMPFGASIVSRCWRANLQAKLRNDKVTNFDFVGSQKSTCGGTNVDQDHEGHPGSQAVDYVAKGNLTVWLDQNPPDVILMLLGTNDVLIGKKSTGDILKAYDTLIGQMRAKNPKMHIIFSNLLPLDTARWPQTAADGIVNLNAAIKQYAPSKSTRDSPVTFVDNFTDFDPVKDTTDGEHPNDAGNEKMATKFFGPTRDAIKAISGTDAKQKGQAQAAQDQLAATTTLITSTVKSTAQAKSTSAPSSSQAQSTSAVASASTSVAAQSQATNAATPEAKTSPTQSTSQTSSASSVWEGTDALVCGYADVPLLLRR

SEQ ID NO: 4468 - protein, 138 aa, Unknown
  Kingdom: Fungi, Phylum: Ascomycota
MKFSASALALGLASLTSAISVSYDTGYDDGSRSLTALSCSDGANGLITKYGWNTQANVPSFPRIGGYQGVEGWNSAQCGTCYGVTYNGKTIYVLAVDHTATGFNLAKAAMDELTNGQAAQLGRIDAQYAQVATSNCGF

SEQ ID NO: 4469 - protein, 377 aa, Unknown
  Kingdom: Fungi, Phylum: Ascomycota
MLSKSLFALALLASQGLAKKDWVKGKAFDRIAIIWLENTDYDLAIGDPNLAALAKKGITLTNKFAVTHPSMPNYAAAVSGDYYGINHDNMVNIPSNVSTVVDLLEDKGVSWGEYQEDMPSTGFQGFSYPNPKTGANMYVRKHNPAVLYDANTKPERLANMKNLTLFQEDLKNDKLPQWMFITPNMTSDGHDSTVTVAGTWTRNFLEPLLNNKNFMKNTLVVVTFDENHSYAQQNRIVGILLGDAVPKKLVGTTDDTYYNHYSELSTVQANWGLHNLGRWDVGANVYKFVAEKTGDDVRKWNDAVVPFSQMFFNASYAGKLSNKKTSVPWPVPNTQAKHAGRTVLPAVVQTWGKMFNQSAYTKGLEIPDGMHPDAEFK

SEQ ID NO: 4470 - protein, 224 aa, Unknown
  Kingdom: Fungi, Phylum: Ascomycota
MKFAAVAILSLAAGVLAAVDPEHCGPQYGNIVCKDNNCCSQYGWCGSTKDHCDASTCLKSFSAPGSSCAPKKPTTTLKTTTKASAPTSPAQTFPASVPVIDVCGHAQGGVTCPGAGANGYFYRCCSSAGHCGPKNDIQDQALYCGDGCQAGYGKCDSQKAPSEPTVARGADAGEGETCGPIVNKKCKAGLCCSGSNFCGTGADFCGAANWCQKNWSGSTNLCHA

SEQ ID NO: 4471 - protein, 1054 aa, Unknown
  Kingdom: Fungi, Phylum: Ascomycota
MRTSIIAFGALAGLASANINFSWVNPTCNINAPNRCLTGQHCGEDNTCVPDIKSDHSKISTSHLQIVPEKRQTKYSQDGQCGPSHGNLLCDPNSTVYKGTCCSSYGWCGNTDAHCGTGCLSGCDNTPAEPVASKAAAVSYRDDGRCGKDFGGATCDPKGAYGGCCSSYGYCGSTDGHCLVADGCQNGCKDAPTTTAAATTAAVSRPPSTTTSGEPVLGKPSTVDSAPAQPTGKQTTDGSCGATFGDTICGNWAQGSCCSMYGYCGNTTAHCGEGCQSGPCVNAPSVPAPKASPAPAAAKPGTIQIKGRSGVPAMHAGLMQNGKVVFLDKVENYTELKLGNGQYAYSSEYDPTTQKLTPLAYKTNAFCSGGIFLADGRFISVGGNAPLDFIDPTVGDGFKGIRYLKRSATDATLDGQAWSEPGQQLDTARWYASVQIMPNNEIFVASGSLNGLDPTKPENNNPTYEILNADGTPKTKSINMEILNKNQPYYMYPFLHLMKDGNLFVQVSKSAEIFNVGTGNVVRTLPDLPGTYRTYPNTGGSVMMPLTSANQWNPDIIICGGGPYQDITAPADPSCGRMKPLDANPTWEMDSMPEGRGMVEGTILADGTIAWVNGAQEGAQGFGVAQDPALEVLLYDPNQPKGKRFTTGPKSTIARLYHSVALLLLDGTLLISGSNPVEQPILQPTAKDPYVTEFRNEIYTPPYLVGNPTRPSAVQISTKALKADGSKFTIKFNAPANSKAVKIHLYYGGFVTHSVHMGHRSLFLDNTGFKAGATAQTVTVTMPPNRNIAPAGPYVIYVLVDGVPAMGMALNIELFTAATPNGQKISIFLEELGIPYRTTAIDLGADDQKKPNFLKINPNGRIPAIVDHSRNDFPVFESGAIFLYLAEHYDKDFKFSFHDADDKSEMLQWLFFQNAGVGPIQGQANHFFRYAPEKIQYGIDRYQNETKRLYSVLEERLKDRDYLVGTGKGKYSVADISTFTWVRWGPWAGIDLDKFPNLKKWADKIEQREAVQKGLLVPNGDDQIVKLRKDPNVEDPFKGWVMKGQNEIKEKHGR

SEQ ID NO: 4472 - protein, 402 aa, Unknown
  Kingdom: Fungi, Phylum: Ascomycota
MADLKTLSLALIAAVALPAAAAELPAGVIAVPLSRDSGLTAYYAEFQVGTPPQETYLKVDTGSPNYAFLDPRNPVCATQDCKTFGTFDNTTSSTCHYEGPGFFDALSYLGNGDYLNDTFILGGVTMEKMYFGYTSSYISPNRVTGNVSTILGLSLNCQIGGPKCTDKGPVLLPQLKNASLIDRMSTSIYLGRDDGDVKNAQMLIGGAYDKAKVDGELFTVEMVDPHDLQLANGQTNSVNVTAIEVVLDGGNRTAETYGQKNVGSPVLLDTGIAAWYMTETIFAAVYHGLGGQGDVPGGTRYVPVDCVYRDPNHTKSYVSVEFGTAGTVKVPFFSLVSKFADGTCGSFIEARGDVLSTMGDPFLRGVYSIFDQENWTITMGQVKHAEQEDIVQIPTGGFQTAR

SEQ ID NO: 4473 - protein, 457 aa, Unknown
  Kingdom: Fungi, Phylum: Ascomycota
MKSVAIAAVASALATTVAGSPATPVQKRADVTSITVKGNAFWKGNERFYIRGVDYQPGGASDAKDPIADADGCKRDIEKFKELGINTVRVYTVDNTAEHDTCMNALADAGIYLALDVNTPKYSINRASPQVSYNKVYLQSVFATVEKFAAYSNTLLFFSGNEVINDDSTTNCAPFVKAVTRDIKSYMNARKLRKVPVGYSAADVESNRYEMAAYMNCGEDSVRSDFYAFNDYSWCDPNTFTGAGWDQKVQKLSNYSLPIFLSEFGCNTNKREFNEVKSIYSTDMSSVYSGGLVYEYSQEDSNYGLVEINGDSVKELTDFTTLKNAYANATDPSGDGGYKSSGSASECPTESKTWNVTIKADQLPAFPSGASDYLKNGAGTGPGLKGSGSQSSGSQETDLAGAGDGAVTSGAAGGTTGTSSPSKGAASALRPGEFSFAPLAMGAVVLVSSLFGGALIL

SEQ ID NO: 4474 - protein, 582 aa, Unknown
  Kingdom: Fungi, Phylum: Ascomycota
MRTTTSVAALAFALLQGTNAFNAAKSRDFNLLADMGINPDGSSIETATAANIARSLHIGTTVKDSVVNVATRQAASPYPEKIAEEYVALKLDQFGKSKETFNNRFWVAESGYKAGGPVFIYDVGEADASGSWQFRLQNETSFFKQIVDQFGGVGIVWEHRFYGNSTPAPINLDTPPETFKYLTTEQSLADVVQFAKQFKRKNINATLTPDKTPWIFVGGSYPAMRAAFMRNMYPDTIYASYASSAPVEASVDQSFYFEPVYRGMNKYGFGNCTQDIKAAIKYIDHTFDTDRSASAALKEQFLGKGAASNSHATFADALTTIFYLWQSYGVDGGSGSLRSFCDYIETDPKTNATAPAEGWSKSKGAKYVVDRWASWKTFTPLVNNYLETECSGKQNVTGTCDLNKRFTDPSSISWTWQYCTQWGYFQSANLGPNQIVSKYNSLQHQHDICHRQFPDAPRSLLPDWPNTDRTNKVFGGWDIRPSNTYWSGGEFDPWRTLSPLSTEPFAPKINSFTDAPKCGTTTSKRDLFGYTMADAQHCYDFRTYFPGGAISRKYFTDALSQWLKCYKPKGGYGHGYSKRFTA

SEQ ID NO: 4475 - protein, 467 aa, Unknown
  Kingdom: Fungi, Phylum: Ascomycota
MRSTIRALAALASAACLISPSTAQTYTNCNPTVRTDCPPDSALARTVNIDFSSQSDSFTPQSNPTYGKDGVSFTISKSGDAPQLTSKWYIMFGKVDVVLKASPGAGIVSSFVMQSDDLDEIDWEWLGSDPDEVQTNYFGKGQTTSYNRGAFHADAGSQSGFKTYSIEWTPEQIVWQIDGKTVRTLEPANAENQYPQTPMQIKFGSWAGGDPSNAAGTIEWARGPTDYSKGPFTMTVKSLRVQDYSTGNQYTYGDTSGTWQSIKSNGGTIYSGGDKPLNSDSPQITATATGAPLPFTPSRTSSDYERPSVYPWIPGTSSATPEPTFGNYPGLPSGWTVSDSGKVLPPSSAPQSPLASSTASPAASQLASSGGSKPLIWTGYDERGFTTVYTSYPGTTQAPVTQLSATAAAAQPTTTAKVSVDLALENAAETAPPVPKANPAVKVLPWLCTPLGLLFSIFLIIGGSRWN

SEQ ID NO: 4476 - protein, 108 aa, Unknown
  Kingdom: Fungi, Phylum: Ascomycota
MGYEKGDAKKGANLFKTRCAQCHTLKEGEGNKIGPMLHGLFGRKTGQVDGYSYTDANKQKGITWNEDTLFEYLENPKKYIPGTKMAFGGLKKPKDRNDLITFLQEETK

SEQ ID NO: 4477 - protein, 395 aa, Unknown
  Kingdom: Fungi, Phylum: Ascomycota
MSSFLKIALPALALTGSAYAQSNSCSVSATKTIQNAGDATALSSCSTFTGSIAVATGTTDDIALNGIKMIKGDIVATNNSNMKRISADSLEEVDGSIELDGLTRLYAVDMPKLKTVETIKWNALPNLQTIGFTAEVTKADNVRIENTALRSLKGINIEKADTIFVANNGYINEINMQLGNVSDSLTFADNNEKLAVTLPNLIWATNLTFRFIGSLEMPSLETLNGSLGLYNNGFDSFSAPNLTSIGEALAIVANEQVSNLSFPLLTKITDNLQIANNTNLTAIDGFPQLESIGGAFDISGNMSDVETPKLDSVKGAFNLQSTGNVTEACAFYKPLKDKKLIQGKYFCQGKLVDPSVAGSKPTSQGNGDDKTGAATSLSAVNGALGLAAMAAVFLL

SEQ ID NO: 4478 - protein, 305 aa, Unknown
  Kingdom: Fungi, Phylum: Ascomycota
MRFSTVAATALAASPAIVAAAKGTMGFALGTKQPSGSCKTQADYEDDFDAIKSGAGATIVRGYSASDCDSAKNILPAAKSKGFKVVLGIWPDVEDSFQKDLKAITDVASSYTDSIYAVTVGSETLYRGNFTGPELADKISTVKSKLPKGIKVGTADSWNKFADGTGDAIIGTADIIMVNAFAFWQGASRDNATHTYLDDMYQATTHIEKVAGGADKAPEVWTGETGWPTAEGTDYDEAKGGLDNAKHFYQHGFCALLDWGFNAFYFEAFDEPWKPASIGDNGKAADETAWGAMTADRKTKFSLKC

SEQ ID NO: 4479 - protein, 599 aa, Unknown
  Kingdom: Fungi, Phylum: Ascomycota
MGRVEEPASTLVKVANSATVALNMAGVDLRTLIAKRVATLPSVPAAAARLQLSSLQQSRLQHQHVRRQLPPQHPPTRFPPTPPAAPTMAGLPAWAALSATAAAAQGGADRRQITAEAHVKQASASATPSATGGVLQCLNGKNVPYKMTSDSDYAELIEPYNLALPYKPSVVVLPETQQNVQDAVICAGQSGIKVQAKSGGHSYASFSTGGKDGAMMISLQPFQKVELDTSTGITKVGGGVRLGNLADGIYTQGQKALSHGTCPGVGIGGHFTHGGYGHTSRHWGLAMDQIVAADVVLADGSLIKASSTENSDVFWGIRGAADSLGIVTNFYLQTQAAPPSITYFAFPFSNMYNTKSVFTNAWLHLQDFAKNSSVVDNKISFGVYIDNYGTFSLSGAYFGTVDEFNSKVKNELLRTLPAPTSTTVKAYSWYDYLVLVSGKTQIKEPLTGYDEHENFFAKSITVPESSGLTSAGLNAWFDYIKGTSTEYYTIVNLYGGPGSAINSKDTTFAAYNDRDSLWVFQNYGYGTSSTNFINGLNDAIIKAQPQTNFGAYLNYVDPSYDAATAHKLYYGDALYAKLLTLKKKVDPNNVFWNPQAVGA

SEQ ID NO: 4480 - protein, 361 aa, Unknown
  Kingdom: Fungi, Phylum: Ascomycota
MLPRYTTWLTLLLSTSTTLAQTSTSCNPTEKTCPADIGLSSSTYTHDFTTSGADDDAWNITAGNVTYTSSGAEFTITKSGDHPTIQSKWYIFFGRVSFFLRAAPGTGIVSSAILESDDLDELDWEWLGGTDYVSKVQTNYFGKGNTTSYDRAAWSPVSSTQTTTHNYTIAWTSSATTWLVDGAAIRTLDYADAVAGKNYPQTPMNIRIGIWAGGDSGNDAGTIEWAGGETDYADGPFTMYLERVEVVNENPGGSYEYGDLTGDFTSIKVNGEDDAGSSSSSALSGSSGSTGSGEESASESAKGTATVEPSASETKTGMWWTASASASAVLAQAAASPALKLSVPVWQFCVLGSAWLLAAAL

SEQ ID NO: 4481 - protein, 325 aa, Unknown
  Kingdom: Fungi, Phylum: Ascomycota
MTSSLDQLKATGTTVVCDSGDFATIDKYKPQDATTNPSLILAASKKPEYAKLIDAAVAWGKQHADNIDDQVDATLDNLLVQFGKEILKVVPGKVSTEVDARFSFDTQASVNKALRIIDLYKEQGIGKERVLIKIASTWEGIKAAEILQRDHGINTNLTLMFSLVQAIAAAEANAFLISPFVGRILDWYKASTKKEYSKEEDPGVQSVGSIFNYYKKFGYKTIVMGASFRSVGEVTELAGCDYLTIAPNLLEQLYNSTDSVPKKLDASNASSLDIEKKSYINDEAAFRFYFNEDQMATEKLREGISKFAADAVTLKDILRKKIQES

SEQ ID NO: 4482 - protein, 157 aa, Unknown
  Kingdom: Fungi, Phylum: Ascomycota
MFTPSTSRIARTLLTSARLQTASINPTSTANLYRPLLTQKFFSSTARMSDTGVHNLQTKAAFDEALGDKSSLMVLDCFATWCGPCKVIAPQVVKFSSTYPNARFYKLDVDEVPDVAQELGIRAMPTFLLFKNGDKVAEVVGANPKALEAAIKANVDA

SEQ ID NO: 4483 - protein, 401 aa, Unknown
  Kingdom: Fungi, Phylum: Ascomycota
MSTTISLLAAATAAAASIIELPVRIEGSYASVEVAAGTPLQPYRLLFDTGSSTTWVTSTACTETSCPNPRPYDRTLYSANASSTSTDLHSFSRIPYIDGDGIAGAATLDVFSTRDGSFKWNQTFLSVNESSWRWITADGFLGLGFSSIAEANTSSLVETLLWGGQLDEPRFGLFYGTNLADEGEQNGVLTIGGSAEDKYVDGSVVFTPLRKEDEYQLWRAPLRSVNVLVARQPNATVVTNTGRLPHTTDAQSVWPKANTTWDMYGFGAAVFDTGAGRISVPDEIIDAVYFNLGWNVTKLVHGEERMECEHLNASWALTFTLGEGAEEDDVSFSIRGDEFVVPGEQCMPPIDNSGQNSFALVGSAFLQRYYTVFDFGGEKVEEYKPRIGFGRLKKDWDYLYQ

SEQ ID NO: 4484 - protein, 1007 aa, Unknown
  Kingdom: Fungi, Phylum: Ascomycota
MAPSGFLQASALVTSLVVLTAAQNPTATPTSATGWSTTLAGTPTSFRPVFTIPASADVGADVIPNIQDPKAVDAQDVCPGYKASELKETDGGISAVLTLAGAPCNVYGNDVDVLNLKVEYQSNTRLAVSIEPAYVVASNTSHYIVPESLVSRPQVEDSHKDLDLAFAWGDDPSFWFTVTRQSTGDVIFTTKGTHLVYEDQFIEFVNTLPEDYNLYGLGERIHGLRLNNNFTATIYAADVGDPIDRNIYGSHPFYLETRYFTAGGNGTKKPLKQSELNDENGGYTTGGKGSGFESYSHGVYLRNTHGMDVVLKPTNLTWRSLGGSIDLFFFDGPTQPEVTKQYQESAVGLPAMQQYWSFGYHQCRWGYRNWTELRDVVESLRNASIPMETIWLDIDYMDQYRDFTTDPVTFPASGVKDFFDWLHGNNQHFVPIVDSAIYIPNPTNASDAYDVYTRGNKSDVFLKNPDGSQYIGAVWPGYTVFPDWMSTNGVSWWVNEMVEWHKSVPFSGFWIDMSEVSSFCVGSCGTGNVTLNPVHPPFSLPGEVGNVIYGYPEGFNITNATEAATASALSASQAAAAAATAASSVSVEYLRTTPTPGVRNINHPPYVIDNVQGDLAVHAVSPNATHQNGMVEYDVHNLWGHQILNATYQGLLSVFPGKRPFIIGRSTFAGSGKWAGHWGGDNASKWYYMYFSIPQALSFSLFGIPMFGVDTCGFNGNTDAELCARWMQLSAFFPFYRNHNTLSALSQEPYRWESVASASRTAMHIRYSLLPYMYTLFHQAHTTGSTVMRALAWEFPNEPQLAGVDTQFLLGPNILVTPVLEPQADTVRGVFPGLVDGESWYDWYTGEKVQADAGVNTTISAPLGHIPVYIRGGAVLPTQEPGYTTAESRKNPWGLIVALSEDGTASGSLYVDDGESIEQESTLEVSFTAKSCALKAHVQGDFKDTNALGNVTILGVHSAPAQVKLNDLTVDSSKIAYNATASTLKLCDLNDLTSGGAWQGSWTLSWA

SEQ ID NO: 4485 - protein, 608 aa, Unknown
  Kingdom: Fungi, Phylum: Ascomycota
MKYSLITGLLAVASTNGKPTSHVESESVNVETLRTVPQGWAAISAPAGHRKLPFRIAVRSADTDILERTLMEVSDPNHARYGQHLKRDQLKDLIKPRAESSGAVLSWLEESGISSEDIKDDGEWITFHAPVERAESMLGTTFKTYQNQVRRDVKRVRALSYSVPKAVRDHIDLIEPTVRFGQIKAERSNVLTKEAAPFSVAAVNATCNTTITPTCLKDLYNFADYKVDPKGAVKLGVSGFLEQLARFADLKQFASTFSPGAGSNFTVTPVNGGTLDQNATDDSVEANLDIDYTVGLVDPTIETTFYSTAGRGILVPDLDQPSEDDNENEPYLDFFTYLAGLPDDELPQVLSTSYGEDEQSVPATYAKKVCDIIGQLGTRGVSVIFSSGDTGVGSACQTNDGKNTTRFLPIFPASCPYVTSVGGTYKIEPERAVSFSSGGFSDLWERPAYQDAAVGAYLEKLGSQWEGLYNPAGRGFPDVAAQGQGFRVVDKGVQISVGGTSASAPVFASVVTLLNNARLAAGQPSLGFLNPWIYSKGYQGLTDIKDGGSTGCIGRSIYSGLKAPKVPYASWNATEGWDPVTGYGTPNFGKLLELSQGQSNSSYSVPPS

SEQ ID NO: 4486 - protein, 891 aa, Unknown
  Kingdom: Fungi, Phylum: Ascomycota
MRPLLAITSLLNLPIIGAFDISTTTIGSWKVASTKDVGINTAKLSVPDINTSSWYTIGSRGTLMASLLANGVYDETSLFFSDNLQNVEISQFRVPWFYRTEFEAQPDNDTFTQLVTNGISSRADFFLNKRYLGGTIGAYAGSEIDVTDELQAGKNVLLVKVYPTDYNRDFALGFVDWNPYPPDNGTGIWRDIQIKKSGQVTIDKPRVRTTLSGDLDFSVSVKNLGNTKIEGRVQCAVTDPDGKEIGTPRTPFEADGGESDLVELHLKVESPKIWYPSQWGDQPLYSVQCTATNNSNTFVAAAYDQTPVTKFGIRTVTSRLNSHNDTVFSVNDQPFQVIGAGYTSDIFLRFDVEKLRTQFNYVLDMGLNTVRLEGKQEHPELYDLADEMGIMLLPGWECCDKWEAWTYNEEKSGEEWDDEDYETAASSMSHEAGMMQNHPSVLGFLVGSDYWPDSRATDLYLNTLWGYNWTTPIIASASQNGYPERLGNGGMKMAGPYDWVPPNYWYDTDNGNDTHLGAAFGFGSELGAGVGTPENGSLSKFLDASDLDDLWQSPDKGLYHMSTNVSSFYTRSIYNEALSKRYGAPTSLNDYSLKAQMADYEATRAQFEAYLSRWSAERPATGLIYWMINSAWPSLHWNLFDYYLHPGGSYFGTKAALGNLETAVFDYHSRDVYYTNRALSITGSEARHLSIEITDLAGTAIYQDLNNTYADLTAKPNSSNRITHISALHNTTSAVLLRLTLSSPDLPDPLSQNTYWLGPQPDVLDYNNSTWYHTPVSSFSDLTALSHMHKAKIVVRGKGKSLQIENTSDVPAVFIRLNLVDGNGDDVVPVVWETNYFTLWPRQSYEVAVDAGAKWDVDDLRVVVDGRNVERRVVRLNGGTQVLPGDGFRAQ

SEQ ID NO: 4487 - protein, 790 aa, Unknown
  Kingdom: Fungi, Phylum: Ascomycota
MQLVSIALCFWAAVAQSAVIAPYPRSADAATTNFDAVVLDEKLQPRAAADGYWLNDLSGKGIAPFNPNPAGYKVFRNVKDYGAKGDGVTDDSDAINRAISDGNRCGPFVCDSSTDSPAVVYIPSGTYFIQKPIIFYYATVLIGNPRDLPVLKASATLDALALIDGSPYSNQDGSPGWTSTNLFMRQIRNLVIDGTARDPTKGFQAIHWPASQATTIQNVKIRMTQASNSVHAGIFVENGSGGHMADLDIEGGLYGMNIGNQQFTMRNVKISKAVVGISQIWDWGWLYSGLSISDCGTAFSMTNGASAGKLEVGSVVIIDSVITNCPTFVDQAWTLSTTPTGAGQLTIQNVQLNNVPVAVKGPNGATVLAGGSITIDTWGQGNRYTPNGPQKYQGIFTAAARPAGLLDNGKFYSKSKPQYETLTTNDFISARSSGATGNGNTDDTQAVQNAINAAVSQNKVLFFEHGVYKVTNTLDFPPGLRAVGEAFSAIMGSGSAFADQNNPRPVVRIGQSGQSGSIEWSDMLVQTQGGTPGAKLIEYNLRTARGSGIWDVHTRIGGAKGTNQQVAQCPVGSVNPQCFAAHTNVHITSAASGAYFENNWFWTADHDLDDWNSTRVAIFTGRGLLVEGRGIWLWANGVEHHAFYQYQFNKASDVFAGFIQTETPYYQPTPDALSSPYTRQAAYNDPTFTAGQRAWGLRAVDTTNLQVYGGGLYSFFIDYSTACSDANAPGGKRICQNQILSLEGSTSFQAFALSQVGVEQMLTINGQDKAIWSDNLSVYSNTIGLIQSGL

SEQ ID NO: 4488 - protein, 387 aa, Unknown
  Kingdom: Fungi, Phylum: Ascomycota
MRLLITSTALAASCNAFALPSWTALAVDPNLPALPLEHFVTPKFARPLTLDQALSGQNASVTTIKPDDLQAAKDQVPTLVLPINGTVHGALAKLADTVDDVLDHFTKRQGLCSNVRTRVEWDHASNDQRQGYINAIKCLMNSPPSGQFPVSQSRYDDLVGLHQTLTPNVHGNAKFLLWHRYYTWTFESLLRDECGLQGPLLWFDETRYAGNFAASSIFSSQWFGSINLGGNCVTDGQFANQVCVYGPGSSNTPHCLARNNDDSDTINTGNPIVDACNSRSDYADMAACAEGGAHAWGHNGIGAVMSDVYASPSDPVFFLHHGFIDRNFRIWQNNGGNARVSSVDGTDAFGNALTLNTKVNVYGFRPDVRVGDILNTRGPTLCYKYDY

SEQ ID NO: 4489 - protein, 209 aa, Unknown
  Kingdom: Fungi, Phylum: Ascomycota
MAILKGPGEPKSYDGSNLRIGIIHARWNTTLITALLDGTTKALKAAGVRDENIVIQSVPGSYELPYAVKQLYSASQVQSSTGGVVGAAADLLGSASDLTKLSVGGSGEGKSTQPFDAIVAIGVLIKGETMHFEYIADAVSHGLMKLQLDGNVPVIFGLLTLLSEEQGLYRAGIAGPNKNEGHNHGEDWGSAAVELGIKRKGWVEGKFVD

SEQ ID NO: 4490 - protein, 744 aa, Unknown
  Kingdom: Fungi, Phylum: Ascomycota
MVRSGLVAAFAAYAHVAQASCPFMEAETRDVPASHPQVKRADGSYGMPSNTDEFMAQYEVNDTNVYMTTNTGTPIEDQESLSAGERGPTLLEDFIFREKIMHFDHERVPERAVHARGAGAHGVFQSYGDWSNITGASFLSTPNKETPVFIRFSTVAGSRGSADTVRDVHGFAVRFYTDEGNFDIVGNNIPVFFIQDAIKFPDLIHAVKPRPDSEIPQAATAHDSAWDFFSQQPSSMHTLFWAMSGHGTIRSYRHTDGWGVHTFRFVTDEGKTKLVKFRFRTMQGKASLLWEEAQITAGMNADFNRQDLFESIENGQYPEWIFEAQIFEEDDQLRWGFDVLDPTKIVPEDIVPFTPLGKLTLNRNPRNYFAETEQIMFQVGHVVRGIDFTEDPLLQGRLFSYLDTQLNRHNGPNFEQLPINQPRVPVHNNQRDGAAQMYIPLNTAAYSPNTLNAGSPKQATQKDGRGFFTAPNRSTGGRLVRAVSSTFADVWSQPRLFFNSLLPVEQQFVINAMRFETSQLKSDVVKNNVLIQLNRVSHDVAVRVAEAIGMTAPEADDTYYHDNTTTGVSVSEAPLLKIDGLKVGFLTSNSGSSDTASSLKAALKDVNVGFSVVAEHLGDGIDQTYSATSAVQFDAIVVDGSASALFAAPGSLANSNTTASNTTSGWRSTLFPAGRPLQIVQDGYKWGKPVGVVGSGSQVFSAAGVQAGTPGVYAFGANGTASIVEQLAEGLKTFKFLDRYPLDN

SEQ ID NO: 4491 - protein, 626 aa, Unknown
  Kingdom: Fungi, Phylum: Ascomycota
MPRMYKQALVALVAELATAHIIPRQASIDYNTAPPNLSTLANFSLFETWRPRSHVLPANGQIGDPCMHYTDPATGLFHVGYLHGGNGASGATTDDFVTYTDLNNNSANFIFPGGKNDPVAVFDGSVIERGINGLPTLLYTSVAYIPIQWTVAYTKGSETQSLAIARDGGRNFTKLEHGPVIPSPPFAVNVTGFRDPFVFQNPQVDALLKKRSGTEYTIISGGVHGSGPSLFLYAHHGDESDNFQTWEYIGEWWHEKANTTWSEAGWAGRWGFNFEVGNYFALDKDGYNPHGEIFTTLGAEWSYDPIVPQVSDVREMLWTAGKQSIVNGSIEFEPTMAGRLDSGKSAYAAAGKAVPSSSQASQKSGAPDRFLSYLWLTGDYYGTLNTPKAQQNWTGSLLLPRELSVGYLDVVDNELSREKGAWRVDTEHNNGTVTLAMLSQKIARETLAAFKSNTTAVIKQAGGRRSSGATFDRSPSSKHYILSTSITFPSRSNSTMAGLEILSGDLETTRIYYQFSNESLVVDRSNSSAAAATNDWVQTDTESGKFRLFDVPCENGTEIETLDLTIVVDGGVVEVHVNNRFALSTWVWSWYEDSRNIRFVAEGGEVKFGDVTIWEGLVDAWPQRSS

SEQ ID NO: 4492 - protein, 642 aa, Unknown
  Kingdom: Fungi, Phylum: Ascomycota
MKFTSALGALGASSVLLSGVSAIQLDITSPENIKQVAKTLSVNLRQYYTGDRPGDTPGNLPDPYYWWECGAMFNAFIDYWYYTGDDQYNGITTQAMQHQIGDYSAFMPPNQTKTLGNDDQAFWGMAAMTAAENKLPDLGDGNPSWLALAQAVFNTQKDRWDNATCGGGLKWQIFTFNNGYNYKNTISNGCFFNIASRLYKYLGNDTYAEWAEAAWEWELAVGLMSQDYHFYDGTDDKQNCSSVNHIQWTYNAGVHMAGAAAMWNVTQNDLWRTRLKGLIDGAGVFFKDNVMTEVACENNGKCDVDQRSFKAYLARWMGYTAIVAPWTSQYIDPLLQASAKAAAAQCTGGVNQTSCGLRWIDNGANDGSFGVGEQMAAMEVVQALLYPTVSGPATQNNGGISKSDPNAGADVPQTPITFNAVTTGDKAGASILTIIVLVAIIADAHAPPSKPISPSTPYVTTRQRVLLTRELRTTSACFINMPPPSKLLDQINSYLETRKSAPPYVNETTQLPTLQQLTVNDTPDFTKAFLSSGGSHVLDKKTNNQQNNHQHACITDKVAKESKDSNASTHQLHDEENQATSGGSVAANAHKANPVGSTPSLLDRLQHAGWTLTGRQGPVHADNLPEPASKEELKKRAEELNK

SEQ ID NO: 4493 - protein, 486 aa, Unknown
  Kingdom: Fungi, Phylum: Ascomycota
MRSFFRASVLSLVSQQASFVISTAVPETVDVAVIGAGLSGLTAARDLLHAGKSVIVLEARDRVGGKVYNHPLANGGVTEVGAEFVGPTQDKVLGMISDLGLQTFYTYSQGQSILWRNNTRHVFTPDPALGGAPPVDPSSLAQIAAAQAQLDQWAAELNVSAPWAHPQAAKWDSQTFDDYLSQYANHADARFVLSTACNSLLSVEPKEISLLYVLAYIAAAGNETTIGTLDRLVAVKGGAQESRVVGGTGLIPQRLADKVGYNHIVLKAPVDRVVKTGKGYEVCSRAGTVNAKNVVLAMAPPLLRQINFQPALPSSRQKLNQQTKMGALGKGIPIYETPFWRKSENLSAQVQSDSGTVRVAFDSTPEDESFGAILGFLLADEMRALDKLSVADAQSKIVADYVRYYGKQAANFTEFVLQRWDLEEWSRGGPVAIAPPNVLTKYGSALRQNAGGLHFAGTETSEYWTGYMDGAIRSGERVAREIVGSS

SEQ ID NO: 4494 - protein, 684 aa, Unknown
  Kingdom: Fungi, Phylum: Ascomycota
MMLRPNAIALVSSFLLFQTSTAINACPVTDTVFTGTQGESQSVTPNVASTAACAQLCDKAINCFKAVYDTQTKDCHIKGTGDLDWQPNARFDVIQAEQINIARCPYSETTYTYDGKSFKVCPDTDLRGETVELIYRTTAENCAWRCSNRNNCMQAVFDSVLSACHIKADTKSNTLIWSTNKRFDVIRRVVDAKPAANGAWSDLVRLPVIPVAAYIVPEFPSSSRMMVFSSWGADAFGGASGRTQFADYNFNTGAVSARTVANTQHDMFCPGISALEDGRILIQGGSDAKKNSFYNPSTNTFTAAPDLIMARGYQTGTTLSDGRVFTIGGAYSGPRQGKDGEVYDPKSNSWKALPGAKNGPLLTTDHEGIWREDNHAWLFGWKNGSIFQAGPSKAMNWYSANGNGAQVAAGTRDTDDAMCGIWVMYEPGKILTAGGSPDYTDSDANNRAHIISIGEYGQTATVERVSDMEYARGFSNAVVLPDGTVLVTGGQPRSKVFTDDDGILQAELFNPATKSWKTLAAEAVPRNYHSVSILLPDGRVFSGGGGLCYTAKIGGSTVNCNKLVDHADGQTFSPPYLFNEDGSAAARPAISALSSTSVKVGGQLKITTSTANPKFVLIRIGSVTHSVNSDQRRVPLTSVTRTGTQYTATLPNDSGILIPGHYYLFTLNAAGVPSIARTVKVTLS

SEQ ID NO: 4495 - protein, 398 aa, Unknown
  Kingdom: Fungi, Phylum: Ascomycota
MHFSTITALSAATLVSGAALKRQHLEDASNSIPSTQLLPALPLEEFAKTAGHMLTLEEALAGLNITDKMHEIGDKLGDGLKDGLNGLEGLFHPEEADTANTASTNEGESKVSTMSVNAAAATCSTVRVRTEWDSTSTAERQNFVDSLKCLMAKPPSGQFSASKSRYEDFTALHQTLTPRVHSNSKFLLWHRYLLWTWEQELREQCGLTGTLPWFDETKYAGKFGQSSIFSSQWFGGIGLGGACVTDGQFANLAINVGPGSGNQPHCLARNGDAAKTINTGQSMVDACNSRQTFADMAGCAEGGAHAWGHNGVGAVMQDVYASPADPVFWLHHGFIDRNFRIWQNQNAGVRTTTIDGTDIDGNALTLDTTINVYSFKPDVKIRDVLDTTGSTLCYKYNY

SEQ ID NO: 4496 - protein, 849 aa, Unknown
  Kingdom: Fungi, Phylum: Ascomycota
MRPHAEVRGRERVSLNDEWRFQRFVDNPDGLSYDLLKPWILPAANDYLVGKKYDRPSEPGPGSNVTYVQPSFDDAAWEAVNLPHDWAAGGAFDFSEDVSGGTGRLPFTGIGWYRKSLTIDASVVSSGKSVFLDIDGAMAYATAWLNGQLVGGWPYPYNSFRLDLTPYAKVGENTLAIRVDNVPESARWYPGAGIYRNTWLVTANPVHVGYHGSYITTPSVSTEQASISLKIEVDNKGNASQTVQVATEIFVLDSTSRKASGDAVAKIAASTVTVSGSSKQSVNGSTTVTSPKLWGPAPKQTPNEYVAVTTISSNGTTLDTYETPFGIRTVEYDPDQGILINGEHIPVYGTCNHHDLGSLGAAFNFRAAERQIQVLQEMGNNALRTSHNPPAPEWLELADRMGLMVMDEIFDTWNYAKVENDFHLLFPEWSEADLRTFIRRDRNHPSIISWSIGNELAEQSNSTGTATAKRLQDIVHEEDPTKQVTVGMNNAGPNTGLAAEIDVIGLNYQGEGKGNAPSGSFAAFHSKFPNKMIWSTESASTISSRGTYLFPVTSNKSAIVGGAPGEGGDPVNNFISSYELYAPEWAASPDKVFEQQDRNPYVAGEFVWTGWDYIGEPTPYDNSSRSSYFGIIDLAGFKKDRFYLYQARWRPDLAMAHILPHWSWPDREGLVTPVHVFTSGDEAELFINGRSAGRQKRGQYDYRLRWDNVTYTPGEISVKAWKNGEEWATASHRTVGAATALNVTADRTTINGDGKDLSFVSCAVIDAKGDTVPYADNEITFSVVSGPGQIVTTDNGDPRDGTPFPSKKRKAFSGLALAIIKAQAGATGEIIIEAKADGLTVGQVVITAA

SEQ ID NO: 4497 - protein, 614 aa, Unknown
  Kingdom: Fungi, Phylum: Ascomycota
MQIKSAFVAAAILAFCDALATPLSARSPYVVKETHYVPKEWQKQDRAHGGKTISLQIGLKQGRFEELDRHLHEVSDPDHARYGQHLTADEVDELVRPSSETHDLVHDWLQENGIELESLSYSTAKDWIVVHLPIEQVEKLIDTEYHNYKHHDGSVVARATSWSLPRHLHDHIDTIQPTTSFFRAEKNIATYLEGGAEIPQGYKAPSNQTIAAVCNATSVTPQCFETLYETKGYKPKACDKNNVAFNNFLGEIPIRPDGKLFLQKYRPEYVAQAADFKQISIDNGPVQDGPLSANQSAEGISREANLDFQAIAGIDYGTPIISYSTGGSPPFIPDITTPTNTNEPYLVWVNYLLSQKDLPKIVSTSYGDSEQTVPRSYAERVCKQFAQAGARGTTLFFSSGDSGLGGTDKCYTNDGKNTYQFNPNFPASCPYVTAVGATMNFAPEEAVYRPSRNTSAGYRDFYAGGSGFSNYFDRPTWQGNAVPQYIKHLDGLYDGLYNKKGRAYPDLAAQGLYFAYFWNGTEGTISGTSASTPLTAGIFSLVNDALIASGKPALGYINPWLYKKGYKGLNDILKGTSHGCNVDGFPVTEGWDPVTGWGTPNFPKLLKAVGVKDH

SEQ ID NO: 4498 - protein, 423 aa, Unknown
  Kingdom: Fungi, Phylum: Ascomycota
MRTTTVLTALLPAALSSVIPATEEVSPALSFDKRQDAVFAGLGGKILQADVYAGIAGINQQIYQATQQSSQWKTCNPLNIIVRREWSAFSTAEKKDYIKAVQCMAKLPPKFPKSVCPGCQNRFDDFVATHIRQTFSIHNTGNFLPWHRFFTYAYEKTLRDECGYKGYQPYYNWPKWSDDPTKSPLLDGSETSLGGNGVLGCTNQTSYGIPTNAAPLINIPHGSGGGCIASGPMKNWPVNLGPVFTDLTCTPNNPIFDYTDPTTAGQVGLGYNPRCLKRDISAWTSSQWTNDEMVTKLLNSKDMKTFWYDMQGGENPFSNNFMGVHTAGHFTVGGDPGSDFLTSPGDPYFYAHHAQIDRVWWTWQNLNPSERTKAIYGTTVLADPTAPNTTLADSMTLEYAFAGNITVGDAMSTMGGPFCYTYI

SEQ ID NO: 4499 - protein, 629 aa, Unknown
  Kingdom: Fungi, Phylum: Ascomycota
MKFSTVGAVLLPFVASTARAVELDPNDEASVKAAARTYAYGLMELYKNNATGTAEQDIGIWPQPHYWWEGGAAWGGMIEYSMFSGDDSHVKTLQQALTANYGPNNDFILSYRKSQTGNDDQLFWALAVMSALEYQFPHSESAPADYLQVAVNAFNNVVGRWDTTTCDGGLKWQIYPENAYGYNYKNSISNGCAFALGARLARYTGNTTYSDWSEKIYDWTKSVGLISDKFEVFDGVDDKTNCAAVADKTQWTYNNAMFLHGSAFMYDITNGASVWKDRVSGFLSHAELLFFSPADKDNIMYEWACETGESGRKCNLDQQSFKAYLSRFMAQTAAVAPFTKETITKYLTASAVGAAKSCSGGDDKATCGSKWYTGSWDGTSGVGQQLSALEVTKSLLSLMQNIVPVKQGASEPKPTSTMATKPSSTPAAKPTSAPVSKPAESSKVVEAPSSSEAAPIVSSAYAPAPQSSEAAPVISAAPSTKLAHVPTPLDTTCSTKSTPVAIVSTQKPVVSSAVAASSCLSSTTITVTISRPTAGVNTTCTPSTTKTVYVPPVTSAPEVPSIVTSAPAAPPVLTTLAPVAPPANVSVPANGSVPSSTAPIEFQGVASSSKVLGGSVVGAIVVAIVAGLL

SEQ ID NO: 4500 - protein, 587 aa, Unknown
  Kingdom: Fungi, Phylum: Ascomycota
MLFTSILRALPAALLFSGTQATPLDLESRQASIDAFITAQTTVSINGVLANIGGGSKAPGVPAGIVVASPSRSNPDYWYTWTRDAALTYKALIERLVHGDTSLRQKVDDYVSSQAKLQGVTNPSGGPTTGGLGEPKFNVDMTQFTGAWGRPQRDGPPLRATALSIYANWLADNGNKTYAVNTVWPVIAKDLAYAVQYWNQTGFDLWEEVNGSSFFTLAATHRALAEGAALATKLGQTCTGCASAAPQVLCFAQSFWTGSYIDSNINVNDGRTGKDANSLISSIHTFDPNSKCTDATFQPCSSRALANHKAVTDSFRSVYAINKGIAQGKAVAVGRYSEDVYYNGNPWYLTTLAAAEQLYSALYQWDKIGSITVDSVSLAFFKDLVPSVTAGTYAKGSTTYTSITSAVKTYADGYLAIIQKYTPSNGGLAEQFDKSTGAPLSAVDLTWSYAAFLTATERRAGIVSPSWGETSNNVPPTSCTGTPACNAKITFNVRATTSYGDNIFVTGQLTQLGNWDPNSAKALSASKYTSSDPLWTATIDLPASTVFEYKYIRKSSAGAVVWESDPNRRYTTSTGCGSSATVNDTWR

SEQ ID NO: 4501 - protein, 418 aa, Unknown
  Kingdom: Fungi, Phylum: Ascomycota
MRFTSPLALSLLAGTLSHALPAPQDGPTATTDAAPSSVTFASASTDTAVAADQLDQLASFAQEQVNATLSENNKKRGGCNLSNVAVRREWNALSKTERKAYISAVQCLQKKQTKTPASLIPGARSRFDDWVGTHINQTMTIHYTGTFLGWHRYFTWQYEQALRNECGYTGYQPYWNWAKTANSGLENSPMLDGSDTSMSGNGEFIPGRGSVNLGGNGLPDILIPAGSGGGCVTSGPFKDMKVNLGPAALQLNNGSTISNGDGLSYNPRCLKRDLTDYANKKWANATAIVSLILQNKDIDSFQMTMQGIPGSGNIGVHGGGHYSMGGDPGRDLFVSPGDPLFYLHHGMIDRTWWIWQNLNAKTAFGEDGISGTGTFLNNPPSANTTLDTPIDLGYAAGPPVTMSDLMSTTEGPMCYIYL

SEQ ID NO: 4502 - protein, 1058 aa, Unknown
  Kingdom: Fungi, Phylum: Ascomycota
MRSSLSTIAAVAAGLLASTVSAQGQVAIYWGQGAYQRELSVVCEDPSVDIVNIAFVNGFPTSRDKYPDTNFGNACGGYTFPNPDGTPSKFLGDCPIINRGIKTCKANGKKVLLSLGGGYPTNYYLANKGAALWLARVLIEGFGPKVEGSVMPRPFGDDVAVDGFDLDIESSTAVGDQKFQYYGDFVKIVKQLAPNMLISSAPQCVVPDAHLDQAIAEAPFDYVFVQFYNTDACSAAQGLKQLSDKTATGFTWDDWSKKLLASANPKAKLFLGLPAGTNGANPNHYLSQTGANALIKSIKNTPNFGGVMLWEATVSQNNTRFDQPYSQWIKYSIEGTFEQNYHPVVSSTIRSSSTLVSSTRSSTPVITPSSTPASSKPTSSKASSTPYSTSSKVSSSSSVKSSSSTVKTSSSTIKTSSSTVKTSSSTIKPSSSTVKTSSTPLVTSSTVYPTSSSATVESSIHYSDYFSTASIPHVESSLSYSDYFSTVIPSSYSASSTVEPSTVYPDDVSSTVASSSSAYVTSSASSVYVTSSVEVSSSASSSVSSYHETSSVEVSTSSVYETSSVPEVTSSASSYYETSSSASSVYETSSVPEVTSSASEYSSASSSYGTSSIPEVTSSASESSSIYSASSSKSEYETSSTTLAGASSTPCTTSTASSKTPEASSSASEYSYYSESSKTPEASSSYPVTESTKTPEASTGYYSASSTDASSTPCTTSTELYPTSSKTPEASSATDYSYSSESSKVPEVSSKASEYPSSYPTVSTKTPEVSSSVSYEIYSSSAPTSSAKSTEYIIVSPTPIESTKTPEASSASEYDVYSTATPTVTKPAESTTTVVTTTYLDTCSTGLTTKTTVITKTVCTACAKPSDKPDYPEDWTTSVYVSKTLTVTITKPIHPATDVPAYPTVGVSSAAPKPSAPAVEYPVGKEEVPSYETPAKSSSVPSYPEVPVASHKASSSAPAVYPTASVPATLSQYVTLTKVATPVAYTPVAYATPIVHQGYPAGNGTAPAGTGAVKPSATGSYPVKPSSSSYSPPEFTGAASKMSIGMTGFVAIVAFFML

SEQ ID NO: 4503 - protein, 405 aa, Unknown
  Kingdom: Fungi, Phylum: Ascomycota
MPHVRSQEYPKASKEYELQYVEVIHRHHKRTPYASNTFPKESYGWSCDDQGLFYYGTPLNPAGNESSSTYWSVYTSDINPFAQTGFNGSCQFPQITRGGLDDSWQHGKDLYGVYHDLLGFLPKNLNGKITYRVTNNQITSQVAGMLIDGMYAPKRDVSLRIQPTGVDSLEPQYSCPAASSRYSSYGVGSKASNWTAHLSAAKPLFDSLDAISGIASDSTDWHKSFDHYYDNLSARQCHAKPLPCNINNTKSCVTQEQADTVYRLGQYEYSFIYRDSPQSLQAAVGSYGVWLAELAQNIRDTVAGKSDIIYRHNVAHDGSVSRLLSILQVEQMVWVGMGAEVVFEVYISKKAEGKKYLRVLWGGQVLKSSSPTLGKIDMLDLDVFLAYIDGLVGKKAEKVVEFCSS

SEQ ID NO: 4504 - protein, 233 aa, Unknown
  Kingdom: Fungi, Phylum: Ascomycota
MALPEYKKNFLETCVSAGALKFGTFTLKSKRVSPYFFNAGLFHRADLLRSMSLAYAQSMKAHGDADSSFDFDVLFGPAYKGIPLAATTIDKLADLDTAKYGKKSYSFNRKEAKTHGEGGNIVGASLKGQKIVIIDDVITAGTAIREAIDIIKREGGELVGIIVALDRQEKTPTENDDDGKPGPSAIGEVRKQYGIPVLSILTLDDIVEFLRSQGSEDDIRRLDEYRAKYKASD

SEQ ID NO: 4505 - protein, 557 aa, Unknown
  Kingdom: Fungi, Phylum: Ascomycota
MPGFAQASDLNAWSSLQDHHQKLGKDIVLKEYFKNDPQRFEKFSHVFKNDAENSEILFDFSKNFITEETVKLLVELAKEAGLEQLRDDMFAGKKINFTEDRAVYHVALRNTSNEKMEVDGKSVVEGVNEVLDHIKEFTEQVRSGEWKGYTGKKIDTIINIGIGGSDLGPVMVTEALKPYADRNLKTHFVSNIDGTHIAEALRESNRETTLFLIASKTFTTAETTTNANTAKSWFLEEAKEEDIAKHFVALSTNEEEVTKFGIDKRNMFGFSDWVGGRYSVWSAIGTSVALYIGYDNFHKFLEGAHAMDQHFRNTPLEKNIPVLGGLLSVWYSDFFGAQTHLVSPFDQYLHRFPAYLQQLSMESNGKAITRSGDYVKYTTGPILFGEPATNAQHSFYQLLHQGTKLIPTDFILAANSHNPVQNNKHQKMLASNFFAQAEALMVGKTPDQVKAEGAPDNLVSHKTFLGNRPTTSILADKITPATLGALIVYYEHLTFTEGAIWNINSFDQWGVELGKSLAKKIQAELDDKEESKSHDASTSGLINAFKAKLQPAKDVKL

SEQ ID NO: 4506 - protein, 774 aa, Unknown
  Kingdom: Fungi, Phylum: Ascomycota
MRASTLGFWACIWTSALTTSTDGLYNLIERRLPSHRGQIEFRLEETNNSTAAQNDNYAISRASNGSILVSGSSLSALNAGVRRYLYDEAHVDIYWFVGSRLNEAASSLPKTNGTIAGRSIVPWRYFFNTVTFSYTSPFWSWEDWELELDWLALHGVNLPLAWVGYERILLDVFREIGLTDDEILPFFSGPAFQSWNRFGNIQGSWGGELPLAWIDSQFELQKQILKRMLELGMTPILPAFTGFVPRSLTNTYPNATVVNGSQWEDFPPKYTNTTFLEPSDPLFNKLQNQVISKQIEYYGNITQFYTLDQYNENDPYSGDLDYLRNITQGTWQSLKAANSAAIWVMQGWLFYSNSDFWTNERIEAYLSGVEEDSDMLILDLFSESQPQWQRTNSYYGKPWIWNELHDYGGNQGLYGQIDNVTINPIEALANSSSLVGFGLTPEGQEGNEIMYSLLLDQAWSPVPIDTAQYFHDWVTTRYSHATNCSSTLPPGLYKAWELLRMSAYNNTHLTSNAVPKSIFELAPNITGLVNRTGHHPTTLNYNTTLVVEAWQSLLSAADEQDALWTHPAYQHDLVDVMRQVFANTFLSDYEQLLAAWNTTNPTNASTALVATLSTRLLENLDALDALLTTLPQFRLDTWLSSARARATDSPNSSAATNGTVNTTALADFYAYTALNQVTLWGPDGEINDYASKQWGGLVGPYYGARWGVFLRYLQGVTPGTYNSTLAREGVRAVEAAFQTAGLLESGTRLSRVGASVREVVEGTGVPFLRCNGAV

SEQ ID NO: 4507 - protein, 592 aa, Unknown
  Kingdom: Fungi, Phylum: Ascomycota
MMFLKAIVVFLLQVTALVHAADTAAWKSRSIYFVLTDRIARSSSDTGGTACGNLGKYCGGTFKGLESKLDYIKNLGFDAIWITPVVANSADGYHGYWAQDLYAINSNYGSADDLKSLVSTAHSKGVYIMVDVVANHMGFANIADNSPAPLNQASSYHTACDIDYSNQTSIENCRIANLPDVYTQKSEIRSLYNTWVSWLVKEYSFDGVRIDTVKHVEKDFWPGFSNAIGAYSIGEVFDGDPAYLAGYANLMPGLLNYAVYYPMNNFYQQKGSSQALVDMINTVSSSFPDPAALGTFLDNHDNPRWLNQKNDQTLLKNALAFVILSRGIPILYYGTEQGYAGGADPANREDLWRSSFNTNTNLYQSIAKLTAARKAAGGLAGNDHTHLYVADTAYAWSRAGGNLIVLTTNAGSSSNAQHCFNTQKANGRWTNVYGNGATVTSDGNGQACVNVANGEPIVLLASTGATTTATPTTLQTSSTLVRSTIGTACPTAVSVSFTERVVTVPGDTIKIAGNNVQLGNWNPSSAPALSASQYTSSNPVWNITLKMTPGQAVTYKFVKVSSSGTLTWESDPNRSYTVPSCQASASVSTSWR

SEQ ID NO: 4508 - protein, 644 aa, Unknown
  Kingdom: Fungi, Phylum: Ascomycota
MHWSIAVLSYVLGSALAQNSSSGYNTTAPNLGPDVLTADMISSMGNNTLFNRWRPTYHFISPAGWMNDPCGMMYDPTTETYHLQYQFHPNHVNWGNISWGHATSKDLVTWTDVGGWENAQAQSVGTGPDPTSRNSSYYGLGIFSGTAQPYNLTGGQDGTLIAFYTAVQYLPTNWAIPYINGTEKQAIVMSHDGGETWEQYEGNPIISEHPEGWNVTGWRDPFVEPWPEMDAILGQEEPHWYMVLGSGIKGENGGGRIPFYSAPQSNLTDWTFLGALWEPKPNQTLGSLLETGTYGFNFEVSNFFSLPDEDNDVHYYVLMGTEGGNLTWHPRAQWGLWNEGQVNRRENGSAEFTPVSGGVIDSGLLYAVTSFNDTKNNRRVQWGWANEENNGFGILQNGYQGAMALPREMYVIKTRDLVNVDGGLTTKGNTRVTEHANGTFTGYTLGARPLPDVVEALRGEERTINAISNWTESMQIGEGSAHMELAVTLSNCTGPAGVTIAASSNGEEYTHIYYDPSNYTVNVDRSHSSTIDEYANYTMIGYFYPYTFSNGTTESLNMDIFIDGSLVEVYINDRFWMTTRIYPARLDSVNYGIYVGDNSSVQVSNLKTWEISENVFPERPLNSSSELVFDTPEETNNYVWWPGY

SEQ ID NO: 4509 - protein, 260 aa, Unknown
  Kingdom: Fungi, Phylum: Ascomycota
MLLHAFTLASFAALAVSSPVAVSPIGNSVDLAPRQAATLCDQYGYYAANGYEFNNNNWGKGSASSGSQCTTVRSTSGSGVSWSTTWNWAGGQDNVKSYANAGKQFARGLKMNNIKSMPTSITWDYSNRNIRANVAYDVFTAADPNHDKSSGDYELMVWLARIGGVYPIGSKVTTVNLAGFNWDLYIGPNGSMKVFSFIPADGSWKFTFNADLKVFFNYLAQSQGYPISNQNLIVFQQGTEPFTGAQTTYTVSSYSASVNV

SEQ ID NO: 4510 - protein, 138 aa, Unknown
  Kingdom: Fungi, Phylum: Ascomycota
MKFSASALALGLASLTSAISVSYDSGYDDGSRSLNALSCSDGANGLVTRFGWNTQANVPSFPRIGGYQGIAGWNSPQCGTCYGVTYNGKTIYVLAVDHTATGFNLAKAAMDELTNGQAAALGRIDAQYAQVATSNCGF

SEQ ID NO: 4511 - protein, 302 aa, Unknown
  Kingdom: Fungi, Phylum: Ascomycota
MRCTLLVAAALPLAQGIRIIQGNDDGWAEANARALFKVLTSAGNQVVLSGPAENQSGTGSSDAAPKTVDSDGCQFSSCAPGSPATGANATDPRLNYVNSYPVTAIKTGISTTAPKLWNGAAPELAVTGPNVGSNVAVVVPFSGTVGAAVYSAKTAKIPAIAFSGASGDPTAWNQPTPLYSQIYADLALNVTNTIINSGKPYLPDNTWLNVNFPAVSSTRCNNINQFKFIFTRINSGFIGSAPDIAVCGTSPRLPWEADVIVLRGNDCYVSISPGDANDKTTVAAAQQQVIYNKLKPILSCLP

SEQ ID NO: 4512 - protein, 223 aa, Unknown
  Kingdom: Fungi, Phylum: Ascomycota
MKFAAIAILSIAAGAFAQIDPEHCGPQYGNVVCKDNNCCSQYGWCGSTKDHCDASTCLKSFSAPGSSCAPKASTTLKTTTKASAPTSPAQTFPASVPVIDVCGHAQGGVTCPGAGANGYFYRCCSSAGHCGPKNDIQDQALYCGDGCQAGFGKCDSQKAPTEPTVARGADAGEGETCGPIVNKKCQAGLCCSGSNFCGTGEDFCGAANWCQKNWSGSANLCKA

SEQ ID NO: 4513 - protein, 128 aa, Unknown
  Kingdom: Fungi, Phylum: Ascomycota
MQIFVKTLTGKTITLEVESSDTIDNVKSKIQDKEGIPPDQQRLIFAGKQLEDGRTLSDYNIQKESTLHLVLRLRGGIIEPSLKALASKYNCDKMICRKCYARLPPRAVNCRKKKCGHTNQLRPKKKLK

SEQ ID NO: 4514 - protein, 456 aa, Unknown
  Kingdom: Fungi, Phylum: Ascomycota
MKSVAIAAVAGALATSVAGSATPVQKRADVTTITVKGNAFWKGNERFYIRGVDYQPGGASDAKDPIADEAGCKRDVAKFKELGINTVRVYTVDNTAEHDTCMNLLADAGIYLALDVNTPKYSLNRASPQISYNKDYLQSVFATVEKFAAYPNTLLFFSGNEVINDDKTTNCAPFVKAVTRDIKSYMNARKLRKVPVGYSAADVESNRYEMADYMNCGADSVRSDFYAFNDYSWCDPNTFTGSGWDQKVEKLSNYSLPIFLSEFGCNTNKREFNEVKSIYSTDMSSVYSGGLVYEYSQEDSKYGLVEISGDSVKELDDFTTLKNAYANATDPSGDGGYKSSGSASACPSSSDSWNVTMSDDKLPAFPSGANDFLKNGAGDGPGLKGSGSQSAGSAETEVADAGAGAVTSGAGAGSTASSSPSTGAASALRPGEFSLAPLAMGAVVLVSSLFGGLLVL

SEQ ID NO: 4515 - protein, 366 aa, Unknown
  Kingdom: Fungi, Phylum: Ascomycota
MVAIKAGLLLSAGALVSAVPTGLDARASCTFSDAAAAAKGKTSCTNIVLNNIAVPAGTTLDLTKLKDGTTVTFQGTTSFGYKEWSGPLISVSGTKITVKGASGHVIDGNGAKWWDGKGTNGGKTKPKFFYAHSMKQSTISNLNVKNTPVQGFSINGATDLVLDHITIDNSAGDKTNGGHNTDAFDVGSSTGITISNANIKNQDDCLAINSGTNIHFTGGTCSGGHGLSIGSVGGRSDNTVKNVVIEKSKILNSDNGVRIKTVSGATGSVSNITYKDITLSNIAKYGIVIQQDYENGSPTGKPTTGVPITNLQVSGVTGSVASKGINTYILCGKGSCSNWKWSGNKVTGGSKKATCSNIPSGSGASC

SEQ ID NO: 4516 - protein, 813 aa, Unknown
  Kingdom: Fungi, Phylum: Ascomycota
MRTSIFALGALAGLASANINFSWVNPTCDVNSPNRCLTGQHCDGSNCVADIKSDHSKVSSSHLRVVPEKRQAKYSQDGQCGPANGNLLCDPNSKVYSGTCCSQYGWCGSTEGHCGTGCLSGCDNKPAEPVPTKAAAVPARDDGRCGKDFGGATCDPNGAYGGCCSSYGYCGSTDGHCLVANGCQNGCKDATTTKAAATTADVSRPPSTTTSGEPVLGKPTHIDDPTPAAPTGVQTTDGSCGATFGDAICGTWAQGSCCSMYGYCGNTTAHCGEGCQSGPCVNAPAIPAPKASPAPAAAKPGSIQIKGRSGVPAMHAGLMPNGKVVFLDKVENYTELKLPNGQYAYSSEYDPNTQKLTPLSYKTNAFCSGGIFLADGRFASLGGNAPLDFIDPTVGDGFKGIRFLKRSATDASLDGKAWDEPGTQLDTARWYASVQIMPNNQIFVASGSLNGLDPTKPENNNPTYEILNADGTPQGKSIHMEILDKNQPYYMYPFLHLMKDGNLFVQVSKSAEIFNVGTGNVVRTLPDLPGTYRTYPNTGGSVMMPLSSANQWNPDVIICGGGPYQDITAPADPSCGRMKPLDANPTWELDSMPEGRGMVEGTLLADGTIAWVNGAREGAQGFGVAQDPALEVLLYDPNQPKGKRFTTGPKSTIARLYHSVALLLLDGTLLISGSNPVEQPILQPTAKDPYVTEFRNEIYTPPYLQGNPTRPSNVQISTKSLKANGSTFTIKFTAPANAKAVKVNLYYGGFVTHSVHMGHRMLFLDNTGFKAGASAQTITVTMPPNRNIAPAGPYVIYVLVDGVPAMGQFVDVA

SEQ ID NO: 4517 - protein, 243 aa, Unknown
  Kingdom: Fungi, Phylum: Ascomycota
  misc_feature (226)..(227): Xaa can be any naturally occurring amino acid
MRFSTVAATALAASPAIVAAAKGTAGFALGTKEPSGACKTVKDYELDFDAIKSNSGATIVRGYSASDCDSAKSILPAAKSKGFKVVLGIWPDVEDSFQKDLKAITDVAETYADSIYAVTVGSETLYRGNFTGSELKEKISTVKSKLPSGIKVGTADSWNKFADGTGDAIIGTADIIMVNAFAFWQGASRDNATHVVMDDMYQAITHIEKIAGGVDKAPEVWTGETXXDGRLLRALTTTRPRVD

SEQ ID NO: 4518 - protein, 513 aa, Unknown
  Kingdom: Fungi, Phylum: Ascomycota
MFTRLFASSAVAAWTIASVLPGGSCGPTSPPDIFSRTPATGFDVKPLAAQLSRGAQIYYPGSDSFTNLTVRWSNLSPPTPNLVIAPGTEQDVSKIVKFASKRDIPVLAYNGHHGTLTSLGKMEYGIQIYMPQLNSISVNKKKSTVTIGGGTNSKKLQEALWAAGKQTVTGTCECVSYLGPALGGGHGWLQGHHGLISDQFLSMNVVLANGDLKTIDAKSDLWWAMQGAGHNFGIVTSVTSKAYDIENTDWAIETIVLKGDDVEAIYKAANEVFINNGNQSAKIHNWSYWQNDASLDAEKPVIIMYIIQEGVKSVDARYTKAFHDIGPLKSTPQFGTYHDLAAWTGIALESPPCQDFGFNNPRFPIYTKGYNTTAQKKAYELYASAVGGPNSPYTNSIFMFEDYAGEGVRARSAGASAFAFRDAHILAAPLIIYAPTDKAQDDTVKQLGNQLREVIREGTGSEELHTYVNYAYGDEGTKSWFGYETWRQDRLKTLKKKYDPQGRFSFYAPIASS

SEQ ID NO: 4519 - protein, 310 aa, Unknown
  Kingdom: Fungi, Phylum: Ascomycota
MKATFASVLALATAASAQVKGFNYGATNNDGSCRGYSDFVRYFNDAKSLPGASGFQTARLYTSIQCGTAAAPIEAFRAAIDTDTKILVGLWASAGRAVYENELNALLTAARTLGTPFTDRIVGISVGSEDLYRSSPDGVANNAGVGATGAEIEGYIGWMRDWIRGTALEYKPIGHVDTWTAWIRPENRGVANSVNWLGHNSFPYFEGTKPNNIDLAAQNFNSAVAQTESVAGGKEVWITETGWPRVGPTSRDAVASTENSQRYWKEVGCSLFGKRNTFWYTLKDANTAQTDLSFAVTPLENNTPYFDLTC

SEQ ID NO: 4520 - protein, 355 aa, Unknown
  Kingdom: Fungi, Phylum: Ascomycota
MNHIQVVGTHNSYHREVSLAERAVFEKYVPSPEDYYYSHPTLPNQLEHQAVRSFELDLHSDEKGGLYYPPLIWTLSNLTNSTTPFDGSVLQKPGIKVFHVTDFDPDSVCHTFVDCLKQLKTWSDANKNHVPVIIDLEIKTDAPACVLGGVCPGEATNWTLPRLLNVDAEILSVFPKKQLIRPDDVRQGNLTLEQSVLQKGWPLLKDARGRFMFFFDNDPKPSDPNSPRELYRSDGHESLQNRTVFTNSVEGSSDAAVIKYNEPRGNNTAEIQRLVKKGYIVRTRSDVPLDTVLNKTTEMRDSAFASGAHIVSTDFPSWGMTARWGWDFVVQLKDGRVARCNPINAPKGCKDSKLE

SEQ ID NO: 4521 - protein, 532 aa, Unknown
  Kingdom: Fungi, Phylum: Ascomycota
MRGLIAATALLAGVHAAVDPIVIKGSKFFFKSNGTQFFMKGVAYQQEVNSNTTASDADELNITDPLADSTSCKRDIEYLKKLQTNTIRVYAIDPEKDHKECMNALADAGIYVVADLSEPGNSINRDDAEWTTTLYARYTSVIDELMKYDNTLGFFAGNEVSNQPNNTLASAFVKAAVRDSKAYIKSKNYREVGVGYATNDDADIRENLANYFDCGNSEDAIDFWGYNIYSWCGDSSFEKSGFDVRTKEFEKYNVPVFFAEYGCNTPRPRLFTEVGTLYSDKMTDVWSGGIVYMYFEEANEYGLATISNGKVSTNKDFENLSKQIAKATPTGVKMSEYNPTNTAAASCPSVKAGSWEAESDPLPPAANADLCSCMMDTLSCAVADKATEDDYGDMFGYVCGLKDGEYCAGINRNVTTGPYGAYGMCSAKEQLSFALNAYAKAVSGGCSFKGKATTKTAVPTPTASGCASLLKEAGAAGTGTVSSGATTGSGSGSGSSNSSTGAASGLVVPGVGMGLSMYIFGAVASGMAMIFL

SEQ ID NO: 4522 - protein, 531 aa, Unknown
  Kingdom: Fungi, Phylum: Ascomycota
MQPLLLTAAVATLLGSVIASPSSSVRVQTSTGGVIVGHGASNKPSVTEFLGIRYAESPVGDLRFAAPKKYVAPEGTVFQASEWSADCPSNKPPVSAFPNFTEPSGLRVWKNFAAQNSNPVSEDCLKLNVWTKNASNTKAKKPVLVFLHGGRFQIPGPHSPLYNGQYLADSQDVVVVTPNYRLGVFGFSGAPGVEANAALKDHRAAVEWVRDNIAAFGGDPSRIVIFGQSAGGASVDYWSFAWKKDPIVAGLIPMSGTSLSFLPNTPDYAQTLWYNVSQTVGCGGPGDAAASVLSCVRSKDTSVLLAAAARVPALPTQALAQATFHPTVDNITVFADYQQLAASGDFAKIPLLAGNTDQEDGWYRISGWAARLGFTNAQWNLFAERGFTCPVALTTKYRVQYGVPTWRYRYFGDFDNLRLYNSTAGLSLRGSAAYHGVDLNIVFGTAADNSGLANTVAEDATIKYVQGAYAAFARDSKKGLTQYGWPAYKETGKTLVGLAYNNSPKPTFFEATTYDKACPAKNDPLPGRGAF

SEQ ID NO: 4523 - protein, 130 aa, Unknown
  Kingdom: Fungi, Phylum: Ascomycota
MFANSIITILTLAVAVTATLDPAISNTKGKYPARPGCAVTKTSRAIQAAECSHNTRVAGKQTFAVFTQDHQYDGIHGYPYGTCEAYMCAPGTEMRSNGDKWTFFWSNVGEKSGEGAGCVKSPNDDAGSQA

SEQ ID NO: 4524 - protein, 141 aa, Unknown
  Kingdom: Fungi, Phylum: Ascomycota
MKFLSILALIAPVAFALPTSVVTEAPVEDAALESRQSCFVRCGSTCYTSAQVTAARNSGYNYIRQGGTAGGSSYPHRYNNYEGFDFLVGGTYYEFPLRTGGVYTGGSPGADRVVFNGNGQRAGEITHTGASGNNFVACTGW

SEQ ID NO: 4525 - protein, 596 aa, Unknown
  Kingdom: Fungi, Phylum: Ascomycota
MAPVLSFLIGSLLAARGLAEPFEKLFAVPEGWKPAGPAAESQVLKLQIALQQGDVETFEQHVMEVSTPSNKKYGQHFESHEEMKRMLLPTEEASSSVASWLKAAGVEEFEQDADWVTFKTTVGVANKMLETEFAWYVSEEAKPRKILRALEYSVPEDIAAHINLVQPTTRFAAIRANHETEKEIFGLQRIEVAAGANVTVNCDAAITPQCLKQLYKIDYKADPKSGSKAAFASYLEEYARYSDMALFEQNILPEAIGQNFTVIQYSGGLNDQNSADDSGEANLDAQYMLGLAQPLPITEFSTGGRGPWVADLDQPDEADSANEPYLEFLQNVLKMSQKDLPQVISTSYGENEQSVPKSYALSVCNLFAQLSSRGVSVIFSSGDSGVGSACQSNDGKNTTMFQPQYPASCPWVTSVGSTRYLNETATYFSSGGFSNYWKRPSYQDDAIKAYFHILGEKNKPYFNRHGRGFPDVSAQGFGYRVYDKGVLKGYQGTSCSAPAFGGIVALLNDARLRAKKPSLGFLNPLLYSNPDALNDIVLGGSTGCDGHARFGGAPNGSPVIPYASWNATKGWDPVSGLGTPAFDKLLKAAVPSRYRA

SEQ ID NO: 4526 - protein, 614 aa, Unknown
  Kingdom: Fungi, Phylum: Ascomycota
MQIKSAFVAAAILAFCDALATPIRARSPYVVKETHYVPKEWEKQDRAHGGRTISLQIGLKQGRFEELDRHLNEVSDPDHARYGQHLSAEEVDELVRPSSQTHDLVHEWLQENGIEIENLRYSTAKDWIVVHLPIEQVEKLIDTEYHNYKHHDGSVVARATSWSLPRHLHDHIDTIQPTTSFFRAEKNIATYIDGGAEIPQGYQTPSNQTIAAVCNATSVTPQCFETLYGTKGYQPKALNKNSIAFNNFLGEIPIRPDGKLFLEKYRPESVAQAANFKQISIDNGPVQDGPLTANQTAEGISREANLDFQAIAGISYNTPIISYSTGGSPPFVPDVTTPTNTNEPYLVWVNYLLSQKDLPKIVSTSYGDSEQTVPRSYAERVCKQFAQAGARGTTLFFSSGDSGLGGTDKCYSNDGKNTYQFNPNFPASCPYVTAVGATMNFAPEEAVYRPGRNTSSGYRDFYAGGSGFSNYFDRPTWQGNAVPQYIKGLEGLYDGLYNKKGRAYPDLAAQGLYFAYFWNGTEGTISGTSASTPLLAGIFSLVNDALIASGKPTLGYINPWLYKKGYKGLRDILKGTSHGCNVDGFPVTEGWDPVTGWGVPDFSKLLKAAGAKVH

SEQ ID NO: 4527 - protein, 538 aa, Unknown
  Kingdom: Fungi, Phylum: Ascomycota
MSTPSMKYIVSLAALVAGAASQNTFEPTDFNITEALLDNGVDVSALPDLAPLADRALISGCSAACSSLKLIFGDDKVETQKETAFTSFLNTYWSNQQREITPQCVFKPGKALDVSTAILVARLTQCPFAAKSGGHSAVPGGSNADGGITISFEKLGKISLAADKQTVALQPGHTWYEVYSALEKDGVTVIGGRAGSVGVGGLTLGGGISYFSGQYGLACDNVFNYELVTASGLIINVSENSYPDLYWALRGGGNNFGIVTEFKVRAVPQGQMWGGRRIYLESAFPALIEAYYNLGMNAKKDNKAHQILSFTANGGMAIASLAVEYADPNPNATIFTEYNAIPGAILDETAVQSLAQRAKSLDETATLPGFRQAFWTLTVKLDKDLATTIKDIFFEERESIADAANLVAAISFQVITEPILKKTVVRGGNALGLSAADGPLTNLLIALIWSDKADDTRINQFAERVKNRGIAAAKAKGKDVSYLYMNYASPWQDPVASYGAANKARLQRVSKKYDPTGVFEKLQPGYFKLNGAPKSGSP

SEQ ID NO: 4528 - protein, 382 aa, Unknown
  Kingdom: Fungi, Phylum: Ascomycota
MRVLVVSTAFAASCNALSLRWFARAADPSHTALPLEHFNTPKWARPLTLEQAVSGMNASVTTIKPEDLEEAKIQVPTLVIPNNATLPNNTETVNQEISKSVKRQGLCSNVRTRVEWDSASNNDRQGYINAIKCLMTKPASGQFPTSRNRYDDLVGLHQTLTPNVHGNAKFLLWHRYYTWTFESLLRDECGLTGPLLWFDETRYAGNYPASSLFSSQWFGSVDIGGNCVTNGQFANLALVYGPGSSNQPHCLARNNDNSKTINTGNAIVDACNSRSDYADMAACAEGGAHAWGHNGIGAVMSDVYASPSDPVFFLHHAFIDRNFRIWQNNGGNARVSSIDGTDTSGNPLTLNTKVNVYGFRPDVTIGQILDTRGPTLCYKYNY

SEQ ID NO: 4529 - protein, 399 aa, Unknown
  Kingdom: Fungi, Phylum: Ascomycota
MKSASLLAAATAATASVLELPVRVQDTYSSVGFSVGTPPKPYWLLFDTGSSTAWITNTACTEASCPNPRPYSRTGYSANASSTSQDLHSFTRIPFIDGDGVAGAATLDVFSTPDSSFEWNQTFLSVNQSSWRWITADGFLGLGFSSIAENKTSSLVETLLWDGKLDEPRFGLFYGTDFANDADHNGVLTIGGSEEEKYVDGEVVYVPLRKEDPYQLWRAPLRSINILVAGQQNATVIMKTGSLPDTTDAEGVWPKYNTTWPTYGTAVFDTGAGRISLPTENIAAVYFNLGWNITKLMNGEERMDCQHLNASWALTFTLGESVDESDDISFSIRGDEFTEPGGECMPPFDDSQGYGFALIGATFLTRYYSVYDFGASKVEEYAPRIGFGRLKKEWDWLYQ

SEQ ID NO: 4530 - protein, 429 aa, Unknown
  Kingdom: Fungi, Phylum: Ascomycota
MSSFLKIALPALALTSSAFAQSSNSCSASATKTIESAGDATALSACSTYSGSIAVSTSATEDIALNGIKKITGDLVADGNANIRRLSADSLEELDGSMTLNGLTRLVGVDFPKLKKVETIKWSALPNLQTIGFTAEVTEADTVQIENTALRSLKGINIEKVDTLFIANNGQITEVNMQLGNVSDALTFANNNEALSITLPNLIWATNLTFRFVGSLEMPSLESTNGSLGLYNNGFSSFSAPNLTTIGEALAIVANDQVSNISFPMLTKINDNLQIANNTNLTDIDGFPLLKSIGGAFDISGNMSNVETPALESVKGTFNLQSTSNVTETCAFYEPLKKKDWIEGKFFCKGKLVDPGQQGSKPTEQGGSQTGAATSLSAVNGALGLAAMAAVFLLLITHDLASFDSVWHLPQALKFELNMMRTGAVEAKG

SEQ ID NO: 4531 - protein, 598 aa, Unknown
  Kingdom: Fungi, Phylum: Ascomycota
MHFSTLAAVAAIAPFVSAHGGMGLPKIAGINMRDLKSRDLLANLEARIAEVKTAHAHENRLAARQDDRQCGAGIGSCPAGQCCSGAGYCGTEDDYCYSPGCNYQYGPGCPENITPAGTNTSSIARTKVGSVQYGGAGIYNCVTPGTVALTYDDGPQKDYTTHVLDVFKTYNAKATFFISGNNINKGEIDTTPEFVSVIKRMESEGHHIASHTWTHLDLSAVSSIDRKNQMWKNEMALRNIIGKIPTYMRPPYSSCTAESGCEKDMADLGYHVTYFDVDTDDYNQDDVNKIQNSKNYFKGNITAGGASAASSEWLAIGHDIHYQTVYNLTDYMLSTLTGLGYKAVTVGECLGDPEANWYRAADGAAATQPATKTSSGAASTATNKVSTDGNCGSTAGSTCLGSTFGNCCSQYGYCGSTTDHCGTGCQSGFGNCGGNGAVSSKAAASTAKPVTSTVKTSAAATATTASKVSTDGTCAGTGKQTCQGSTFGNCCSQYNYCGSTSDHCGTGCQSGFGTCGSSSVSKAASPSTKATSTKATTTKAAATSAAAKKISTDGTCAGSSGFTCKGSSFGNCCSQYGWCGSTTGHCSSGCQSAFGTCS

SEQ ID NO: 4532 - protein, 165 aa, Unknown
  Kingdom: Fungi, Phylum: Ascomycota
MNARNGCESGGSAFMCTDQSPWAINDNLAYGFAAAKLNGMGESNWCCACYELTFTSGPVNGKKMVVQVTNTGGDLGDNHFDLQMPGGGVGIFNACTAQFNAPANGWGQRYGGISSRSECDSFPAKLKAGCYWRFDWFKNADNPNVSFKPVACPAALTNKTGCKRN

SEQ ID NO: 4533 - protein, 487 aa, Unknown
  Kingdom: Fungi, Phylum: Ascomycota
MHSLQLFLTFGSLLAGHVQAVAVDPVLSKRAESCSTLVAKYRNQTLLPSDPEYPAQREAHWSQTSYKSPDCIFFPKNSNDVVAVVKLLRKSNEKFAVRSGGHSPLPQWANVDNGVLISMRDITDLSYDSKHNQLRSGSGNKWGKIYEYLQPYNQLVVGGRSPTVGFGLLGGGGLSHLSNEYGFSTSNVVKFEVVLADGSKKTATEKSDPELFWALKGGGNNFGIITHVTFKTVPMGKVWGGTIIYSGDKRDALMAAFAEYQRVGQLDQKSAMLSYLAINNDTMFVNLAYTADVARPAAFAPFYNITPLADTTQSYDSFLALVSGGIELNVPRWTWGSTVFYLDRTAYVEVGKICQKATAKLAGINGGTMVLMPQPISKSMVAKSAARGGSSPLNVRNREQLWFAINMGWNFASDDAKVGSVLMETIAEIEAYTKSKNLYDDFVFLNDAYFTQQPFEGAVKSRLQSIAKKYDPQAFFQTRQPGGFKLA

SEQ ID NO: 4534 - protein, 578 aa, Unknown
  Kingdom: Fungi, Phylum: Ascomycota
MRTATSIAALALALLQGADAFNAAKSRDFNLLADMGLNPDGSHIETAIAANIARSLHIGTTVKDSSVGLTSRQAPETITEEYVSLKLDQFGKSKETFNNRFWVAESGYKPGGPVFIYDVGEADASGSWQFRLQNETSFFKQIVDQFGGVGIVWEHRFYGNSTPAPINLDTPAETFRYLTTEQSLADVVQFAKQFKRQNINATLTPDKTPWIFIGGSYPAMRAAFIRDKYPDTIYAGYASSAPVQASVDQSFYFEPVYRGLNRYGFGNCTQDIKAAIKYIDHTFDTDRSASAKLKEQFLGKGAASNSHATFADALTTIFYLWQSYGVDGGAGSLRNFCDWIETDPTTSTTAPAEGWAKAKGAKYIVDRWASWKTFTPIVNNYLETECSGNQNVTGTCDLNKRFSDPSSISWTWQYCTQWGYFQSANLGPNQIVSKYNSLTHQRDICHRQFPHAPRSLLPEWPNTDKTNAVFGGWDIRPSNVYWSGGEFDPWRTLSPLSAEPFAPRVRPFTNPPRCGSGSSRREVFGYTMADAQHCYDFRTYFAPGAVSRGFFTDALGQWLGCWKPRGGYGGGYERRWDA

SEQ ID NO: 4535 - protein, 506 aa, Unknown
  Kingdom: Fungi, Phylum: Ascomycota
MVLKSQLLLLLPAPALSAAVTNCTASALPTPSVLGAKILSLNAFESTLESSTISFCNLTLTYTHPGQNDLIKVWLGLPASWNGRFQGAGGGGWVTGFPSQMVLGIADGYATVATDGGHDGLTQMTDEWALLSPGNVNLYALQNFASVALNDMTVLGKQLTEAYYGKPISKSYWAGCSTGGRQGLMMAQRYPDAYDGILAQAPAVHWAELIPTMFWPQWFMKQIGYFPPQCELDAISAAAISACDELDGLKDGIVGLTGLCTFDPHTIVGQSYACGGIKGTISKEAAEIALATWKGARNAEGEEQWPGVTPGSPLGAVANTTCDSTGSNCTGLPFHVASEWHQIFLQKNTSFDPYSYTREGWDAAFHASVQQYTSIIGTSDPDLSEFKKRGGKMITSHGIADEAIPFNSTVNYYERVLALDSNVTDFYRFFGAPGVGHCGGNIGAQSTLADFMDPLVVWVEEGKAPETINAARAINGTNWEQDLCLWPSSSIYKGGDPALSSSYQCE

SEQ ID NO: 4536 - protein, 151 aa, Unknown; identical to SEQ ID NO: 4338
  Kingdom: Fungi, Phylum: Ascomycota

SEQ ID NO: 4537 - protein, 556 aa, Unknown
  Kingdom: Fungi, Phylum: Ascomycota
MQFRAVSLLLAVATAPASVLAAPPVGANSYGNSTTCRKTTVAVLGAGVAGITAAQALANQSITDFLIVEYNEQIGGRMRHANFGSDTAGNPYVVELGANWISGTGTPNGPENPVWTFAKQTNLSSTYSNLSNIATYDETGASDYLDLLDEYDEVAGAVEQAAGMILSENLQDRSQRAILSENGWKTKRDAHRKAVEWWMFDWDAAALPEESSAVFATTASNLTYYQFKDEDFLSIDQRGYNIWLKGEAAKFLQPNDTRLLLNTVVTAIEYSDSGVKVTNEDGSCIQADYAICTFALGVLQEEVVEFTPALPEWKESSIATFNMGTYTKIFMQFNETFWPADKEFFLYAHPTTRGYYPQFQSLSTEGFFPGSNILFATVVDEQSARIEAQDDDITKAEVMDVLRQMFPDVDIPEPIDFMYPRWGQNPWTYGSYSNWPAGTTLEMHQNLRANVERLYFAGEHTSAEYYGFLHGAWFEGQEAGQRIAGALGKDCLNEGGICGDYVRYEVLQGTTERAEYNASNGMGADPFFISEADESEIGTITRRSLKRSGHKRRHHK

SEQ ID NO: 4538 - protein, 2089 aa, Unknown
  Kingdom: Fungi, Phylum: Ascomycota
MGRFGVLTALLLSSTTAAKWIGETRTEDGVKYQCKCYDDNACWPTGAEWSSFNKTLGGTLQLAIPAAASCHYKFENYTFSTYDAAKCAEVTELIGNGFDKGDEQWMFVLPNTGTESLRKLWPFMSNNTCLPTTDPSTPCTRGFMGHYVVLATEKRHIKAGVDFAREHNLRLIIRNTGHDFMGRSTGYGALIINTHSFKDVKFIKKYTGPGQWRGTAVTVGAGIQGRELYRHAFAQTPKQVVVGGECPTVGWAGGYVQGGGHGPLSSIYGMGADNVLSFDAITAEGKYVTANAKENPDLYWALKGGGPGTFAVVTSVTVKTFPEVPTAGVEININSTHTNDTALFRKGVHIFNGQSNHLSNLGIFAYFEQGPGPGRLLVKPIVGPNMNLAQLKAAVAPLFAELDAAKVPYDTHFKAFPTFFEFYIDMFADEAPSPNAIVNGRLFTQRDIAERNEQVSDALIMASQNGINVGHIVNPGNGAPVVDNAIHPKWRNASTFVITNVLMSGTEPWNVKKERERYNTEVVGKALREAGPDGASYVNEGDLYEPDWQEAYWGENYPRLLKIRQKWDPKGVFYTQTTPGTEKWSVIDYGRKLYVCALPNHVAPRSARNRSPHRSAATCAPQAAVPIPDRSPASASTWDLAGPPGSRRADRCVAPTPQTLRRAHVDGMPPVLNPFLRAFFRSALPSQCTPAQHHVLLVPTTDVLVASRDKDSGTPYADLSGSEEFLASHVLRVPGGVGPNNQVRDASSFRETRGKAKQFTTANGRTVIVKDAFIYSNKGFKTLNQAQLLSDTIFYPDTFEAQPWLVYYISRPLIGTYEATPIIPATLVVRKHAQPTTAPPAAGSSSAAASSVMPRKKEVKSFGDLLNHFPMIARQMQPGLERLFKEFGKELEKPLPPTPSTRSRRSSQSSRRRGSVSSVETAGSRPLSMHSSVSQGPNGFISTLEISDEEDAMRNSLETAVTAAIDLFQMVDKQQLSLLGATTDLTGPIVERMIERYIAEQVHHTLLFPRICDIRRLEDLDLERQTRQMQDIDISQVGIDIGNGRKGKQELAVRLSKAVDMFKKMGVAGSPQEMLDIVLAVTKHITMPDASSVAKDSTAQATLNGQQLSEKHDHLLTINADTLVSLLLIVVIRAPVRHLQARLSYMRHFIFIDDVETGELGYALSTFEAVLSYLQNDSGGLRKASRRNRKLWQATKTGDLATIQGILEPDRSFHQDMNDSSSDDELPERHHPVRFASFSDLNSLAGSTMKGDYEPRRRRRRSPSNSRHESEDGPLAHIFPFQRAQTPTLPDRPKLKKTVSYDTRSMSSCSARSFRSRTTIDSRYSAIEGDTSIEKLVMTQSSEGESVLMMAVESKQDKALQYLLSLTDYYTPAFVFEDCNNEGTTLLSLAVQLAHSKSTDTLLGYILENSSSPEALAAYFAKQDSKGRCMAHYLFHQPRLIQRIGHLVPWRLKDKNGQTPVFALCRSYDHEEYHSMVDQGLLAATHAQADGQPLHLDEHVDAKGNSLLHVITDPQLANKLLYRCDSDANATNDKHFTPLMVASKYGRTDMVRVLFQDPRVDLSVRDARGLTAVELAKDDDVRNRIDDLVLLSNEPGADGRITTVVRSFFVEDGTVRLVLKSGAPNSNGTITVTTCRRSSQDFENLGKWLAQENPASWLPVIASMASPYLIPSRPARSVLRDMQLRLDSFLKILLRHPTFSMHEMVWEFFLVPDIDSSMLAQRSARKAELRVERLREELTPIYDVREVELFVQHARENVRSLHHASKSVLRRTNKLRMSSTDLTDAAKLSNTAIHSLPFLPASHLRAFERYTKTIANTEASPIAGFYYNMHALSSTITAVLTALTRPSNLIASMSSTQKAIDRHDLSVRRSDRWPLGLLDDARSRVQRDAQEKMERSKDELADLGRELRYTQQVVASELASWQESRVEMGRRALRELGRRMVVVERARLESMRRAIRELGIERVGKGKGKEGHANGVPVQPESASEVPEAHLQHGTASETNGHATPHSVELDDVMLPPEGGPQVEDLIDGPSTEPLEETPLLDLAAEAPEQLDGTAAPISEPTSEVTAATVSVGNEDVEEEHPPGLPSRR

SEQ ID NO: 4539 - protein, 1886 aa, Unknown
  Kingdom: Fungi, Phylum: Ascomycota
MRFVFLAVFAGLTTAQTNSTFDGTPSIPSISRGSSTQSLSAASTNTNAAITVAADGSGHYTAINAAVSAAQNSGIPTVTVLPGTYSEAVSIVGTATVSIVGATATSAADWSQNQVVISNSAAALTIASSNAKGVTLRNLNFVNSANTAPSVNAVVLALRGNNIAFYGCSIVSPGATAISASYGLAFFANSRIEGSDKIFYNVPSIYVYKSTIVPLSSGATVVYSKGATVNNVFYNSTVVFDSASIEQKPGYSNTGVYLAAPNGVGAIVIYRNVAMDGFISSQGFHPTAGTVSSFFGEFATTGAGSYSKNAATRPVYDNQLTVSQVSQYTVDRVFGNAFYPYANSSTSWIDSTTLSSLNDADAAQLAMTPSPTLVASSTASLPLSSVSHNVSSTTISTGASSINSTCAPSATFVVSKDPSMCEYKNVTAAIAALPNDAKPYTIHIGAGVYNEQISITRKGKVTLVGATNFTRDYTHNQVTIQTSNGVLTSAGQDEITPVINAKKTSDNSGLALYNINFANLYPQTKNTAALAADFYGANIAAYGCSFIGFQDTLLTNKGTQVFSNCYIEGSVDFIWGFSTAFFHKCMIVTNTPGSCIAAQSRASASSTGGYVFDRSVITYSPTYGSSFGLSYLGRPYSGNSIAVYTNCFIDKHISAAGWSVWSTSTPQTSNVMFGEYANTGPGSWQTSTQRASFATNLTASQAASYELSAWIGDITWLDQTAYNYEPSYSLITTSSPSSTNATDSAGFSSTSTINEHPDSGSVPPNGAVIVSLDGNHNASFDNLTAALTSLPKDTTNQTIFLYPGIYKEQAPIINRAGAVRIIGYTTGDPGRSYKDNTVTITFSRGLSVSPLPAGHSDAETATVQTSSSRISFYNIAIINTDNLDGAETSYVTLAASIYGNDIAFYGCSFDGWQDTLLTGAKTGYQYYESCYIGGKGAIDFIWGYSKAYFKGCTVGAKRKSSAITAHSRASSSAIGGYIFDNCLFTTAPGIADDLTNKVYLGRPYSAYAFVVVKNSYIDSTIAPAGWKIWSATDPRTDHITFSEYNNSGPSNWENNIAARQAFGYATLLASDMYSLSSVMDSTEWIDFTYWDSIVTPAPTAVLPAGPTNITVGGNSTFDGTTPPIGALIVSKAPIIGLDTYRTIQDALNAAPTSSKLNATIFIYPGVYNEQLIVNKSGTTIFMGYSNNTDEYAQNQVSIEFSHGIDTQGTEGSDTDGATVYATGNYFYAYNINFRNTAGTTRNIASLGFAVKSGKFAALYACQIYGNQDTLDISGSLFTFKTYIEGNIDFIFGNGAAYFLDSTISPNEDAISITADKRTTNTTAGGLVFDQCTLKPASGTGPFNNIGLGRPWNSNARVVFVDCYFDSMISAAGWNPWSKSSPQTASVTFGEYHNYGPGSSTCGRASFSQQLSDADVVQFQLGNFFAFTKFIDFSRVDTQPFTVGIGSAQTCATAASSSSILASSTILLSSSILPTITVYTTSTAVLKLTASAVFTQPDATSTMVIKLTSTASLIGADTTRTEIVKETATVQYTSPDVTSTYTSVITEDAGPTITPEIVTKTSVIRVTTTIGGTTTVKAPTFTVKGTTTILVVLTVSSKPTTLTQIEGSTATFVSAITPKSAFTTIRTTTSMAPSSTKTTTMKAKSSKTISTVILKTITKKTTTTESCLPTVAARLVRRGAAIPRAAPGTVTVTLSTEITSYVKTATFTQAGFTALVTETSVAKVKTYTQPGATSTLSLTSFVKTTTIVQPGSTHWISETSTKTLGKTRTLPGSTTTVVSTSYITKQQLQTVTPQALTVSDLKTRTSSHVVTVAQQTVYLAKTAGLTSTIRTTLPVSTQTIFQTITIGGGVATSTVTAPPGTKTVVAKSTTTVWLVATKLAKNAQACV

SEQ ID NO: 4540 - protein, 249 aa, Unknown
  Kingdom: Fungi, Phylum: Ascomycota
MKFSTIFTIASTAALTVAAPTTPASDLSKRADFCGQWDSQIQGPYTIYNNLWGRDQASSGSQCTGVSGLSGSTLRWHTKWSWAGGAGHVKSYANVVTKTNGRAISAISSLPSVWSWTYTGNNLIANVAYDLFTGSSVSGHPEHEIMIWLSALGGAGPISATGSPIATVTITGRQFRVYKGAHSQMTVFSFVATSPINNFNGDVNEFLKYLRNSQGLPGNQILQSAGAGTEPFSGSNAVFTTTAFSFAEK

SEQ ID NO: 4541 - protein, 207 aa, Unknown
  Kingdom: Fungi, Phylum: Ascomycota
MKTAILTFALATLAATAPAPLVPRAPPNVPTTAAAKTQLAGLIVAAQGPQTGYSRDLFPHWITQSGSCNTREVVLARDGTNVVQNPSSCAATSGTWRSPFDGATWTAASDVDIDHMVPLSNAWKSGASSWTAARRQAFANDLTNPQLLAVTDEVNQAKGDKGPEAWKPPLTSYYCTYAKMWVKVKSVYSLTITSAEKTALTSMLDTC

SEQ ID NO: 4542 - protein, 327 aa, Unknown
  Kingdom: Fungi, Phylum: Ascomycota
MARFTSLILLGAAAVSASPLAARQATTVTVTATADAAPTSAAWDAGAVHQYPIHASCNATQHQYIRNGLDETISICRQARDHILRWGNSSAIYQKYFGNAPTGEPIGWFTKIVDGDKADVLFRCDDPDQNCATQNNWAGHWRGKNASSETVICDRSYVLRRPLEGMCMFGYDVANGATNFYWASDLLHRLLHIPNVGEGIVEHYGGADEYPGVLALAESNPSEAVRNSDTLQYFALEVYAHDIAVPGVGCPGHYREVSSSAAAAPTSSATAAATSAAVTTTAAASSAASSAVASATSAAASATASCTPHDDHWHCPPGVPEPASPPA

SEQ ID NO: 4543 - protein, 871 aa, Unknown
  Kingdom: Fungi, Phylum: Ascomycota
MNRLAQALLAIGLVQAQTFPNTTNPTNSSSPLNNAESPPFYPSPWIEGTGDWAEAYAKAQAFVRQLTLLEKVNLTTGTGWQSDNCVGNVGEIPRLGFKALCLQDSPLGIRFADYVSAFPAGGTVAASWDRGEFYRRGNQMGQEHRGKGVDVQLGPAIGPIGRNPKGGRNWEGFSPDPYLSGHAVAETVRGIQDAGVIACTKHYILNEQEHFRSPGNFQDFGFVDAISSNVDDKTLHELYLWPFADAVHAGTGAIMCSYNKGNNSQVCQNSYLQNYILKGELGFQGFILSDWDAQHSGVSSTQAGLDMTMPGDTNFNSGFSFWGTNLTISILNGTIPQWRLDDAATRIMAAYYYVGRDQDNTDTNFNSWSRDTYGYRNFYGKADYELINQHIDVRAEHFRAIRSSAAKSTVLLKNNGALPLTGNEKWTGVFGNDAAENAYGPNGCPDRGCNNGTLAMGWGSGTADFTYLITPLEAIKREVTDNGGSLTSVTDNYAYNQIQAMAAQVSVAIVFVNADSGEGYITVDGNFGDRNNLTLWGDGETLIQNVSSLCNNTIVVIHSVGPVLVNSFYESENVTAILWAGLPGQESGNAIADVLYGRVNPGGKLPFTFGSSEEEYGPDLIYTPIAGNDSPQDNFEEGVFIDYRAFDQKNITPVYEFGFGLSYTTFSYSNLNVQKITAGPYTPTTGQTSAAPTLGNFSTNIEDYQWPANLTREGTFIYPYLNSTDLAEASFDPEYGLNYTWPAGSSDGSPQPRIAAGGAPGGNPQLWDVLFTVTASITNNGTLPGDEVVQLYLSLGGPEDPAIVLRGFDRLSIQPNQTATFSTDILRRDLSNWETETQNWVISEYPKKIYVGASSRKLYLEADLDLSEYQS

SEQ ID NO: 4544 - protein, 425 aa, Unknown
  Kingdom: Fungi, Phylum: Ascomycota
MPSSRLFFVFALLAALALAAPSQVRRQGLAKRSFKVPRQLNKAHPTGPNGPAAMRKVFRKYNFVVKGDFAGYSRQAAGMNASTTAAGGNKTGTVAANPEQNAALFLSPVDVGGQMMNLDFDSGSSDLWMFSTELDAASIGQHAAFDASKSTTFKKTEGAQWKISYGDGSGAAGSVGTDTVTIGGVKVEGQTVELANQVSQSFVQDTNTDGLVGLAFSSLNTVNDGTKKTPQKTFFDNVMNDLDMPVFTADLDPDGTGVYEFGKIDATKFEGEMAWIPVKAETGFWQFASTKFAVGDQMFENPQGSDAIADTGTSLLLVDQQVADAYYSKVQGAQLNAQVGGYIYPCGAALPDMSVAIGDTYMAKIPGNQVTFATVDQANTTCFGGIQGNQGAGLQIYGDTMFKAQLVAFNGGNQSLGFGQKPAVQ

SEQ ID NO: 4545 - protein, 349 aa, Unknown
  Kingdom: Fungi, Phylum: Ascomycota
MRSTLFNLAFLTGVSLARPQKATFEQETRSIDEIYKATLAEGGLITVWHGGDEKNQQSWLKQMFEARFPDVTLNITVDLSKYHDGNLDLQLAAKNVYVDSVILQTLHDYPRWKKQGALLNYAPRNFDKIYPVFKDADAAYAGLYIYSWSIASNTNKTTTVPKSYQDFTKPEFKDKILLTYPNDGDAVLLKDPKFGHKWFDALLANNPRWVRGTATPGTLLRSNDANSVASFTGGHSFSTESGFDNMLPTKGTFTSWAQTGAILKNTPHPEGAKLLHNYLLSDEFQQMVWSTRSDINPPTGAKKILEQPNTNAPAFAKWMSDRENVERLRFFFEDRIGSAQGLSPLEDDL

SEQ ID NO: 4546 - protein, 389 aa, Unknown
  Kingdom: Fungi, Phylum: Ascomycota
MRFTSSFIASAALLSTANAAIKGLNYGAQFNNDAAKQLADFEYEFNKAKNLRGTDNWTSARLYTMIQHGTQNTIIEAIQAAINTKTTLLLGLWASAGQESVNNEIVALKAAIDQYGTAFTDLVVGISVGSEDLYRISADGAGGNPGAEPSTLVNYIQQTRDAIAGTPLSGAKLGHVDTWQVYVNASNNDVITNLDWLGMDVGRESGVRLTGLRQTSSFNNGIGSGADLFFDTYNQTVAAAQGKPVWVTETGWPVSGGTVNQAVPNADNARIYWEDVTCKLVNENVSLYYYTLQDVQWGNPSPSFGIMPGGDLAQVSPLFDLSCPAATKNVSSLPVVPLSSALSPLLFTFLVNLTLVASLLSYLLPALPYNHVAHVLVQSMYPSILKPGL

SEQ ID NO: 4547 - protein, 309 aa, Unknown
  Kingdom: Fungi, Phylum: Ascomycota
MKVTHFWASTALLHIPTVLAQGLRQATGGPEATTTVQWYPEPTPEVSNCTASLITTLCEYKKPGSAFAVASSGKAHCWEYCNAHQPCNFVVFVAGNPYTGSGSCWLYPDETFDASAGEPGCDYLSVYDKPKCAEPTPTSGACTATASPSAVASVCAYPTPDDDCFYTCSASSGATNCLSQCAESDSCNYVVFNPRNDDNSPFASGTCWMYPNGTYDATKASTCSGAPEQFVYQNPCPKPSSSSASASASASSDGSSPSATGSSSNDAKAEGASEDAATPSADAKGAAPAGFSVSGSVVVGIAALMWQEL

SEQ ID NO: 4548 - protein, 388 aa, Unknown
  Kingdom: Fungi, Phylum: Ascomycota
MKSSVLLSLSAVALAAAVATPKDPQVVFQNPQVTIDEPDQYLIELSPGETRWVTEDEKWTLRRQNINFFDITNTDDLSILSQEIASKKVTFPSKPAYNKTVVPLLKELEKDNMRSHLETFTSFHTRYYKSQYGAQSSAWLLKQVDGTLKDAGATNAFVKAFPHPWGQSSIIATIPGKSNKTVVIGAHQDSINLFLPSILAAPGADDDGSGTVTILEALRVLLKSEEILKGEAENTVEFHWYSAEEGGLLGSQAIFQSYQKERRDVKAMLQQDMTGYVQKTLDNGEPESVGVITDFVDPGLTDFIKEVITEYCDIPYILTKCGYACSDHASASKAGYPSAFVIESDFKYSDNKIHTTEDKIEYLSFDHMLQHAKLTLGLAYELAFAEFK

SEQ ID NO: 4549 - protein, 540 aa, Unknown
  Kingdom: Fungi, Phylum: Ascomycota
MKQALIGGAALFGAAQALNYTCTPSAIQAALPEGTSVNFAYPVAANATFEVPQSDTGYPDSPPNLPALCAASIQVQSIGNTTFGFGIFLPEEWNGRFLAVGNGGFAGGINYLDMAAGVRYGFAAVSTDTGHNSTSGNGTWAYNQPDRVENWGHLALHGSVVIGKEITAAYYKQNVSYSYYNGCSTGGRQGLKEAEYYPEDFDGIVAGAPAWWTNHLQPWTIRIALYNFPATADYHIPAALFSALNKEVVKQCDPQDGLMDGIISDPLGCNFQPTTLLCSANSTANASSCFTGPQLDTVYNIFSDYVGENNTVFFPSFYLGSEGQPALISGNAPNSLGTGYVQYFLGKGPGWNFTEYNDDIIALSDAMNPGNATVGFDLSRFNAKGGKILSYHGMGDPLIPTGSTPYFYDHVLRTMKPQGVNVDDFFKYFLVPGMSHCSGTQASVNAPWYFAGGNQQSALADDVYSVPGFEDEEHDVLKAMMAWVEEGRVPEYIVATKYVNDTTHDEVLRQRPICMYPKQAKYTGEGDVDDVVNWECKSLY

SEQ ID NO: 4550 - protein, 487 aa, Unknown
  Kingdom: Fungi, Phylum: Ascomycota
MKFFSLLLAAGAASAELSQVPLQETPEVEGFQMFQSQFSELHSIRIKQQQNDTLCNAHSKQYTGWLDVGAKHIFFWYFESQHSPSEDPLLLWLTGGPGGSGMIGMLQENGPCLINEHANGTVYNEYGWSKNANVIYVDQPAGVGFSYVDEGAPIPGTSFTAAQDMHHFLQLFTTDVFPRLKGKEFHITGESYAGHYVPALGAQIVSQNQLYPKRPQVNLKSIFVGNAYISPLDTAFGYWETLCTTNPGVKEPVFNQTRCDIMATHLPRCLDLARVCYNHPDPAICLAGEEVCWNGVIVHYDGESGAGGRNRFDITHPCETGDDLCYPEIPRIGEYLNLPWVYEALHVPKAVGNYSIFSEEVAIAFSLTNDMGISTQPQVLYLLENGVDVLFYQGNLDLACNTAGNLQWANSFPWKGQPAFVAQSKQTWKDGSDEVGWFKEVKIVTASGRETTFALSTVDGAGHLVPFDKPKEALALVDRWLTKRSFA

SEQ ID NO: 4551 - protein, 421 aa, Unknown
  Kingdom: Fungi, Phylum: Ascomycota
MKLLGVTLASLGLVSAASVSNKNNVNYDDWKVFRVNGPSNTAKFQEIVKKLQLDVWKGKPSSGEVVDVSVAPEQLSAFETATKDFDTKIMHENLGASIANETTFSVYAAGAVPSATWFNSYHSLADHYQWITDLAAAYPSNSEVISAGKSLEGRDIKGIHIWGSGGKGSQKAVVWHSTVHAREWITTMVNEYAAYQLLTSTDATTAAFKNKYDFYIFPVVNPDGFYFSQNSNRLWRKNRQSTGSASCVGRDINRNWPHKSWGQAQGASTSPCAEDYKGPSAGDGVETKALKAQLDSLKAGKGIQLYMDIHAYSQLWLYPYGYTCSGALPNSASYASLTRGAIAAVKAVHGTTFTGGPICSTIYQVSGDSVDYALENAGAKYSMTVELRDTGNYGFVLPASQILPSGEEMWAGLAYLLKNMT

SEQ ID NO: 4552 - protein, 540 aa, Unknown
  Kingdom: Fungi, Phylum: Ascomycota
MKYAYTLPALAALAAASPMLHVGTIHNDAAPILSSTQSKEIADNYMIVFKKHVKHENTKDHHEWVQSIHTKSQSDRMELRKRSQFPVTTTVFEGLKHTYNIAGGILGYSGHFDEETIEAIRRHPDVDYIERDSEVHTLGGDEDYETEKNAPWGLARISHRDSLSFGTWNKYLYAADGGEGVDVYVIDTGTNYKHVDFEGRAHWGKTIPNGDADEDGNGHGTHCSGTVAGKKYGVAKKANVYAVKVLRSNGSGTMSDVVKGVEWAAQAHSDTVSAAKKGKKKGFKGSAANMSLGGGKSTTLDLAVNAAVDAGIHFAVAAGNDNADSCNYSPAAAQNAVTVGASTLLDERAYFSNYGKCNDIFAPGLNILSTWIGSEHATNTISGTSMASPHIAGLLAYYLSLQPAKDSSYAVADITPKKLKANLIAVGTVGALSDVPSNTANILAWNGGGSSNYTDIVEKGGYKSTKGASKEPSEYTITIPSVSEVEKEVADEFQKAKGAASRTAHQVGGKLTKLEAEIEDFVAEEMEHMFEEFKERVARQ

SEQ ID NO: 4553 - protein, 376 aa, Unknown
  Kingdom: Fungi, Phylum: Ascomycota
MKFSIITAVAALAGSAFAQDRVKGAAEGFAKGVTGGGNAAPVYPTTNAQLISYLADSTPRVIVLTKTFDFVGTEGSVTSDGCAPWGTGSACQTAINKDNWCKNYQPNAPRVNKITYDKAGVLGMTIGSNKSLIGQGAKGVIRGKGVRIHSNAKNIIIQNVRFTNINPAYVWGGDAITVDGGDLIWIDHVTTDLIARQHIVLGNKASGRVTISNNDINGATSWSATCNSRHYWGLYFTGSSDTVTFKNNYVHHTSGRSPKVGGNTLLHAVNNYFYAMSHAFEADSGSYIVAEGNIFQNVDRAAQAGLPGKMFGSSTNLAACRTGLGRNCQMNAFGSSGALAGSDTSFFGNFKGKNIAAASSANDAKNVVNTAGVGRI

SEQ ID NO: 4554 - protein, 190 aa, Unknown
  Kingdom: Fungi, Phylum: Ascomycota
MSSDPSPEEQKTLDAEAKARELAEQAALPYKWDQTIKDLDITVPIEGKYKGKDLDVAIARNKLRVAIRGQPPIIDGELPHPIRVDDSTWTLSTTAAGKDIEIHLDKVNQMEWWAHVVTSAPKIDTSKIQPENSNLGDLDGETRGMVEKMMFDQRQKEMGKPTSDEQKKLDILEQFKAQHPEMDFSNVKMG

SEQ ID NO: 4555 - protein, 555 aa, Unknown
  Kingdom: Fungi, Phylum: Ascomycota
MKVAHTWGALLSTALIANAAPIAENYTSEADYDVVVVGSGPAGLITADRMSEAGKKTLLLEQGGPSYYITGGRERPGWLNGTDLSRVDVPGLYKSVFSVPGNLTCASDVVNAFQGCTVGGNTAINAGLFFQPPASDWDLYFPAGWKNWDMQSAIAKVHAKQPSTDNPSADGKRYLQSGFDAARKWLVEGAGYAEVGLNDGWEYHQKNKVFGRPIYNYEGGQRSGPVKTYLQSALQRSNFHFQTGAKVVRIIRDGQTATGVEIQIKGSNATSIVKIAKTGRVILSGGALLSPQLLMWSGIGEAAALRNLSAAGQLTLPASQWINNSAVGDKVFDNPNTFIELFSDSISSYNYNYTNPIPADRDLYLKSRSGPYSFGSQTSAFWDFIRQGNETVGCQGTIDSSGAVDFVDNGTITLNVYGTSGLRSFGRVGLDEKGIATPSSGFFYSDKRDAQAVGQFIYNIFQALPKTLTPLNIARNSTLEQITTWISSPSDYTLGNVQHWSSSCRFDTCVDSNAKVIGTSNIHVVDASISAPLTTNPVLGTMIIAERAVERILAM

SEQ ID NO: 4556 - protein, 523 aa, Unknown
  Kingdom: Fungi, Phylum: Ascomycota
MTTRKGTQRILLLSATLGLARAVTLPEPTAAPAKIQVRAPIVTPAAVRFDDRYSYVQRRDILEDIKSGVEGVAKSWGSVLGTDLPSFFTEGIPGWFENLPTGTDVMSSLGIGDDDLAAIPTQVLNIPPYANWTDQGWNVRFHGNVYKIPNISQSKIDDLANIFLIDTSVEELPDEQKANARNLTRSIFVVQQGDENVTMTLEPAPMQGGDGEPGGGNAITAPGGNQTITLPYETTAEGDFDVFVPIESNGLINGNETENVQRLNVHTNGTDTGNATAFLVPPTGITFISDIDDILRVTKIYDPKEGLLNSFARDFTQWMNMPDIYRNWSQTLPNSTHFHYLTTTPEQATRNYMDFIYKTYPGGSFDTRPLNFSDVKATLSIRKFLLQKIFVTFPQRKFVLLADTSNSDVMNDYPELAHTYPNQVQCIFLRNTSSTDSDDWFPYNTEGFKGLNNRSYMFFHVPDDLTGLDIANGQCLNESIQQNVTFSRQAEILGIHGGAGSKLGGSATISFLVALVAAMLLTL

SEQ ID NO: 4557 - protein, 1409 aa, Unknown
  Kingdom: Fungi, Phylum: Ascomycota
  misc_feature (412)..(420): Xaa can be any naturally occurring amino acid
MTRSTTVWAAALAVASMSGSGPIGTVAEAMPAPQPQQTQGKPRYYFPRHVKRQINSEVANATTTATPSSSSTSSAESSSSERRQNTFPDISSLFRSFMNGESSTSDSSSSDVFSTTSEQDTSSSSLDPLSITVTSTPQNSQPPTGTGSPQVPPPPASSSTTPEEIPAVPSAPASSSSSVETTPEIVSSSSSSAPTSTPEEPTSTANVEPSSAPVSTPEEQTSVAPSSTPEELTSTVNARPSSAPATMPEEQTSIAPSATPKEPTSTANVEPSSAPVSTPEEQTSVAPSSIPQEPSSTPDEERPAPTGVIPPSSQIVLPTTSSTPSPPAAPSSQTPSDTESEVSSSSQAAQQSAAPTGVLPPISEILTPTTSSSAAATSEAPAETEPTTISIQEPTTSSIQEPTTSSIQEPTXXXXXXXXXPTTSNQVSLEPSVAPTGSSPAPSEVILPTTSSTGIEDASSTVEQRPTGVLPPASEIVLPTSSSDVEPAPASSTASAAPTGSLPSASQIILPTTTSASSVPTQSPEDDEPTQSSGGLLSSLLGGLLPSSGRLPTSESVQPTQAPTTSDQQAAPTGTLPDVILSGTSSTAPASEAPSSQPSSFLGPFIIPGTSETSAQPTTSDSVDLPTSVAPTGSMPPASEIVLPTSSAQSLEQVAPTGSMPASSDIVLPTSSAGVIESLVSSLLNTAEPTPTSAVESGIIPSSGVVPTGDAASSSPSSGGITIGITTALGTESATASAPLTSQASPSGAIPTSEGVSASSELDLSSLLSSAVSEILPTGVVPSSGAINPTAPVSATITESPSASGILPSVAPSLISDLSSLLSSAVSDLPTGSALPSLISSLVSSAESALTSASILPTASVPVPIPTSDISSIVSSIASDFSSTLLSSGILPSATVSGSGSLSAALPTGTESVTPSESVTPSETITPSGSISPSESATVSASSGTLPTFTLSGTDISTGIIPSSTLSGTGVSPSATISPSESIPLTISASETITSSGSIDSSATITVSATDSTAVSVSPSATGSVSPSVSGAVSTGVESSASPTLSPSESISTAPSAPATASISPSDVSTTTSNESTVPIPVVPSTTSSQTPVRTVLPTATNSETTLFIPTSIVQEASTVASPTAATSSGIPSSLPRMIAPPGGVPPEVSQDSFMGQVCFKWPLNYPFVSANNGGNQIFHYLPQAIADGLNISVSDVKNYGLKPLDTTKYQGFITTMAMFTIPKDLQTKLAAQLRNPADPFWHNKDATVNDLTNLINTACPLAAGGSLPGAGSNVAPGDPAATSTGGAGDGGAIGGDAGASRKINPTSAGIATGAIVGAIAYGAAMFFVARRYRNKRIAHQRSSSVPSTSRMTYGSIPGGAAAWMRGARDGRMTPGSRGSHGSASSQGRSIRTQQISAPVMAENSLGWN

SEQ ID NO: 4558 - protein, 609 aa, Unknown
  Kingdom: Fungi, Phylum: Ascomycota
MAPVTRLIALAASLAVSSATTIAEINGNKFLSPFKDQTVSNVTGVVTAKGPDGLWIRSTTPDRDERTSESVYVFGRTFGANLTVGDAITIGGKVLEYRSNKDYIYLTQISNPVLEKVVSKGNKVVPLIIGKDTGNPPTEQYTSLDGGDVFAVPNNKSQISVVNPTLEPKKYGLDFWESMTGELVTVKKARALTKPNQYGDTWVAGSWKVTGTNDRDGLTTTDKDANPEAIIVGSPLDGTKNPTETRMGDSLEEITGVVTYAFGYYRILPSTALKVTGSKQPLTPKPTKLESKNDCDGITFGAYNVENLAPTSDHLPHVAEQIVDYLKSPDVVFIQEVQDDNGVTNDAVVSAYLTLSTLTKAIAAAGGPNYTFIDIAPVDDKDGGAPGGNIRVAYLYKPSIVRLYKPNPGGPLDKTEVVNGPALSFNPGRIEPASEAWTASRKPLVAQWEVIGKKGKTSGNFFTINVHFGSKGGSSSIMGDARPPVNGGVDDRLEQATLTANFVKDILSKNKNAHIVTAGDFNEFTFVEPLKQYVKISGLKDMDAVAGIDELERYTYLFDMNAQQLDHMFISPSLTSKAKYEHVHLTTWVSYDEQVSDHDPSVARMDVCV

SEQ ID NO: 4559 - protein, 620 aa, Unknown
  Kingdom: Fungi, Phylum: Ascomycota
MRDFLLASAATASVLFARTAGAVAVNPLPKPSNITWGDSGCLSVGSLSLSGPDHKVLQQAFDRATGTITDLKWVPAATEAPIREFEPFPTSTASKKSRRKRQYSVPPTGNCTVRLTTVNVEIANTHAALQHGVDESYTLDISEASDSIDITARTVYGALHAFTTLQQIVINDGHGNLIVEQPVSIQDAPLYPVRGVMIDSGRNFISKKKIFEQIDGMALSKLNVIHWHMIDSQSWPLEIKAYPEMTEDAYSANEIFSQDTLREIVSYAAARAVRIIPEIDMPGHASAGWGQIDEDILTCQDSWWSNDDWALHTAVQPNPGQLDILNNKTYEVTGKVYKEIADIFPDNWFHIGGDELFLNCNNFSSRAMAFFDSGKSMGDLYQYWVDHAIPNFRAQANKTFVMWEDVVLSAAVAATGNVPRDIVLQAWNNGLEHIYNITALGHRVIVSSSDFIYLDCGYGGFVSNDPRYNVMVNPNATDGSPNFNWGAGGGSWCAPYKTWQRIYDYDFTLGLDDTQKALVQGAIAPLWSEQVDDVVISQKMWPRAAALAELVWSGNRDENGKKRTTELTQRILNFREYLVANGVQAAPLMPKYCLQHPHECDLYLNQTVLHVEPAAPAWAS

SEQ ID NO: 4560 - protein, 620 aa, Unknown
  Kingdom: Fungi, Phylum: Ascomycota
MAVFSRLAVAVQFMGILIAPTLGAATNGASPQYDYVIVGGGITGLVVANRLSEDRSKSVLVIEAGDNVDTDATKIPYKANDMTSANGLMWDGINSNPEPGLGNNSYPVIVAKVLGGGSVINGMVYDRGSAADYDAWEALGNSGWGWSGLEPYFKKCTTYQPPTPEAVKDFNITWDASTYGKGPLTVAVPSNQYADLKDYWKAWKATGVHVPEDGNNGEAYGPSWYPNTMDVTTGRRAHARYAYYDPIQRTRTNLQILTKTTAQKILFDSKDKPTATGVEIIDANGKVSTIRARKEVVLAAGSIQTPKLLQLSGIGPRAVLKAAGVKVRVELDAVGSNFQDHPWATVMFNTTTTTFPNPSSLLTNATFNASAWAEYEANKTGPYTNARGNALAFISLPDMTSKQNVTSLAKMLSSQKDTTYLPSIYSANKNLARGFAAQRKIITNLFSRRDAAVAEFPVPTDASFSLVGVQKPLSRGTVYLNPSNPTGPPVVTHNAFVNPVDRTILGISTRYYRSVLSSPLLSRFRITETVPGAQFQSDEQLYNAMLAQGLLSPTLAHPSGSCPMMPEDLGGCVSEKLLVYGTRRLSIVDASIIPIIPSCHLQATMYGVGEKAADIIKARS

SEQ ID NO: 4561 - protein, 792 aa, Unknown
  Kingdom: Fungi, Phylum: Ascomycota
MEQVRSQPAAAGGRRRSIFTEVGLIDEHTINTKRSPAPILITEQALRQQRPSRKVRFRSRNSIFGAKDGVEEVDDESDWESVDEEDDDSNQATSPTSLAYTISNSKLYRAGLFAIVLALMLPIIQVISIAPLSVYGSSIPRASITSLAERSTLVERADSQTDVCKRWSGQSAIVNGTLYMYGFRTTTDAQQNSNTWTNDFVTLDLTKSWQISNPSLTGLPQPSGPPAVSLGYLYSSHNSLWLYGGQYSDSPAEKPGPNSIWEYDIGGKTWTEHADPKSSAGTNAEGDGQSIQRAAEGSGFGVTALGRGWYFGGHLDDFTTEGWSNQIARVYLKSLLEITFPGHSNDAVESLKDGKKAEGTPVFRNITTGGIQDTGSFPERADGLLTYVPGFGNEGLLIGFTGGDNDTFAQMNVIDVYDIAESKWYKQSTSGKMPPYRVNPCAVVGAAADGSSYNIYMFGGQNLQPYGDQTQKDDMWILSVPSFTWIEVDQNSQAVPPARAGHSCHVWDGQMIVVGGYVGQELSCDSPGIYVFNMSSLSWSDQFTSLTGGKATQDFTGDGSIGNPLAQQANQRGFNASAGVEGSYGYRVPEAVQKVIGGDAVGGATLTAPVQTPTAGPLATGKAITYTVTGPNGASYTEIVSSSGASNGDSGPNIAAIVAGVIAGVFAVIAAYFAFCAWIYRKQVAMWKKHAAMVTAAAEKRDTTFTSSKISSERAPGTMAGSTAGGAAAGSFDIQRGSGENTSYAGAAANWERRSSVGSVTEDLLDGQEPSFWGTKGVLLNPRRSLRVINNG

SEQ ID NO: 4562 - protein, 741 aa, Unknown
  Kingdom: Fungi, Phylum: Ascomycota
MPTHHPQYGDLLLLASDYPRGRIEIRERPFCAWQACANPWTLWNLQSKPERHHRHLQRPETRIGPSSRWSQDVVPIEMPTTLSSTKRSDRRHPGDHSFALFIPYLFVIIIMLFRQFALAAASVSLARAVDLTGYEYVVVGSGAGGGPLAARLALAGHKTLLLEAGDDQGASQNYTVPGFHAKISEDPNLAWNFYVKHYADEERQARDFKTSYTTPDGGEYTGLSPPAGSVQKGTLYPRTGSLGGCTAHNALIAVYPHQSDFEYIASLTGDDSWAPDNMRKYFVKLENNAYLTNGQGHGYEGWLGTQYAPIDIVTSDPQLLSLVGGAAFALSNKTNAVINLATLVAGDANADSLARDQNPGLFQIPLSTADGQRTGAREFVVAVRDAKAADGSKKYPLDVRLNAHVTKITFDETEETPRATGVEFLDGQYLYKASPKNKGDKGIAGTATASREVIVAGGTYNSPQLLKLSGVGPAEELTKFDIPVVVDLPGVGTNLQDHYEISVQGSTETDFSALDGCTFKGDAADPCIARHNTPILGNRGVYASPGLGATMFYQSSTAEKNNWDIFAFGGPVNFRGYFPNYSVNATAVHNIFSWAILKAHPRNTAGSVTLQSADPLDVPAINYNYFDTGVGDFEKDVTAMREAVALTRDAFKQQLVPITEVLPGADVDTDEKVNDYIKDNTWGHHASSTCPIGADGDAMAVLDSSFNVRGTKGLRVVDASVFPRIPDEGGVDGNVGRCLRA

SEQ ID NO: 4563 - protein, 319 aa, Unknown
  Kingdom: Fungi, Phylum: Ascomycota
MASSLKLDFVTVDVFTNKPYEGNPLAIIRIPHGVSVTQEQKQRIAREFNLSESTFLHENAPDATEDKWTVDIFMTSQELPFAGHPTVGTACYVLAKTAEQRGIKDGVIDAGFQLKAGPVGLRYDVAKKTAKAAIPHDVHVHQKRWSRDELFNLQPGLAAAHQKGEVKALEDYPIVSIVKGMTFVLVELESVEALAKVSLAGQSVKIEGLDQSWDKTFIGTYFYVQTGKGENGATQLRTRMIEGPLEDPATGSAASDLTAYLSLEEGRAGETLKYELVQGVEMGRRSEIFIDIVMAKDGSIETVYLEGGAVQVMEGRLTV

SEQ ID NO: 4564 - protein, 879 aa, Unknown
  Kingdom: Fungi, Phylum: Ascomycota
MLLKAVVLGLSACASALDARSYGAEIPYSGETASKHAYGTLLSSSPTGSPKISLPTSGHSTASSSSVHVSYTRPTTYIRTIAPYPTKANSTSTSSAPLSTGTSGSCAPYWLENIKHQGVASFNPNSNNYTVFRNVKDFGARGDGVTDDTAAIQRAVTQGNRCGPSACESSTNTPALVYFPEGTYLISSSIIDYYYTQLIGNPNCLPTLLATSNFTGLGLIDGSPYLGTGTRPGRTGFGPTNTFFRQIRNLILDMTNIPANVSATGVHWPTAQTTSLQNIVFKMSAANGTQHQGLFIEEGSGGFMTDLLFEGGNYGFNVGNQQFTTRNLTFNNVVTAINQLWDWGWTYSGVTINNCQVGLNISAGGPSAVNIGSITLFDSEINNTPIGIITSRTDNSEPAAAGSVYLENVKLSNVGVAVAGPNASYLGGTAGSTVIAAWADGHRYLPRGPVEARGPVEPSKRPAELLDATGRYYTYSKPQYGGTPLSSFLSARDLGATGDGVTDDTAALNAALLQAKSEGKILYVDAGFYKVTGTIYIPPGSKIVGEALASVILSAGEYFNDINNPKPVVRVAQPGEQGSIEWSDMFISTQGQQKGAILIEYNLGTYSSTPAGMWDVHTRIGGFAGSDLQTEQCEKTPDIRTTPANLVQECIAAYMSIHITKFATGLYLENNWLWVADHDLDDARNNNTQITIYAGRGLHIESLRGQLWLWGTAVEHHVLYEYQFVDTRNIFMGQIQTETAYYQPNPDATIPFPPNPALNDPIFAPFINGTGNSTASTASGWGLRIVRSNNILGYGVGLYSFFDNYSTACSAVGAGAVCQTRIFSVEGDRLSYDINVYNLNTVGATNMITRDGVDLASNVDNNSTFVDTINMFRINGVGL

SEQ ID NO: 4565 - protein, 295 aa, Unknown
  Kingdom: Fungi, Phylum: Ascomycota
MRLTTLLGAAFTAATALAQPINGTNTTYVGPENGHLVIVGGNLQSDSIWQRIIDLAGGPDAPIVVIPTAGGEPTYNANFSSAVSFRKLGAKNVTVLHTYNPAVADTDEFVAPLLEAKGVFYGGGRQWRLVDAYAGTKTEKAVQAVLDRGGVVSGSSAGASIQGSFLARGDTANNQVMIGDHIVGFGYLKNTAIDQHFLVRNRQFDLFDILKVYPELLGIAIDEDTALIVSKNDAEVFGSTYAAFYDGGFWSREGSELKNLPPPESRFYFLKAGDKYDLGLRKVVETESIAERSEL

SEQ ID NO: 4566 - protein, 379 aa, Unknown
  Kingdom: Fungi, Phylum: Ascomycota
MLIPFVQVLALAATIEAAVTKPRDVVENLQRKAIAELDQVKRVGNGGCSLSRAAVRKDWDWMSGKERKAYTAAVNCLLDSPSQSDPALIPGARNRYDDFVAQHMNQTLTIHGTGNFLTWHRQFVYAYEKALQEECGYRGYQPYWNWFAHQDNLRKSPVFDGSATSMSGDGSFVYHNGSVVGGGNIFLPSGQGGGCLQDGPFKGMVANLGPISPSMKEMSRVNSTFAYNPRCLRRDLTTSASSGWLTVENLLNVTIGAASKSIELFQNEYQGRFSDKFLGLHAAGHASISGDAGDIFASPVDPVFFLHHAMVDRVYWLWQALNKDQAHKVGGTITLNNNPPSRKATLEDLVQTNWLNVEPAPIGHLTDTLGNKPYCYIYL

SEQ ID NO: 4567 - protein, 273 aa, Unknown
  Kingdom: Fungi, Phylum: Ascomycota
MRAQILSLIAAASAVTAQSSTVVPAPIVSGNPKGASYVATLPEQEKYTVRGSFAAVSAEDGNGVKFTISVSGLPAEGGPFMYHLHEKPVPSDGNCTGTGAHLDPYKRGEVPVCDESKPETCQTGDLSGKFGNFTTQEWAQEYVDLYSATRPDSNAYFGNLSVVVHLSNKTRIACANFTQISGGEDSGYPGYPTSSINLSTGASSGYALPTGSGGYNSTIVPPAPTGTGSPTTAVPVSPSSTTSSAPVEFTDAAPRLVSGAAGAVVAIAAALLL

SEQ ID NO: 4568 - protein, 643 aa, Unknown
  Kingdom: Fungi, Phylum: Ascomycota
MYTSRVSFSSLANCLSLAILVASLSTGSQGVALAKRNATIEQDVFFDISRTELEEKITELKAAGYRPTSLSIHGSPVDAKYAGIWTQQDGKAYETILGANETTYNAWLDRWRTNGYVSTHVSATGSASNALFAGVMQEVSLVRSWVQQCGLDNPWAYANATMDTPMIIKGVSMYGVPGERQYCILGHENTVNYQQTVSYQTDSYQDDYKKLEADETSKRYWRPVYIDMTEDNILTPMFDDTSVGKWVAVTDLSTSQLKSELSVQKAKNMYPIHIAGAGQANARYAVIFAERTTPLEREWHATGASTGFNDNAGVSAALDEVMQNFMRSNSVRQAQVAASINGTVVASHAYTWAESDRTVVQPSDKFLLGSVSKTFTYAATNHLINTGLLNLTTLVYPLLGYNNPSDERSLDITVQHLLDHTAGFDRTMSPDLGFIFTTVAQSLNQATPATLRQVIEYIAARPLDFTPGSRLVYSNYGTMLLSYVITNLTGETYSSYIEKSVLNGAKVELYSTAAESHASDPIVQETKYTGVSALQPLSNERVSSVNGGDRSIKEEAIGAFGLRASATTISQFIGSNAVYGLGDRQQWSYRDGTVAGARAIAYSMEELDWALTLNTREYVNEAAWEDLVFNKVRDVWDRFALAG

SEQ ID NO: 4569 - protein, 335 aa, Unknown
  Kingdom: Fungi, Phylum: Ascomycota
MVHLKSTVLAGIAAAPSAYAWGSLGHTTVTYIAQNLISQDTKKFAQRILNDTSASYLANVATWADSYRYTPEGAFSSPLHYIDALDNPPKSCNVDYARDCSEEGCIVSAIANYSVRAVTPSVGLAEQQKALKWVLHFIGDIHQPLHVENLEVGGNLINVTFNGARTNLHAAWDTAIPQKLVGNFSLPTAERWANSLTAEIKRGKFKKESRSWTKGLQVKKPVDSAMAWARDANAFVCSTVVPLGAEAVRNQEISGAYYETAAPVVEKQIAKAGFRLARWLDAVVENAGRGVIKGVDGKYGLSKREVALSEAQKEGLRKREAFGDGCGCTAEEHEH

SEQ ID NO: 4570 - protein, 531 aa, Unknown
  Kingdom: Fungi, Phylum: Ascomycota
MKVRTTIPLVAFAGGVLAQTTFEPLDFNVTEALIANGVDVSALPGLSDLTEKRSLFSPCAVACSSLSLVFGNKVLSSGSAAYDAFTSGYWSTQTASVNPYCVFKPGKALDVSTVVLLSRLTQCPFAVKGGGHTGFPGASSIEGGITVTLEDLNEITLSKDKKTAAIGPGNRWGAVYSKLAEDGLAVIGGRASDVGLGLVLGGGVSHFSSIYGFACDNVASFEVVTASGIILNVTPKQFPDLYWALRGGGNNFGVVTKFTLETLPHGLMWGGTRIHLQPDYPALINAFASMAEQASSDPKAAQILSFATTAGSPAAQIQLEYLQPVDEANPPRILKKYLSIPSVRANTANLTLAEDAELLVNQMPGGHRYSFWAATFKVDRDLMAWMQALHQKNVAPLPDQGSLTFQAFTVDALSQTSKKGGNALGLNGDDGPLMHTLLYMVWDDATKDDTLNKAASTFMEAAKAEAKSRGLYHQYIYMNYAGPYQNVVPSYGEENLAKLKKIAKKYDPQEVFQKLQPGGFKLDGAPYGESI

SEQ ID NO: 4571 - protein, 336 aa, Unknown
  Kingdom: Fungi, Phylum: Ascomycota
MLHLLTLVLSLAAAAAAAPTSLTARAGRTSPPAGCLSVGGSGTYKTVSAAVAKLSTSSTSAQCIFIYKGTYKEQVYIPALKSALTLYGETTDTSGFASNTVTITQGKSQDDVANNDLTATLRAWTPNLKVYNINLVNTRGQGSQALAVSANADKQGYYGCQFKGYQDTILAQIGQQVYAKSYIEGATDFIFGQKAAAWFDGVDIRVLAASKGYITANGRDSDSNPSYYVINKSKISAASGNTVKAGAYYLGRPWRNYSRVVFQNTAMSNVINSAGWVQWGSSDPRTDKVTYGEFGNTGDGASGTRASFSKKLSSAVSISTVLGSSYKDWVDTTYLS

SEQ ID NO: 4572 - protein, 503 aa, Unknown
  Kingdom: Fungi, Phylum: Ascomycota
MAPSDLYKHGLLGLLCLAPTLAQGQGSKANAVQDCLLGGGVHATISTDETWSNDTASFQFRLPRDPVSVAFPETRDEVALALGCARNASVKVSVIGRGHSFQGYGIGNPGNLVIDMGAFTELSFDNTTKQLKAEGGVNVGPAAKYVYDNFNRHFPHVRGSHVGLAGSSFGGGFGTTSRLLGIPMDNLISVEYMLYNGTIVNAGVGASGELSNLYFAAQGAGPNFGVALSTTTQTHEIPYNDAVSYSLSLGQVSNEAAAAALLAIQKWVLDGGAPDELSLRFALGNFATAGFFYGPEAEFDSIFAPLVKTLRFIAPAVNLTKTVLPTFWDAEVAAAGNGLNLPTGGSLGGRASLVQSWTTTNQRPLTARQASALINSYHSLNRTDLTNTGFLDLWGGVSRDIIDQDHAYIHGQNLWLVRVDGVASSGVWPSDGVEYMQNLLKPFEVALKKSGPLRGFPNYVNSELSEKEWSSRLYGSNYRRLRRIKATWDPEGLFSGFGLAITP

SEQ ID NO: 4573 - protein, 336 aa, Unknown
  Kingdom: Fungi, Phylum: Ascomycota
MLFSNILAAAALVSAAFAAPSDKETRANRKLKWFGINESGAEFGEKNFPGVYNKDYIWYDTKTIDQFLGQGVNLFRLNFLMERLTPNSLTGSFDKAYLGNLTQQINYITGKGAYAMVQPHNYGRFYGNIITDTSGFKTWWKNVAAQYKDNALVVFDTNNEYHDMDQTLVFNLNQASIDGIRAAGATKQYITPEGNSWTGAWTWVSSGNAASLVSLKDPQNKLIYQMHQYLDTDGSGTSEACVSSTIFKERLQAATKWLKDNKKQGFLGEFAAGNNAQCISALQDGLTYLGQNSDVWWGAAWWAAGPWWGNYIYSMEPSTGVAWVNILPKIKSYFVS

SEQ ID NO: 4574 - protein, 497 aa, Unknown
  Kingdom: Fungi, Phylum: Ascomycota
MLKLLGAAALLGAAFAQNLSSLPTVDLGYEIYQAASFNETGGFYNFSNIRYAAPPVGDLRFAPPQAPAENRSSVITGNPNRICPQAGPAWSSQAQRFLTSVILGASYNTSTNYVPPGANSSSLVPAADPREDEDCLFLDVFVPQDVLEKAGKGYGAPVLVWIYGGGYTGGNKNNNPAGLIAASGNSTNGDVIYVSLNYRLGAFGWQAGPSFQAEGGTANVALYDQRFALEWVQEHIHLFGGDKNRVTVFGESAGGGSIMHQITAYGGLKGKAPFQQAIPQSPGWQPVQSNVQLEDTYRKFLNLTNTTSLAELRALPYEALRRANVQQIAYDTAWGQFGYGPTVDGNFVPQQPGQLLAQGRFDKDVNVMYQRATLIISEGIFTCNTYYLSKAYKNETYSYLFAVPPAFHGFDVAYTYFTGGAPSLLPTGVTNRTVAIALQEFITSFAEEGVPAASGVPKFDMYGENASVLRLNITGIDEIRDSNANKRCDWWQLALVS

SEQ ID NO: 4575 - protein, 230 aa, Unknown
  Kingdom: Fungi, Phylum: Ascomycota
MGFTDFVSDAGLTLLNNWVKTRSYIVGYTPSQADVKVFQQIKQIPAPEKFPYAWRWYNHLLTFEGEFETLPGDPTKEATAYGPESSELTVNPAKAPEKEAEEDDDDVDLFGSDDEVDEEAERIKAERLAEYNKKKAGKVKPAAKSIVTLDVKPWDDETDMNELKANVLAIEKEGLVWGASQLVAVGFGIKKLQINLVVEDDKVSLDELQQQIEEDEDHVQSTDIVAMQKL

SEQ ID NO: 4576 - protein, 207 aa, Unknown
  Kingdom: Fungi, Phylum: Ascomycota
MSSAPAQPMNVPEGAKAATVAAGCFWGVEHMYRREFGKKGLYDARVGYIGGDTQNPGYRAVCSGRTGHREMQRREGVKERITIEHHADFPSDAEALQVVYDPTKIEYRSLLEFFYKMHDPTTENRQGPDVGTQYRSAIFYHDDEQEKIAKEITKKVNEQWWKGGVSTEVLPAGQWWDAEAYHQKYLDVNPGGYECPSHFLRSFPPLS

SEQ ID NO: 4577 - protein, 254 aa, Unknown
  Kingdom: Fungi, Phylum: Ascomycota
MQFKAFLAGLMASAVSATPTPQDSVAIVGGVAASAGDFPFIVSLQRGGSHFCGGSLLNSRTVLTAAHCTQGQTASQLQVRAGSLNRASGGTLVRVSSVKIHPSFSGSTLNNDVAIWKLATAIPTSSTISYATLPASGSDPAAGTTLTVAGWGTTTSGGSTAPAALRKVDVPVVSRATCRNNYSVSEITDNMFCAGFAAGGKDSCQGDSGGPIVNAANRQLLGVVSWGEGCAAPGKPGVYARVGSLLPFINANLA

SEQ ID NO: 4578 - protein, 217 aa, Unknown; identical to SEQ ID NO: 4382
  Kingdom: Fungi, Phylum: Ascomycota

SEQ ID NO: 4579 - protein, 240 aa, Unknown
  Kingdom: Fungi, Phylum: Ascomycota
MSRANQWFVIGDGIAREVITADIQRYLGPDALVRPGTGTGEFQGQPGYWITAYRTLTSQMIQDLKMDSQRWHQERQPEGRGAYQDSRTHAARQHWGPSKPVDHPSADPYDRQPAPRASGYATSAAYAPGDGHYTTAPAGYGSAQAAYQAAPSSAGPRTAPADYSGYSQRDPGYQSQAYGSYPSQSPTDAYGRPTAVPTAYATPSATPAPGYYIASDGRQYPLAQQPQTSRSSQPGYNRKH

SEQ ID NO: 4580 - protein, 320 aa, Unknown
  Kingdom: Fungi, Phylum: Ascomycota
MDNLGKISAFGKSFGASFTPFAARTQQYVKEQLGQAEDKTQLPPDYIELEKRVDALKKVHTTMLQVTSQYSNEAYDYPANLRESFNDLGRTVSEKVNLLSSATSPAEAQAALTAPPSAKPQPKTFSHAVARAALNSSHMLTAEQSGSSEDPLATALEKYAIASEKVGEARLAQDAQIQSRFLSGWSTTLNTNIQFATRARKQVENSRLSLDATKANAKGGAFALPGQARKDGHGDEDLSEEARAKIEQAEDEFVGQTEEAVGVMKNVLDTPEPLRNLAELIAAQLEYHKKAYDILSELLPVVEQLQVEQEASYRKTRDEA

SEQ ID NO: 4581 - protein, 504 aa, Unknown
  Kingdom: Fungi, Phylum: Ascomycota
  misc_feature (420)..(424): Xaa can be any naturally occurring amino acid
MYTQLSTWLVVSAALWPTATAFYPYHYDDSSMTTSSSRRSARFSKTSSGSITLPLRRVPASLRSRQQNTYNIVDSKDPSQKNSVAIDQDGSDLSYMVAVTIGDSKEEYHLLLDSAASNTWVMGQDCKSDACGTHTTFGSGDSSSLKTQDSPFSVTYGTGSVSGTLATDTLHIGSLSPTVSFGLATNVSNEFKSYPMDGILGIGRGDVVKGTAQVMDVLKNDNLIGSKLYGIHLSRARDGLNDGELNLGEVNKGRFSGDLNWIDCIPNDTGFWEIPLDDATVNGAAIGLSGKQGIMDTGTSYILMPPADALAIHSQMQGYTQSGETFSVPCDTKASLQFVFGKQEYNISTADWLGGKLDSGLCRSNIVGRQTFGEDQWLIGDVFLKNVYSVFDFDESRVGLGLPSTGEEAEEEEEEEEEEXXXXXLTHLHCGIANKRIHWSDANCSRRGQRESELERERGSRKPGRGRSARRCWGAENSSGVGDVRPRCFVVGIDFSWAHVHGLD

SEQ ID NO: 4582 - protein, 595 aa, Unknown
  Kingdom: Fungi, Phylum: Ascomycota
MRFWALTVTAISLGFQAGATITEDVAEAYDFIVVGGGTAGLAVASRISQGLPDNTVLVIEAGPDGRQEPGIYIPGRKGSTLGGKYDWNLTTVPQPNANNRTFAQNRGKVLGGSSALNLMTWDRTSVAELDAWERLGNKGWNWKTLYPAMLRAETFLPSPEYGEEGVGKTGPIQTLISRIFPKHQASWIPTLNALGLATNRESLNGHPVGVSTQPNNVSPNYTRSYAPEYLRATKGNLVLKLDTRVAKINFQGRTATGVTFEDGTTVSARKEVILSAGSFQTPGLLELSGVGDRTLLEKLRIPVVRNLPSVGENLSDHIRIQSSYQLKSSYPSFDVLKNTTRAAIELAAYNAGQVSLYDYTASGYAYFPWDIVSNQTAATFKELVQGDTALTSAVDKVKKSYFSPPKSATVPQLEVIFSDGYTGLKGYPAVNSSLFGVGTFSLIGVVQHPLSKGNVHISSRNISDKPIINPNYLSHPYDLQAATQLAKLLRKIASTAPLKDVWTEEYEPGKAVQSDEDWKRYALANTLSIYHPIGTAALLPEKDGGVVDAQLKVYGTKRLRVVDASIIPLLPSAHIQTLVYGIAEKAADMIIAEYS

SEQ ID NO: 4583 - protein, 397 aa, Unknown
  Kingdom: Fungi, Phylum: Ascomycota
MASNGANTPQSQAQVQPCRYKTGKTLGAGSYSVVKECVHIDTGRYYAAKVINKRLMAGREHMVRNEIAVLKRVSMGHRNILTLVDYFETMNNLYLVTDLALGGELFDRICRKGNYYESDAADLIRATLSAVAYLHDHGIVHRDLKPENLLFRTPEDNADLLIADFGLSRIMDEEQFHVLTTTCGTPGYMAPEIFRKTGHGKPVDIWAIGVITYFLLCGYTPFDRDSNLEEMQAILVADYSFTPLEYWRGVSLTAREFIRRCLTVDPAARMTSHEALSHPWIADLGKKQAEGEEDLLPTVKKNFNARRTLHAAIDTIRAINQLRAGGAAGMMDGIKASEPRRGAPPAPKFPQPAEEGSDPMEIDHVDSRGNGHGQTEAMIREQERRIRETQQGLWSKR

SEQ ID NO: 4584 - protein, 330 aa, Unknown
  Kingdom: Fungi, Phylum: Ascomycota
MIASSLLYGLLATASVVDAAASKKQIKYEVVTGIFQQDEASTDPSTFDFIGSNFGLIERSYPSDPKTPDSKYATQWQRLNKYIKFLNKEKRTRYSLLFMGRHGEGYHNAAESYFGTPAWNCYWAEREGNGTHTWADAKLTQVGIKQAQDVNAFWAHLITNEKITPPESYYSSPLWRCLDTAQITFDGLPLPKKAAFKPIVKELLREGITAHTCNRRSNKSMLTKNFPDFKFEKGFPETDPLWKELTNEPSAAQDIRSKELLDDIFSSDDATYMSFTAHSGHITSMLRVLGHRPFRLATGSAIPVLVKQTTITDGEPTKTVPWESQQTEAA

SEQ ID NO: 4585 - protein, 450 aa, Unknown
  Kingdom: Fungi, Phylum: Ascomycota
MLARSGVLSLAVSFLASHAAAVDLNIDSQDSIRSVAKALAKGVVTFYDDALSESLVPGLFPDPYYWWEAGLAMNHLVEYYGLTNDSEYNARISEALQHQLGEMDAFMPTNQTITAGNDDQSSWGLASLSAHEAQLPAPISGSWLQFAKNVFDIQTLRWDTDSCDGGLKWQYFSFNDGYNYKNAASNSQLFLLAARLADQTGNATYAEWAAKVWQWSIEIGLVSADYDVYDGTDDRNNCSQFNLIQWTSNHAVFTEGAAIMYNLSNASQNWTDVVTGLVNTSSIFQRDGDALNEVACENNGRCDVDQRAFKGIAIRSFARAARAAPIVADSIHAMLNASAQGATQNCEVTGDDVACSLSWSSSSGNETWEQNTAGDGNLGEILNALSAVQALLWRSVEFSNNTISSVSPNATTSGSPSGASGSVLPTGAGSTLTASFTYVLAVAFAVALGC

SEQ ID NO: 4586 - protein, 374 aa, Unknown
  Kingdom: Fungi, Phylum: Ascomycota
MKSTIFSLIPLVGFALAQEGCTRRTVTKTETEKHYVTVQPTADITSTITKDVTSTSTIDLTVTVTVRPSSAEVSPTGLHWGSYPNGTWSNYTARPDPILSTASLHYTPSPITETPAPTSAPSEIAYPTGETGEEYEEASEAAVPTSETKTSSAYVAPAASSTSEAAQPQPTSAAGSKRGEATFYGGNTDGGACSFTGYTIPSSLFGTALSGSNWDTASNCGVCVSVTGPSGNKITAMIVDECPGCGTNHLDLYPEGFSSLAAPSEGVIPVSWDFVSCGITSPIVLKNKSGTSPYWFSMQVQNANVAIASLEVSTDGGNTWSKTQRQTYNYFENPAGYGTQSVDVRVTSISGESIVVKDVSIAPETTKTASGNFS

SEQ ID NO: 4587 - protein, 590 aa, Unknown
  Kingdom: Fungi, Phylum: Ascomycota
MYTFIVALTHLLSLTSAVLTFIPTRPPSIPLAVKSPYLSAWLPVGSEGNNGGYLPGQWPQFYTGQTLGWTGLVRVDNETYTWMGAPENIPVAHQTAFEYTATKSVFTIEVNKKVALRVTFFSPLTQKDLGRQSLVFSYMSVEVASIDGEDHKVQIYNDTSAEWISGDETINAEFCRYLQYYATDAQNGVTYHSGVDEDPVFGYGVNLGMVRRSSVSTLFSPGLCQDEAIQFLGAEGLVVLPSLWKSYFANDLETLVFFHQDHEEYSRLSSELDDQILEDSIVAARQDYAILTTLAARQAFAATQLTVDVIYPTSPIFFYTNPELIRLLLDLHFENQESGHYPNTWAIHDLGAHYPNNTGQPDGNDEPMPVEECGNNIIMVLAYFQRSGNTDYIKQHCPILKQWVKYLIEQSLYPAEQLLRCHLANQTNLALKGIIGIEAMSHLSSLINQTVAAQIYTTISHTFISAWQTLTLNTAASPPHAMLNYANASSWSLLYNLFADRLLATNLVAKEIYDMRSAFYPTVEDLYSVSDDSITSILDDPAVLLYLARRQLLMQVVVAVCPGVFTPLFRNAAIPRVPIGLDCNYQLRNV

SEQ ID NO: 4588 - protein, 721 aa, Unknown
  Kingdom: Fungi, Phylum: Ascomycota
MLFALFAFLQFTVALQHGTHHHHARHSQDAIIKRQIDEIADSLVARQSSGFTAITGVCSTNTNSDGTCNSNGRVSAPRLEIRQLRQNADQWNLYLLGMERFMAKDKNDRLSYYQVVGVHGRPFVSWNNFPTPLLNNAGFCPHAQVLFGSWHRPYLAIFEQALYQSIQEVINTFPSGQRGRWQQAASTFRMPYWDWAQDGGANSVPTVIRDQTVTVTKPSGSVTIPNPLYSYSWGSSIPSEVGGGPWNNWPNTLRRPVANPTRSNNNEMNARFNSLRTSLRDRVFALFSSKQPWGAASTSQIGVRTDLSGSGVDSFESVHDVIHNTAGGESGGHMYYLDISSFDPIFWLHHTNVDRLLAMYQLITPNSYVSNGNINRGMAQWNQGEPKNSYTPLKPFTKNSRGDYFTSQDVKETRVLGYHYPETSERTYSQVARAVTSLYGAGQRTMTKRDNETSYETGQYQGRPLKEGDYHHILSVTADKFAMEGSYTVHCFIGKPSSNSTSNSTLPASNTTVPYPISNSTAPYTNGTGEADYDPLTDYTQDPNYVGAYGILGGSMPGNGSAPIMTKGSIPLTTCLQGKEAAGEIPSLHPDDVEPYLEQNLHYIVVGVNGQLDPDSIPNLHISAHCTKAIPAASDDELPDLSAPYQALPKATHNKPAGKPFVYTPSPLDIPLPEGPEYEEGTAAPPTSGYPSLPWEEQGYCVTRQTIEYVDQDGNFLYAEM

SEQ ID NO: 4589 - protein, 532 aa, Unknown
  Kingdom: Fungi, Phylum: Ascomycota
MGLLRRLISILFSIYIRAECKNLAPTRETEGGAPRVTLSQATVEGFLDLHNNSVFLGIPFADTTGGQNRWKAPQDVPEANLNTVFNATKYGATCPQVISGTLFSHQGEDCLNLNIWAPSTGSNLPVFVYIYGGAMVTGSSSNPQFQGNNFARKGVVFVSFNTRESIFAYPNSAELESQTQSQNFGILDVDKAMNWIHKNTAAFGGDPNHIVFGGHSSGSVQVDHYLWNHPDTWLVGAVQMAANAKSGPAVAPVNQALDIVAAEVGCPTGAGQLECLRQVDIYDFQTERFNATYNTWFTPAVDNITRYQDYGSRFAIGNYASHVPLLTGNSDGEGAVFGLVYGGKNTDFDAWLDTFDADVAEIPKDLLLATYNISDFSTVSEMSGAQYGDARFFCPVDYLQDLRSTTQDTWTYRFFGNYSNFWGLPVSAPTHGTEIPFFLGGNECFDAIDGVTEAEQALADYQNDWFVSWIRNPSAGPGWDKVVPKSGTIAKLGVPGNDLAIELASTADFNGRCQSVYNPYLPKYPVIQEVKA

SEQ ID NO: 4590 - protein, 199 aa, Unknown
  Kingdom: Fungi, Phylum: Ascomycota
MLYSSILAVWALPLAMAVPSCIRQRSATNGTATCDLSIVRQPANVLTPPSPDLRLILVVHGEGTQNYTCATPTSTPSAIGAMAELFDASCEVADPSVAQNNMVQAAAIGNHFFADLTTPDFDIPSLGNTRTKKVEEAAAPNPSADIKWLRLQAQPDSTSQVKYIYRLNTGGGLAPTSCEGNSDGEVVTVQYQAQYWIYS

SEQ ID NO: 4591 - protein, 681 aa, Unknown
  Kingdom: Fungi, Phylum: Ascomycota
MIIIVRLSACLCLVSSALALVPDPRVLDSDLTILTHNDLYGNNSHRQASIIAVSKRQSRSAAASSCAALRESLWSYNKHPEQLDILRYLGYDNERHGQDLYWVASTAYARCNAVSAQGRTQQLPCDTPLPALCQNSAALSSPDFTDTSSRWQTAVSTGNATIIGYRDKHSFRFQGIKYAAISSRFSNSVYLPPAGDISALAYGSQCIQGSCSSGTTACSEDCLYMNIWTPTLPTGKRSKTKKKPVMVWIHGGGFVSGSGSDTTFDGGSIVSRGDVILVTINYRLGNLGFLALDGTSLTGNYGLKDQSAALDWLHAHIGAFGGDKDRITVFGQSAGAASVRALLASPEARNKFANAITQSTPQGLNYASTFSKYLTIAEATNKTITLLNETGCASSDSKTILSCLRAIDPLNLTTGTVASYPVIDTTFLPTSSLPLGPSAPKLNITLLTGIMHDDGSPFTSLTNSSNLTAVLAAQNLPTSPPSSLFPLPPIQNTSLAMFNLTSRITTDALFRCLAQSTASTAVKNSIFTKTFAYEFDRAFQLKDWSPNPPACEAPRTAEHPNGDPGLEYYKCHSGELYYVFGTLVREGVRVRDEDDVRFSQFVVDSWTAFARRGVPVPERRFLEARGFVNTTVLVNKARVWEPVGRAKGRELMVLDVEAGMEGWREVRQCEALGLGMRYYDV

SEQ ID NO: 4592 - protein, 229 aa, Unknown
  Kingdom: Fungi, Phylum: Ascomycota
MKFTAATALTVIGLAAANPVELTERQSCPKVYIFGARETTVPQSNAYGTAGGLVNSVKAAFPGSGSEAIVYPACGGQSSCGGISYDNSATQGTAAVVRAVTAYNQKCPSTQIVLIGYSQGGQIMDNALCGGAGATLTGNALNAVKAAIFMGDPHNRAGLPYNVGTCTTQGFAARPAGFQCKPANTSIIKSYCDAADPYCCTGNDANSHQQYVNKYGSQALAFIKTKVTA

SEQ ID NO: 4593 - protein, 402 aa, Unknown
  Kingdom: Fungi, Phylum: Ascomycota
MAPFFANQSCDPWQLRERPCELGNYVKYAVNATGPADVQRTIAFAASNNIQLVIRNTGHDYLGRSAGAGSPAVWTHHLKEITHIPTYKDVDYRGPAFDVGAGVQRFEIMAAARDKGLVVVGGECPTLAEMLVNANKRENPDLYWALTGGGGSTYGVMVAVTVKAHKDAVFGGASLSFFTTDNAQDVFYDAIQAFHEELPAMLDAGTMVVNYFTTSFFMISPLNAYNKTAAEVKSILAPVVARLDAKNINYTASYSKFNTYYEHYDKYFGPLPLGNIQVGIAQYGGRLIPRNVIGNITDTWKAVVEKGVTWIGVGTNVQRLGAAPWSEAIETQQKMTNVITPLVEAATPGSGTYVNEADFNQKDWQTTFRGSNYNKLLGIKRKWDLSCIFYATVGIEVSIVAC

SEQ ID NO: 4594 - protein, 612 aa, Unknown
  Kingdom: Fungi, Phylum: Ascomycota
MPVFSRLAVAVQLLTLIITPVLGVATSKDYDYVIVGGGVTGLVVANRLTEDKRVSVLVIESGESVDGPGNMIPYKANDLTSANGLMWDGLISLPEPALGNSTYNVLVAKVLGGGSVVNGMVYDRGSAADYDAWEALGNKGWGWAGMEPYFKKGTTFQPPSPAIAEAYNITWDPDTYGNGPLAVSITDAQYPDIKDYWAAWKATGVHIPEDGNNGEAYGPSWYANTMDKKTGRRAHARYAYIDPIAQRTNLKILTKTTAQKIVFDKGLTARSVEITDAAGKTSVVNAKKEIILAAGAVQTPKLLQLSGVGPRSVLEAAGVEVKVELDAVGSNYQDHSYATVIFNTTSVHTPSPNSLMTNATFNATAWAQYEANKTGPYTVARGNALAFISLPDMTDDVTSVVASLNSQQDESYLPSFYKGNKELLKGFAAQKKVIADLFKRKDAAVAEFPVPADGSYGLVGVEKPLSRGFVHINAKNPTGSPDILHNAFVNPIDRTIMAISLRFFRTVWARPELKEYKISETVPGAQYTSDEDIYSSLLAQGMLSPTLAHPSGSCPMMPKNAGGCVDEKLQVYGTKRLSVVDASIIPIIPSCHLQATAYGIGEKAAAVIKSRA

SEQ ID NO: 4595 - protein, 569 aa, Unknown
  Kingdom: Fungi, Phylum: Ascomycota
MSRRVIFGAAVLLSAVVAHPSTSLKKHYSHSQLLSSRGVCSGNTASTRSAWCDYSIDTDFTTVVPNTGVTREYWLTLDDVTVAPDGVSRSAMAVNGSIPGPTIFADWGDTVTVHVKNNLVESTNGSSIHWHGVRQNFTNDQDGVVSITQCPTAPEDTVTYTWRATQYGSTWYHSHFALQAWQGIFGGIVINGPATANYDEDLGMLFLNDWDHQTVDELYITAESSGPPTLDNGLINGTNTYDHGGYRYNTSFVSGTSYRIRLVNAAVDTHFKFMIDNHTMQVIASDLVPITPYETTVLDIGMGQRYDIVVTADQADVAHNFWLRAIPQSACSENDNSDDIRGIIYYGDTPSTPSTSAYSYDDSCDDETDNLVPYISKTVEDESSTNVEAATVGFNSDKLFRWYLNSTTMIVEWSNPTLSQILAGNTTYSTSNAVLELPDANVWTYLVIETTLAVPHPIHLHGHDFSVLAQGSGTYSSSVSLNLINPPRRDTAMLPASGYLVLGFETDNPGAWLMHCHIGWHTSEGFALQFIERYDEIAALTDESRLTAGCDSWNSFTEEASIEQDDSGV

SEQ ID NO: 4596 - protein, 470 aa, Unknown
  Kingdom: Fungi, Phylum: Ascomycota
MRFELAALLAAAASASAQAVVGKPYGFASGVTGGGSAAAVTPTTADELATYLSDDKARVILITKEFDFTGKTATGSGCDRKSCSASAGGQFYLGELSCAASDDNVPVSSIKYDTAGPQALKVGSNKSILGVGGKGVLKGKGLSLQKNAKNVIIQGIEFTNINPGVVWGGDALDFQGGNDGVWVDHNKFSLVGRMFIVSHYTASRLTVSNNEFDGTTTTSASCNNNHYWTMMFYGDGDKVTLDRNYLHNVAGRAPKLGQDGTTGTFHAVNNYFENMKGHAFDAYNGAQALVEGNVFSSVSQPVTDKGAKVNTFVVNGGSACSSALGRTCLENSVDSSSGKLTGGSSSSFISALKGNDVTPLAVNKVAAHVKANAGPANLGAASSGATEKDVSTPTTTKAAATSKAAATSKAAAVKTTLATVKKPAATQDASSGGASVAAWGQCGGQGYTGSTACASGYTCKKQNDWYSQCL

SEQ ID NO: 4597 - protein, 553 aa, Unknown
  Kingdom: Fungi, Phylum: Ascomycota
MRTTLWHVNIACKTSWVRVCNDMDVYNTTIHWHGLSQRTAPFSDGSPVSQWPIAPHQCFDYEIHPELEDAGTYFYHSHVGFQAMTAAGPLIIEDDKEPPHKYDEERVVFLQDYYNKTDDVIERGLTATPFVWSGEVNAVLLNGVGVAKEETGRRGCALPVIDVEPGKTYRLRFVGALALSLVSFGIEGHTSMDVIAADGRYTKCHNIDHMQITTGQRFDVLLQTKSADDLTELRGKTDFIIQFETKDRPSVYTGFGILRYSNGAATKTILTAPKIPPLRLSNDTHGFLEYALEPLKPNNFPTASEVTRRVHITNQQVLDSTVIWQLSGLNWTEDKPYNAPPYLVDMYKSGPAAMPNYTAAVTNGGWDPTTLAWPAKLGEVLEIIIENTGSAVNNNGGLDYHPFHLHGGHYFDCGSGNGSYDAAANEEKLAHYTPVQRDTTTLYRYEEKTGPEEVSGWRCWRLRVQDAGCWMLHCHILQHMLMGMQSVWIMGEWEEIARIPYSGAEGYLEFGGTAYGGGDFSPVVWHEWGDGKEDEEGDQKGGPGRHEGEEGKE

SEQ ID NO: 4598 - protein, 764 aa, Unknown
  Kingdom: Fungi, Phylum: Ascomycota
MIIRVFAVLAGTAIALQPLPPVQWTNTNALANGFDGFTARNTSKIIYIDSSWADTSDTEGLTLIPPTAFQFAETFRQDLSNWMTANWTLQRVDQFPENAQGVLLGPFRGSEDDLTYENGVTTEEGYEIEITNRTVYIGGTGARGMFWGTRTLLQQALIANGSSLLAGRTVDAPAYATRGYMLDAGRKWYAPEFLKELCTYASFFKISEFHYHSSDNAPLNRGRNETWGEVFSHFSLYPEQNTELQGIIERKNETLTRAQFEDLQNHCAQRGVTVIPEIEAPGHALAITKWKPELALAKKDLLNLTHPDAIPTVKAIWSEFLPWFQTKEVHIGADEYDPELADDYINFVNEMSEFVNSTAGKRIRIWGTHEPSENLTISKDIVVQHWQYGQSDPVQLQNDGYGLINSEDWWAYMSLKNDHTPILPAPYPQFYNTSRTLNFADVPGWQWDPSLFNPVNTTEQLEPGASGNKGAILAAWNDNGPDATTQLEAYYAMRKGIPVMAARAWAGRRGVNITTENTNTTIHFLASNAPGQNLDRRPASFRTTTQPTRPVISWNQRDGQMAQTFSKGSFGPPYTLHLNVSTSFAIKGPDTSLAISPLTTNTTTNSSISALIFTTNDGFLYPLRNVSYADYDPGHPGRIWTNASTSTHEPIPISLPVRLRIETDVYNGSRVWVNEAFAGRFEVFVFGGRNTVFSWSQMAFVAPLDSVEGGVDSLRLESGIGLYNVTAGNGSYGSPPEPSGAGGGKGGVGVLWVVVGVVVGWMFV

SEQ ID NO: 4599 - protein, 314 aa, Unknown
  Kingdom: Fungi, Phylum: Ascomycota
MADLDLNAIHDFMISVAKSAADRITFAKPTTSSSGSKKNSVDLVTETDQAVEKLISTSLREKYPDFSFMGEETYKPGDKLTPAPTFICDPIDGTTNFVHRYPYVSISLGLAIDLKPVIGVVYNPFTQTLYSAIKGQGAYLNQATKLPLTPPTPLETLNTCLVAVEWGSDRSGNDFTVKSETFKNLAATKENGGGMVHGLRSFGSAALNLCGVASGGLDVYWEAGCWAWDVCAGWIILEEAGGIIVDANPGNWEPRVDERRYMAVRGGEGQKKIVEEFWSLVHGKFETGTTDSLHNGNTQGTSMQQRPKSLIARH

SEQ ID NO: 4600 - protein, 364 aa, Unknown
  Kingdom: Fungi, Phylum: Ascomycota
MDYFRSKRSSAHQPIEDERPAKRISTPAGQRLSIVLESSHIRSKPTKPEPKSKIEVTTTSTYCNDPTHQHIGPTVHVHEQRKPGFLSVITGGRLGDTPRESMENQSHNGSNLSVSVWSDLHTPRSEKFKQLKSGGNGRRRGWKKLAIIGALVIALIIALAVGLAVGLKKKASSELSSSTSTANDGPTPASTGTDAPSAPASTPTSTLTPSDVPSGFPVGAYSLVTFLDTVSTDCTSNNATWTCAPYTDYYSDPQKALAIINWEITGSSGSYKISSKDTSDGYMTFQNAPLSLLDEGKDTERYRFQISRTKTVNMTGTIGDSKGNFECDYGATNLQAYLYTKMQRSYPDDTISVPDAPNPVWPYG

SEQ ID NO: 4601 - protein, 357 aa, Unknown
  Kingdom: Fungi, Phylum: Ascomycota
MVLITLLQLLATAAILSPVQAGHPAQAWREGKFKTLVTFGDSYTDENRLGYFIRNNYTAPPVGWDQPVGLATASGGLSWARYASIYSSAKLYNYAVSGAVCSNNITPRALSPTALFPDIEGYEIPAFIADSKYILPTTSKPFFTGKQDSTAYAIWIGTNDLGNNAFETKSQQPNKTVSDYIECVYKTVEGLYKNGGRYFVLLNLAPLELLPQYQLPSDGGLSATQFWPANGRNQTDVHYRMENTVAALNDVYEYRTPFIALTKKYPGAKFANYNVNGLMTDIHSNPAQYLNGSAPLNTTGTAKTCATVSGQNCTINASPDSFVWFDALHPGEQTSRIVAREFVNVISGNGKWGTYWG

SEQ ID NO: 4602 - protein, 432 aa, Unknown
  Kingdom: Fungi, Phylum: Ascomycota
MHFLNAVALLTIPFLTSAAPLENVKGSKGYQMGVFYVNWAIYGRQHFITDLPAEKLTKINYAFANVNRTTGEVFLSDEWADIQYAYPGDVASNGTQLLGNFNQLYKLKQQNRNLKVVLSVGGWSYRDNFKTALATNGTRHRFAESSLQLIADLGLDGLDVDWEYPEDDTDAANLVDTVKLCRSKFDDYAAKHANGYHFDLGISAPAGPRHYTVLPIAEMDPYLDLYNLMAFDYQGPGFSNFTGHLSNVYPSRANPVTTDFNTAQAIDYYKSQISSPRKIVLGMPLYGRSFANTNGLGQRFNGSGDGTWEAGVLDYKVLPLNGSTVYTDKKVIASWSYDNKTRQLVSFDTPEVQKLKTKYLQKEKLGGAWWWDSSSDRKDDKSLISTVGKALGGVKALQQNTNNLYYPLSKYDNVRGAVPNATVAHLTLSIGL

SEQ ID NO: 4603 - protein, 1330 aa, Unknown
  Kingdom: Fungi, Phylum: Ascomycota
MRSFTVLLAAASFFDLSIAGYALEDDYMTDFYGAFDFFTDSDPTNGFVKYVDEATARQSNLINASTTVPVEWGVDSTNETPEGRPSIRLVSKKKYNAGLVVMDVAHMPTGCGTWPAFWMVGPDWPTGGEIDILEGVNEQTHNGMTLHTSPNCTIGPDTSLFAGGVTTPNCDVNAEGQGKNVGCSIEHPNKNSFGVGLNEIGGGVYATQWTNEAISVWYFPRGSIPEDALGDTPSPEGWGIPAAKFTGGCDIENMFKEQQIIFNTAFCGDWAGAVWESGSCAKKAATCDEYVQNNPEAFKDAYWTINALKVYQDNGNDSPAPSTSGAPAQSTIISEPVSVPTGNATEPAISSGYATIPTEIPTGAPVLSFSDGSYIAPTIPASEEVPAETSAPVAEPTPSRGIPTSEVLEPSKTQDISDSPAATTSTVTTPTKPADPVGDDGMPGFQWPQGTGGSVSNATQTAVAPAEPTAAPSGNMSLPVEDLPSTAETPAQPTNNPDDESPPVVPTDTESAPGAPVVTDIVGEQKTVYQTVYVTVTPGAEETPAPGLSRARAARYMREHRRRSVGHHARIRAISKSKYHIAGRSMSCPVRLHPLRKPKNHRLPVPRYTLSLPDSVDHVYISYIGVQQHSNDNGSTEAKNQLCQQIQSWFKSNNCPSAYESFALIDGREASGTTVWVGYWTDAAQYSRALKTLQLQIIYSRQPEENKSNIGLWHESFKTSVSRLETNYSGLDYLPGLGQIPDSSAAEHDLATYWGAARDRIPDSAHDLFPRPSFEADRPSEDPVGLGQHLTGTSHHNLVHIRSGQWWENCDEIETGAYEGKLEPTLRKGLQYLNDNAAETGAMGLRYLRNTDVNNPLVDYSRKETCGAGFFANLEDLENWAKTHSSHLAIWRGAMAHYKAFPDNRMFRTWHEVSVIKEGDAKFEYINCTADTGVMGSTQLQVHDLNVKPRPFYLHWPLMRHAPFGPNPEESYTYKSAKQPAKFTKANHSIMSRPKVLIVGCGAVGLSQGYHLSAGADITYLVRPGRRPAFEPPKCLYSYKDDELYTFSSYRVIESVSEVSGETFEFVFDTLDGHTARSENGVTTLRSVGDLINEPQNTDTFLLYDAIGLDIEDHYTRTLRIAPTRLFLAASMLAHQPTPHITIPDSANKDLIAKADLLYSHTPPNIGLMVSNAHPALISRVEAVYNANGKLSIRRVPAFVLPWATMLAMLHLVTWNIDGFGPFPRLRANSELWALMLRAQSEILQLPRFGWTGWVLSFMLGSWVTGKMNEPLLEGARPLSYEKFNAFHHGGKVAKQDVGTLEDLLRDGEAAGRKMEALREVIRRARKIHF

SEQ ID NO: 4604 - protein, 635 aa, Unknown
  Kingdom: Fungi, Phylum: Ascomycota
MPVNRHFRRYSAPASPFKATTAPGRPQSSWSPPRRKPGRASFATHTVIGAIVVLLALFFQVFAPHFPLAVLRFFTKDHHWHVSSPGITLRNPVLFHEPPICPKPEQTVEFAGTFNTRPKRSMALAEQAKRVAAEFDFSDDGLNKAVKEFIREMDEGLQQEGTELSQIPTYVTAGLYMAVDLGGTNFRVCSIQLHGNTTFSLTQSKVAVPHELMTAKTSKELFSFLAKQIEKFLQAHHEDHYEGTLKRRQTGGKAEEIFNLGFTFSFPVNQVGINKGLLMRWTKGFDIQDAVGKDVCALLQAEIDELHLPVKVAALVNDTVGTLMARSYASPGKTGTLLGAIFGTGTNGAYVEKLDKVTKLTQAKNVGEFDKSTGEMIVNTEWGSFDNSLRTLPNTPYDVELDEKSVNPGIQMFEKRVSGMFLGELLRLALLKLIKDSKVPLFQDDNSSSNDIHSTTQIAHDSPIYKQWGIDTSFLSICAGDTSAGYRVIRQTLDKDYGVSAASTEDAEAVKVIAGAIGRRAARLSAVAIGAIIINTGRLDKSKGTATTEDKAGIDPPRGDVKVNEDDVVDVGVDGSLVEFYPDFEEHIREALRAVPEVGSHGEKHIRIGIAKDGSGVGAALIALVAGQVPEPQTE

SEQ ID NO: 4605 - protein, 251 aa, Unknown
  Kingdom: Fungi, Phylum: Ascomycota
MHLTTTLAGLISLTTATNLPSPQRLFTNTDQHGAGFTIPTVHESAVQARRILRLESIGTLSTIFPTTSHHATEDRPSVDGAPIGLMDYFGDCEPDTGNPTILAITIATSFKNVDAGSNITLSMRWHPQDNVWRSPAALPRFSLVGHLEEISADEASTASLSTCFIKYHPDAAWWLPGNRIHRSKWVRLVVDEVYWIGGFGDRAYIGWIPTKEWYSVTHEEIEAVRLPGEKKSGWASWKSLIGLGDDESLEL

SEQ ID NO: 4606 - protein, 902 aa, Unknown
  Kingdom: Fungi, Phylum: Ascomycota
MRYALIFAGVAAAYDAYGYNGYGEDKASSSTPAVHYSSSNPAYGGYGDEHKTSSAPAPSKSSTSSKIGYTTITPGYGKQPVTVTSQYQPYPTCGAAGSDGKSCDQWKEDKYVSTVLTDYNSKKVTVTEVEKPITCYHTKTTITHYPTASTSAGYGGNAYPTGSYGSDDHKNNTKPWYEMYEKVHEIKYKDLGAHGLPGYGGSGLCKSCDDEQPYKVKEYKDGKWNEYETTAIYKAPTPDVKTYEKPGVYTEPAKDVTVSYTMTKPSEATITAKAGVPVTYGGVTTDFKETGVKTCAYGAYETGKDNNGNDVTSTIVKTITVTVSTTGKYEVAKPTTTVYEHDTDVVYPTISVYKPGVYHKDAQTVTITKAGETASCEYKQTKTYPAKPEKTPTKDNEYPHGSSSSSKPSVETKTEHKPDHPVSSPYVSKSSTKSDDKYPATSSAPYYPGYPASSSTPVYDSHKSSSTPCSSSSSKPVVETKTESEEYPVSTPVYGNEYPHNSYSSSVPSVNTKTSSAPYYPATLSTPVYDTAKSSSTPCSSSSTKPVEETKTKSDEYPTSTPVYDEYEHSYSSSGPSVDTKTSSAPDYPATLSTPVYDTAKSSSTPCSSSSTKPVEETKTKSEEYPTSTPVYGDNTSSSAPSYPATTTVPHYESGSSTPCPSSTIPGYDHKSSDYPKVPVASSSVPDYDDYKSPDYPEVPVASSTTPAYDAYATPTPAAYEDSNKFSYAATPSQTTDAYPEPSSAYPDEKKDNSYESGGYSKRAGAVQRRQAAVIKRSNNYAKTAPERLPFATLRIQDHGPISPERIRQLETIRKTHVPRYLFRTFTPASGGGQHLAINNEHEIIPHGLMDGKKLDFYGMSEAELWNLYLCHQGGGTQPLTLCTSSAASLFSVLCYATYLAE

SEQ ID NO: 4607 - protein, 537 aa, Unknown
  Kingdom: Fungi, Phylum: Ascomycota
MSIRRAVTALSLCAAALTAPTTKRAVDFNWGSETIRGVNIGGWLVLEPWITPSVFDKANEGRPQRDIIDEYTLGEKLGRDAAIKVLRKHWDTFATWQDFKRIKDAGFNIVRIPVGYWAYDTFDSPYVAGARVYVDAAIDWARSLDLKIMIDLHGAPGSQNGYDNSGQRLDVPQWQSGDTVKETLQVLKTISDKYAQPKYQDVIIGIQLLNEPAMYLDNISEDVTRQFHRDGFYQVRDTSDTTVILHDGFIRPNEWNGFLTPSDNNAQNVAMDHHEYQVFNNDLIQLKPSQHNHKVCDLADAYGGADKWTFVGEWSGAMTDCTKYLNGLGRGARYNGTYLGSAYQGDCSFANDFSKWDQTRKDDVRKYIETQIHAFETKTQGWVFWNFKTENAYEWDALALVDAGVFPAIRNGRVEYKFPKALPALHSDDPADEIVVLQYTANPLTQHAHKRDPAQTATSHDAALTYPCRHSGYAFPPSFAQPFYLTTPKIPLLLFAAPNTPERHITAFSLPPRTPSYDEHPSFAARLATEIDLRPTH

SEQ ID NO: 4608 - protein, 622 aa, Unknown
  Kingdom: Fungi, Phylum: Ascomycota
MRSSTRFAVALQLLGVSAALPSSDLAEIEARASNTYDYVIVGGGITGLVVANRLTEDKKKSVLVIEAGGAYDTPNIRMPFGATYDLDPSLIWPDYMGQPEPGLNNRTWNTPVARVLGGGSVINGMMYDRGSAADYDAWEALGNKGWGWEGLLPFFRKGTEFIPPPQELVDEFNITWDPTAYGKGPLKLGISDFQYPDVKSYFAAYAGHGARRLLDGNNGDNAGTSWYPNTFNPKTGEREHARLAYYESVADRKNLHTLLETVADELVFDLNSSKRLVARGVKVTDRKTGQKKTVYAKREVVLAAGAINTPKLLQLSGIGPKSVLKAAGIPVKLEHDGVGSNFQDHPYLFMSFNISNLSTPNPTSLSTDPAFNASAYAEYAANKTGPLTQARGNSIAFIPLTEVTPSGHTNISSQATKQDNEAYLPAIYKGNKKLLAGIAAQRKVLAKLYSNAKAGIVEYGIPSAGSGILVALQKPMSRGSVAINPANPQGTPMILYNAMTNPLDKSMLAACVRYIRQVWARPELDQFSLVETTPGTQYQTDAEIMDRVLELGSLSPSLAHPSGSCPMMPEKLGGCVSDKLLFYGVEKLSIVDASIIPLVPSQHIQSTMYAIGEKAGHMISNR

SEQ ID NO: 4609 - protein, 405 aa, Unknown
  Kingdom: Fungi, Phylum: Ascomycota
MYLSFTAAILAVAGSAAALPQNPAPAQGTSLPSNVDLPPALPADDFKTPKFARPLSLDEALSGVNATVTTIVENLQDAKNKLPELLLDPNHPSKKILTDLLPDVVPSNLPITPRELDDELEKFEKRQATCSNPRIRREWDSYSNSDRQAYVDAIRCLQSRPASGQFRQSQSRYEDLVALHQTLTPNVHGNAKFLLWHRYYLWTFEQMLRSDCGFNRELPWFDETRYAGRFGASSIFSAQWFGSVNIGGACVTNGQFAGLAINVGPGPGNQRHCLARNGDDSRTRNTDNRIVDACNSRTSYPDMASCAEGGAHAWGHNGIGSVMQDTYASPADPVFFLHHAFIDRNFRIWQNNGGNARVTQISGTDSQGSQLRLDTTVNVYDFRPTVRIRDILNTQSTTLCYKYNY

SEQ ID NO: 4610 - protein, 398 aa, Unknown
  Kingdom: Fungi, Phylum: Ascomycota
MKFALASVAFGLGANALVAREVSQCVQLKASGGQSGILGQLDDGQNRIGGGHPQGCYCLSNGAFTDSKGRGCILTPPTTQFQCDVGATGTSGFAIGSSGSVTYNGNNKFYACPATDSEYNVYTTPVKGQDKCVEISLASGGSCGAGSGQSSAPAASQPAKSTAAPKPSQPAPKPSQPAQSQPAPKPSQPAQSYPAQSQPAPKPSQPAPKPSQPAPKPSQPMQSAPAPQPSAPAQSGNKCPTDLNGSYQFPHLIIPVDSQQPSKAFGTSYNGKVNSHTCSIFNFDIPQLYSGKTCSTVFLFPQQKDLETSSFTVSGSGKVSFTQLQSAANQQTSYSNQPGKKSDLASMSVAPGNSYSIASGECAAGQTVSYEICSEGDFDLEYFQDYNPSPIGLYVRQC

SEQ ID NO: 4611 - protein, 588 aa, Unknown
  Kingdom: Fungi, Phylum: Ascomycota
MYKYDNGRPWDQPSFPSPELIGSKQSTMGAIARAWKWSVLSCLLSTIASATEPTVKVLNGTYEGLYLSGFDQDLFLGVPYAQNTGGQNRFLIPQSLNSIWNGTRSAKQYGHACPDPQPERDGEFGMSEDCLSINIVRPAGLSLNESAKLPVAVWIHGGSYQVGTSALPNYNLTYLVQKSVEIGNPIIATSINYRKGGWGMMYSREIQGTGNANLALRDMRKGLAWISENIGAFGGDKDSVTIWGESAGSFAVGQLLMSYGGRTDGLFHRSIQESGSAATAWYNGSDWYQPIYDNIVDKTNCSDLPDTLACLRTVPYETLLPLLAMPIQGPGWYPTVDGDIIPNFPTELLHSGRFAHIPHLYGSNTDEGTDNAPAGGVINTTQQLYDFVKGSTGFGFPDAVVTRLLELYPDDPTQGIPLNTGEERFTEQGYQYKRIAAIMGDVFYHATRLDDARQYAKYAPTYIYRFNTRPWQASATNSFEGGLAPAYKGVQHFSETQFLFANPAFYGPWPEYKALSDVMSAQWVNFIAGGDPNGEGLPRWPKYSESDKGANLVIQATGRGQNGSFVEEDTWRLEGREFLIEWARRRHV

SEQ ID NO: 4612 - protein, 576 aa, Unknown
  Kingdom: Fungi, Phylum: Ascomycota
MFSRSLIVLASAGAAVAQLTPECEHVTDLTALLEGDDGKAYCSSVLNIGTATQTIVESITTTETSTITTPSQITLSFTTTQTDTISEGTVTETAPTVTATSTNFETTTVYSCPTAFKRRDNGEAQSTSCKGKTTSTPTSTSTSCTKSKTSVTRTPAKTSTSCTKSQQYATSVAAHGAGQPAYSQGAVSSAQGGHYAPGASQAAYSQGPSQPSVSSAQEGYYAPGSSQAAYQTGVAPQPYPSVATGYYQNASSLGYASSTEVSHSSVYYDLYPESAAEAYPVTSSIYKQISSLISSFSAYPTASSSVEIPDVSSSFSSYYSIDITSSESSSPIPTPTPTPSCEAAPSAVRTGYECDTMSIACGCLGLASATAQVTTTTTLTEAAFVTEALLLTTTTQPTETVFTTVPATTETITPSATIIATATQTASVCPCTATQSLCGTTPDTCRDLQTDPNNCGVCGNVCGSGACAAGKCLPCVPRKCGTFGQGRCNNAGTCYCLTGSTGSSLCADIGNGNCQSYAKCSADANCGAGEICTTDTCCGFGICVKANVCGNAQSAKRMFTPRGKGTLGRNEVLGLF

SEQ ID NO: 4613 - protein, 516 aa, Unknown
  Kingdom: Fungi, Phylum: Ascomycota
MLLTISTTLLALPFANVIAKPTYGAQNNTPAPVNVTTCNGKTYTYSALAGYGKLASDARDKFGDTIGGIGSAIALDKKSWKSKKGKKEAYTGVMYGLPDRGWNTGGTQNTQSRIHKFSFDFEIVEATVEKPASPNFKLTYLDTLLLTGPDGTPLTGLDPTTTVTYKGFPNLPFAEYTGDGFGNNGTGGSRVSLDTEGLVLGDDDTYWISDEYAAYVYQFDKKGKMIQTVRTPSSFIPLRNGTESFSAASPPIYDQDFEVNPEDPSTGRANNQGLEALTASPDGKHLYTMLQSAAIQDGGSKSSTRRNTRLLKYRVSSKAVKLEAEYAVQLPVLSTGRIAGQSEMHYISETQFLVLARDSGAGHGQESSESIYRNADVIDISQATNIKGEYDGFNEQIASNKGALKSEIVPATYCPWLSYNVNSQLNRFGVRNGGAQDANLLNEKWESFALGPVDNDYQTKGEGKEYYLISFSDNDFITQNGYINFGKQGYRDSTGYNLDSQVLVFKVRLPKGAKPL

SEQ ID NO: 4614 - protein, 478 aa, Unknown
  Kingdom: Fungi, Phylum: Ascomycota
MKYALCTALVLQSTVALSELLPVHFKAPTTAHFRDIVRNDTYDFGCRPIAHPTDDGHFTLHALLTEDQITHLTKEYESINEITIHRQMVKRAATAPIGTGDRFKAGTVSPVGLGTQASSATISSLMNVNEINSAFNALVKNYGIGSITLPYKTFNGATSYAGFVGAGTDKSAYRLYLSAGVHARERGGPDQLLYWISDLLAANKAGTGLTYGRKTYTNAQVKSVLAAGIVFFPLVNPDGVRYDQSSGSLWRKNRNTRSGSSGSSIGVDLNRNFDFLWNFRKYFDASESPASTSPSSETFYGTAAASEAETKNHVSIYDSFPKIRWFMDIHSAAGDILYSWGDDDAQTTTSTMNFQNSAYDGKRGVTGDSVYKEYIPATDNTNIKNVAAKTVAAMRAVGGRSYVAGPSVGLYPTSGASDDYAFSRFWAKPGSNKVYGYTMEFGYSTNFYPTLSEFNQNILDTNAGFMDWALAAISVGLN

SEQ ID NO: 4615 - protein, 900 aa, Unknown
  Kingdom: Fungi, Phylum: Ascomycota
MILKSLVTLVACARFALTAPYPHDASSLLSPRAANISACPGYTANNIDVTDSGLTADLTLAGAACNVYSEDLQELKLVVEHQADDRLHVKIYDAGLNVFQVQEDVLPRPSNDKTASADSAVRFDITAEPFSFKVTRTSNNEIIFDTTGTPLIFEKQYVRLRTNLPKDPNLYGLGEHSDSFRFHTKSYRRSLWNSESINIPNNANLYGSHPVYFEHRGDKGTHGVFLLNSSPMNIDINEDDAGDQYLEYNTVGGVLDFYFLAGPGPADVSKQYADVVGYSAMYPYWTLGFHQCKYGYWDVNMVAEVVTNYSAAGIPLEVMWTDIDYMDARQDFTLDPERFPLAKMRELVSTLHSRDQRYVLILDPGVRAFEEVAAYKSGHDLDIFLKTEDGTDLLGVQWPGAVAWPDWYHPNAQKWWTEEILNFFDADSGVDIDGIWVDMNEASNFCRDTNCRPREKAIEDGIPPKPANGPRPNTGRPIPGFPASFQPTSSKRDVEARQAMGQMKGFADREWFNPAYKVYNHIGDLTTLTIYTNTSNYDGTRQYDTHNLYGHMMAMTTQNSMVERRPEVRPFVLTRSTWAGTGRKVAHWFGDNASDWEHYRTSIRQMLSFVAMHQMPFVGSDVCGFNGNTNENLCARWAMLGAFQPFYRNHAEISTMQQEFYQWPSVTEAAKKAIDTRYKLLDYIYTALHYQTTTGAPMINPLFFLYPADTNTFAIQEQWFYGDSLLISPVTTDYSDTVTYYLPADVFYNYWTLEKVTGTGANVTESNLTTSDIPVHIRGGSIIPVRTNSANTTRALRKEDFSILVAPDANGSAKGRLYLDEGERIEQPEVSEIEFSFQDGKFTATGEFGYKGAEGESVTVARVVVLGQEKAGETGVFDAQKGTVEVQGPWVLERGFEFQL

SEQ ID NO: 4616 - protein, 978 aa, Unknown
  Kingdom: Fungi, Phylum: Ascomycota
MVPYESHELRRGKYARLDAPTDDDLEPTPTRFSSESNATLEDLEEHDPLAFDSKLKRKKSAGDLKVRKASHKDAEAAVAIPYARKKFSPGRCCCWLLTFVAATVLLLAAGGIWAYKASVPQDGLSPPWYPSPKGGADPAWEESYKKAAELVKQMTLVEKVNITTGTGWSMDMCVGNNGAVPRLNFPQLCLQDGPLGIRFADNITAFPAGITVGATWNKELMYQRGKAHAKEARLKGVNVLLGPTMGPIGRLPAGGRNWEGFGSDPVLQGIAAAQTIKGIQDEGVMATAKHWVGNEQEHFRQAWEWGIPNALSSNIDDRALHEIYAWPFADSIKAGVVSVMCSYNQVNSSYACANSKLLNGVLKDELGFQGFVQSDWLAQRSGVASALAGLDMSMPGDGLRWAKGDSLWGAKLTQAVLNGSVPIDRLDDMVTRVVASWYQVGQDKWSNDGPNFSSWTNDEVGKLHEGSPSDTSTGVVNKFVNPQGNHKEIVRKVAAEGTVLVKNEGNVLPLSRKGHRDGAESKRQTKLRVGVFGEDARLPHDGINKCPDQSCNDGTLASGWGSGAVDFPYLVDPMSAIRNAFDKDSVYVTDWLENKLPKQKEIVEDQDVCIVFVNSDAGEGYLKWKDVRGDRNDLSIQKNGNQLVKDVAKGCSKGKGDVIVVVHAVGPVILEEFIDIPNIKAVLIANLPGQESGNAIVDILFGDVNPSGHLPYTIPKKEEDFGPDSKVKYLPSPSDGLAPQQNFSEGIYIDYRYLDAHSVTPRYEFGFGLSYTTFTLSSLLIRSHHAKSPLPSSRPSGLTPPTYPTTLPDPKSALFPPNFHRIEKYIYPYLSSTDGTTFHAPAPVSPSPPSPAGGGPGGNPDLYTPFLTVSASVSNTGPRSGSAVVQLYISFPTDYRDPDTNEPIDFPVRVLRGFEKVFLEAGGQEHGKGGGREKVEFTVTRRDLSYWDMGRQNWVMPQGVFGVEIGFSSRDLPLKGTW

SEQ ID NO: 4617 - protein, 393 aa, Unknown
  Kingdom: Fungi, Phylum: Ascomycota
MRFSDLSLAVLSCASTTLAAKNHTKPSAYGQWMATSFLSKNQVIRHTYVPAVTLEGIQKVGAVNNNDELLEYARSAVSSLVSPNGTVKGYNDTYYTLDDIRMGNNVLHWWNEGGRNETKYEIAAHRYRDQLNRWPRTPTGGFWHRAPTYANQMWLDGIYMADTFYATYTSYFDNDNVTAWEDILTQYTLIEEHCRNATTNLLYHGYDETKSTVWADPVTGASPYVWNRAVGWYFVALVEVLQVYPKTLPGYATLSSYLTTLAEGVKNVQDATGGWWLLMDPELAGKEGNYIESSATALFTYSYFKGVRTGLLDAEYLDVANKAYELMIDHFIIYEKNGTLSWDGTVEVGSLKGDASYEYYTTVPLSLNDGKGAGPFMYAAAEFDLTQKNQTGY

SEQ ID NO: 4618 - protein, 476 aa, Unknown
  Kingdom: Fungi, Phylum: Ascomycota
MGRFAAVLAAISAIPMVAADDFNILRHVGGNGQWFPGPEVTGISSEIPDGCKVDLAAFFSRHGSRYPDNGAYNEWLSLYNHIQTAVNLTVSDKSLDFLKTWKPVLSDPTNQISQLSPTGYKELTEMGATWRLRYPDLYDYNTPFTMWANYYKSGPRVRDSARLFSHGFLGPNATDLGTIYALNSSDPTAWMNSLATSDLCTAYNDEGGSPYKNVWDNIYLPPIQSRLNAQIHGGFNFTQQEVGIIPYLCGFETQITGRRSPFCEIFTEEEALQYEYAQDLRYWYGNGLGSNIEKYNMLPVVEGLIQRFIDGPSATYTAGNGTFTPPKIIASFSNDGQINQLIAAIGVFDNEPQLPANTTMPERKFRASRLVPMRGTVAFERLSCPAASNGYPLSNSTNNAYVRVRLNDVAYAVANCTSGPGSSCPLSQYQNIIRSKLDKVGDFTKICNTTNSSFAARPTATFFKDNTLSYQTLIKP

SEQ ID NO: 4619 - protein, 469 aa, Unknown
  Kingdom: Fungi, Phylum: Ascomycota
MKASIVAASALVASVAAFEHKNHAGFHLRRAAYEPAPEEICTVYTTVYVHAVPSIVPNTTAIYEHSTPAAETSTSCTEEKTSSIYTPIVISTETPEPSQPPYPTVPAVPEISKPAVPEASKPAVPDVPVSEPSKEVPQPSKPATPEYPTAPVDTPKPAPSSSKAVDTPKPVPSSSKAVDKPKPTGGYSSGGRIVTNGNRWAMTYTPYAPDGNCKTEADIKADIKQIADLGFTTIRSYSTDCGVFEYVIPECEKYGLKIVYGIFLEAGGSGGKGPFSQYANDQLDDIKNNAPKDGVAMVIVGNECMFNNNCVPGELASYIDHVRETLQGAGFPKDIAITTTEPVGTWEEKGAELCSHIDVFTVQVHPYFTATISPDMAGDFAAQQLEQAAKVCPEAAAKGKYISEIGWPSAGNSNGLAVAGKAEQKEAMKKIIEKVGAESTLFSFKDDPWKHPGALGVEQHFGCADVLEY

SEQ ID NO: 4620 - protein, 526 aa, Unknown
  Kingdom: Fungi, Phylum: Ascomycota
MDLEWPTTGVVRKYHLEITNVTMAPDGFERPMSVFNGQYPGPTIEADWGDEIEVTVTNYLENNGTGVHWHGIRQLGSNEMDGTNGLTECPIVPGASKVYRFKATQYGTSWYHSHYSVQYGDGLIGPIVIHGPATGDYDIDLGVLPFTDWFHATTFTVNHATLHAKGPPTADNLLINGSMTSTAGGQYAVTTLTPGKIHRLRLVNMGINNWVHVGIDNHPFTVIAADFVPVEPFQATSLNIAVGQRYDVIINATQSVGNYWLRVGTGGRCDGPNANAANLGSIIRYAGAETANPNSTAAAPLPAGCYDEPIVPYVKTHVPQDVPEELKLTFTDTGGFNGSDLVQWKVNDVPMLIDFDKPTLQTVFEGFSDGHTWGQRESVFEVGDKGHAWQYWVIQQDNATAPPVPHPIHLHGHDFFVLGQQANTVWNGDISTLNMDNPIRRDTATLPALGYLVLAFESDNPGAWLMHCHIPFHISGGLGVQFVERKNEILKSNGQLGPMQQGCADWQKYHAEHWPNGILIDGDSGL

SEQ ID NO: 4621 - protein, 337 aa, Unknown
  Kingdom: Fungi, Phylum: Ascomycota
MFSKAIIATALLGVASAHQNFHQFWVNDQTPGYQVGIRMPPSNSPVEDVKSDDMACNVGGSKVPSGVETVAAAEGDTIKVQWDNSGHPGPITHFLFGPVDDASQATGIGAGWFKIDEQDQVDGKWANEIMQANNMTHEFKLPSGLPSGEYLLRSEMLALHGAQTVGGAQFYIGCAQLKITGTGSTGACGPTISLPGAYNAEDDNIYIPNVYNGFDASTYTAPGGPVVSCGGSGNASPAPTSGASNGTASAVPTPTATISASAVPTSAAATSAAATSAAAEELPIASSAAPTTESATSVAAETPVASATAPASGSGSGSALPEEFTLETFIAWLKEQA

SEQ ID NO: 4622 - protein, 256 aa, Unknown
  Kingdom: Fungi, Phylum: Ascomycota
MRSTTLTSLLAALSLTTAQQINIGAALDVPVPDLIIDPLATPPAITYNAASATSSIAAAAAAGETPTVLKRSVLARQSNGTCTPQALGAGPVPSPDTSMSFLSYKPFSEAAKNATTPSNYTAAFTDLHASTTAKTYLGVSELLVYDSANCTAQCDAKEGCNAVNLFFERTPTVVLGPDCRDPPSSTVIKCVFWGDAVTKTNTVNSGFTDNGFVVAIAGSNGYNKGQAAEDAKSGGRRVEVAAVMMAIVGAVMVVGF

SEQ ID NO: 4623 - protein, 1131 aa, Unknown
  Kingdom: Fungi, Phylum: Ascomycota
MDTLLTAEIYANSPRFRRRSSTFVDAIHDLPGKEEMAPAQLYSTESGRLFHSGRIVIATVGLPARGKTHTSVAVARYLRWLGVKTHVFHLGDYRRATLGPDQDVPEDYFFLNATPQSVLLRNKILKKCRDDIYHFLENEKGQVAIYDAVNAISQGRRSLAKEFAKKGIQTVFIESQCTDERIIQENVRRVKISSPDYKGWNDEDAVRDYLARINSRIPHFETMEEQDLHWIKMINAGERVHVNNCAFGYLSQRIVFYLLNLHIKSRQTYFARAGTTREEDSYKADAELSPAGHEYAKQMSDVLLKYREEERQKLIDQGAPDASLKPLTIWTSTRRRTVQTSEYLASMGYRVRQRSQMSQMNPGVCEKMSERKIREELPDEVTKHEADPYHHRYPRAESYHDLAVRMEPIILELEREENDLLIIAHESVLRVLYGYLMACNAADIPKLEFPRDEIIEIIPSSYNNVAKRIKIPNLPESMVPGSPEDIKIPVPPSGASGNVFTFSNHSGTYQLGPGSRISLDFGVEVGGWVSFNVDSANSANASTPQLSLAFAESPAFVRTISDDTGATPTQDWDQALNVTLSKGLTYYTTPKEKFRGGFRFLTINALSHVEVSNITCTIGFAPNTPNLRNYGGHFYTPNDDLLVRTWYAGAYTVQTNIAPKDTGRWLPQVRPGWAYNNSIGVSGPILVDGAKRDRAIWPGDLGIQGTTAFLSLGADGLESVYHALETLFYYQNATTGRFPFAGPATGSFRNGAQSDTYHAWSLIAMYNYAIWTSDLLWVETHWRNMTRGLDFILRGLENTVGLHEQTRTNDWARQGGGKYNSALNALDYHALASFANLASSLAADTGNATNLTSSLHTQATTWSTAANRLKTAYNTLLWDNTTSLYRDNTTTTLHPQDGNALALFYNLTTTPTQSAFLSKALTTFHGPIGPLTPELPDTISPFISSIEVLAHFAAHRPSRALNLTRTLWSYLLDSPLMTGSTLAEGLSANGSLYYRGNAGYKNDAAYTSLAHGWSTGPTVALTSYVGGLEIVGWRVWKFAPQSDGKVKQVDTAFDSPMGKFAVSWQIVEEVYETFGLEASFETPRGMNGSVDLGWDCEVLQVNGEVYAGGALEGSGVRLVKATGCAWGREDK

SEQ ID NO: 4624 - protein, 544 aa, Unknown
  Kingdom: Fungi, Phylum: Ascomycota
MKVATSALLIGAASAAIPQQQQVLKAPESFKGFDTSSWTKPLQNLEESLKSLTGEARAIWDEVAMMFPEQMEKAAFFSNPKPHMRKHDSEWDYVVKGADVQSVWVENENGEKERDIDGKLENYSLRAKAVDPSVLGVDKVKQYSGYLDDDEEDKHLFYWFFESRNDPKNDPVVLWLNGGPGCSSLTGLFMELGPASITKDQKIKHNDYSWNSNASVIFLDQPVNVGYSYSGGSVSNTVAAGKDVYALLTLFFKQFPEYSKQSFHISGESYAGHYIPVFASEILSHKKRNINLQSVLIGNGLTDGLTQYPEYRPMACGEGGWPAVLDESSCRSMDNALPRCLSLIENCYNSESVWSCVPASIYCNNAMIGPYQRTGQNVYDVRKPCGSNSLCYDELDWIQGYLNKKEVMKAVGAEVSNYESCNFDINRNFLLGGDWMKPFHRVVPGILKEIPVLVYAGDADYICNWLGNKAWTEALEWPGQKEYKKAEMKDFKIDGDGKKVGEVKSSGNFTFMRLHAGGHMVPYDQPEASLEMVNRWLAGDFWES

SEQ ID NO: 4625 - protein, 378 aa, Unknown
  Kingdom: Fungi, Phylum: Ascomycota
MFDYNGQKVRGVNTGGWFVLEPWITPSIFEGNSAKDEWTFTELLGKDAAKSRLQDHWNSWITQADFNRMAEVGLNHVRIPIGYWSVIPRDGDPYVQGAYDKLGEALDWASGAGLSVMIDLHGAPESQNGFDNSGKYGNVGWTQGDSVDHTIRVLNKIRDDYASHPAVSSIQLLNEPLGPNLDMNTVRQFYMDGWGNLKDSNVAVAFHDAFQGVTSWGDWGAGMWNLLLDTHHYEIFTLDAVAMSPDDHVRTACDFGNQMASTGKWTISGEWTGGITDCAKWLNGKDKGARYDGSFGGGSKIGDCTGKSTGTVAGLSEADRTNIGRFIEAQLDAYEKATGWIFWTWKTEGAPEWDMQALIDGGIFPQPLTARKYPGQCG

SEQ ID NO: 4626 - protein, 305 aa, Unknown
  Kingdom: Fungi, Phylum: Ascomycota
MYISALTLLLILSTTTSALNLFPRTTSCPKVWSEALPELQEAFSGCGRDAHGAIRAPFHDCINNGCDGSLILTDECSRAENAGLSDICGKLLSWTKKYNTSAADMIQFAAATAISLCPLGPRVQALIGRKDSSEAAPLNSMPGSRDPISSILEKFAAKGFSPDDVVALMGTHSVAVQVNDDPAQAGKSLDSTPSIYDLKFYQETLDGTAPYSLQSDKGLANDTETQKKWKQFADGDTSAWNTAFTDAWNRFAVIGNDVGSLQDCSNIIPSGASERRLARRMGVMCVETITIDIIAQLCEPPNLHQ

SEQ ID NO: 4627 - protein, 190 aa, Unknown
  Kingdom: Fungi, Phylum: Ascomycota
MDYQAPAPAAGGRGCYNCGDNSHRAAECPTKGTPTCYNCGEKGHVSRECTQPQAEKTCYRCGGTGHISRECTQAGGAPGGRAGGQECYKCGQQGHIARNCSQGGGSYGGGYGGRGGFGGQSQGGYGGARQTTCYSCGGFGHMSRDCTQGQKCYNCGEVGHLSRDCPQETSSERVCYRCKQPGHVQSACPN

SEQ ID NO: 4628 - protein, 249 aa, Unknown
  Kingdom: Fungi, Phylum: Ascomycota
MKFGASIAFLAASLFSAVRGDAVPWERIDKNNSLLLILDLQVGLYQLARDWDPTLYKENIMAHAELGKLFDLPVIMTTSADNGPNGPLPKEMIEMYPDAPLIRRQGEVNAWDNAEFRAAVEATGKKQIIVAGIVTDVCTAFLALSLRAEGYSVFANIEGSGTTTQLIRDTANSRMEKAGVQLVSLFAIVCDLMRDWRATPGAGEVLPFLDKYLPVYGMLARGHAAANENGTVIPGEAGLITGQNGTIVI

SEQ ID NO: 4629 - protein, 1513 aa, Unknown
  Kingdom: Fungi, Phylum: Ascomycota
  misc_feature (1432)..(1437): Xaa can be any naturally occurring amino acid
MATFLENAYSMVHQDNAADVPTDNELKTALEKGNDEQKIETMKKILAIMLNGDAKTGLLMHIIRFVMPSKSKPLKKLMYFFFEVCPKHDAQGKLRQEWILVWPFHASCADSANKIISTKLRDAELVEPLLQPVRQCLTHRHAYVRKNATFAIASIFTHLPELMPDAPDLLTTFLDDENDPTCKRNAFAALTSISHDKALEYLSTVFDAIPNHEELLLLAELEFIRRDAAVNPGNKAKYLRLIFDLLESQVSTVIYEAAHALTTLTSNPVAVKAAAGKFVELAVKEPDNNVKLIVLERVNQLREKNEGVLDDLTMEILRVLSSTDLDVRKKALHIAMEMISSRNVEEVVLLLKKELMKTVDEQYDKNSEYRSILISAIHQAAIKFPEVAASVVGSLMDFISDVSSNASAVDVISFVKEVVERFPDLRPSIIERLVSTLGEVRAGKVYRGVLWIIGEYALEVKDIQDAWKGIRSSLGEIPILASEQRLLDDASEGKEADDQVNGHTKAAAPTGSRKVLADGTYATESALTSSAAAKAKLDAVKNSQKPPLRQLVLDGDYYLATVLSSTLTKLVMRYSELSQNVARTNALRAEAMLIMISIIRVGQSQFVKTLIDEDSVDRIMSCVRSLSEFSQKKELETVFLEDTRKSFATMVQTEEKKRAAKEASERMKSAVNVDDSFSIRQLKKKDADGNDEIEQDLERATGGDTATEDLSSKLSRVVQLTGFSDPVYAEAYVKVHQFDIVLDVLLVNQTTETLQNLTVEFATLGDLKVVERPPTQNVGPHDFINLQSTIKVSSTDTGVIFGNVLYEGEKGVDSNVVILNDVHVDIMDYIKPAQCTETQFRTMWTEFEWENKVNINSKAKSLREFLKQLMACTNMSCLTPEASMKGDCQFLSANLYARSVFGEDALANLSIEKEGDNGPITGFVRIRKDLLAWTYLDNAHFKMHFRSAACAAVVLAFVALNEAAPTTIQASSNAGSPASDVFPPTSTEVNSSLFPPESVVGFPGPTPTGVEPNAIQTAPAYPYNENNQFSFPLVAPQPQGSDSQSKFDLTRYWGNLSPWYSLRSADYGLPDASPLIPDGCEITQVLLLYRHGARYPTSGAAPSTFAQKVANATKTGSLAFSGELSFLSDWTYKLGAELLTPFGRSQNFMLGVQSRQLYGHLLNNFTAAGKLPVFRTQSQDRMVKTAENFAAGFFGVPEYMDEVNIEVLVETPGLNNSGAPYEVCLNSNVPSKGSIGSTVAAKFAASAFNSTIARLQSHATGITFTATDAIAMLQLCSYETVALGYSAFCSLFSEQDFLNYEYFYDLTFYYNNGPGSPVSAAQGKGYLDEYLARFTGVYPSADSALNQTFDNSSTYFPLAQSIYADATHEVVVLDVLTAFNLTALFDGLPLSASGNRHENTFVASKLVPFATHFTTQVLECKDKTPSKQMRFXXXXXXPPPFDPHTSNTPSNDAVIPLNASHPGCPADADGLCAFDNVVSVLQRRSMEIDFKHDCLGNYTAGPGVDYNGRAPRG

SEQ ID NO: 4630 - protein, 1569 aa, Unknown
  Kingdom: Fungi, Phylum: Ascomycota
MRLSNGLISLLLQLGICIGAECKKPAPARQIIGGAPRVRLSQATVEGFLDAQNNTVFLGIPFADTTGGQNRWKAPQDVPKAKKHIVFNATKYGATCPQAISGTLFSQQDEDCLNLNVWAPAEGSNLPVFVYMYGGAMVTGSSSNPQLQGNNFARKGVVFVSFNTRESIFAYPNSAELQSTTSSQNFGILDVDKALEWVQKNIAAFGGNPDHVVFGGHSSGSVQVDHYLWNHPKTKLRGAVQMAANAKSGPAVAPVNQALDIVAAEVGCSTGAGQLECLRSVDVYDFQTENFNTTYNTWFTPVVDDITRHRDYESRFAAGRYASHVPLLTGNSDGEGAIFSLVYGAINTDFDAWLDTFEADSAHVPKDLLLAAYNASDYETVSQMSGQQYGDARFFCPVDYLQDLRSFKQDTWAYRFFGDYANVVGAPVSAPTHGTEIPFFFGGNECFDSVSDVTEAQQALADYQNDWFVSWIKNPSAGPGWEKVTPKSGTLAKLAVPGNELAIELSSTADYNGRCQSLTPTEEQTLVRHILDLDARGFAPRLSKVADISDQLLAARGGTPVGKNWAERFVSRTEQLKMAFNRAKDRQRIVQEHLELISLWFKLVQDTITQYGAYLDDVHNFNETGFQMGVIGSMKVVTGSGRRTRPDLILPGDHSYALTSTPPRNTLGVKNTKQYTRIRIAIKTRAETMLHENVIMKSRIHQLEEHIAVLTKRTSRKRKRIQHGGTMEYGAAALAVAETLHNFTLSPSSPFVTLDYGTEIAGFPFFSVSSLSGLVQIEVKYTEEFSGLLQPYADGPWTFSNGLSNTFRVETFNITSPGYVESFFVQGGQRRQTARLITNGSVTIDSVGVHLTSSNLDANKLPGYLSANKEIYSRVFNLGGRVVQAACIDAGNAPSTWEITTDGAYIRGQASAQSSLVITASNYTLEFDMNIVRGGAGWRVASAPQPLGPYFVLTSEYTEHNTFANTNRTLFPPNKLVLNSGWSLVNQTTLPTPANQYFPVSKTIKEDTWYRVTTTIESAGYRVYVDGEEIVFVPLPAPAEPGNFGTPSPYEGTWGFGGMQEHLTFYKDVTVTASNDSVLYSNPLTSEDTLAEHQVAPLDHSVCLDGGKRDRLVWAGDFYHTVRVLAQPSARFDYILGSIEYILSYQLDDGPYTGFVPISANLGSRPQYKEANIGNYRGLVDYQDLFLTGVGEYFRYTGNVRALSPYWGQIKKLAAARLAFIDPVSGLIAGSAQVASPFSFLGPANGTATTGLFAYMLSKITPLAQALSDEETSRLYSQTADKLREALNRELWKEELGTYALSTASMGNFSLTGIAWAILSGAANEIQTASSIAKLEELRFAAGYKIISSDKKTDDYELAPNPSGFLLKALFKSRRNFGTNSDVFYDAETVRSLCPERRGVQHISEGTDTTAITHLLENLWGSMVNNNGYYSGTSWEYVNPDGSPGLGLFTSLAHPWGAVPTHVLPEYLLGVVPTSLGYDSVLVAPLIGYLGLVDVNGRVPTPHGPIEVAWAINATVVDLIVGVPEGVRASLKLPSHASVEGKDSANKRLDISCGKTMLRFTLHQTSCKT

SEQ ID NO: 4631 - protein, 357 aa, Unknown
  Kingdom: Fungi, Phylum: Ascomycota
MHLKSSAVSATLWLAANAAPSCTSPNATIEFKHWPANASRALSTMIVKNANQSNYAVFDMDNTSYRYDLEESLLPFLENRGILTRDNLDSTLKLIDFKDLANFTETLYSYYLRLCEDDDFICYPWIAQVWSGFTLRELKGYVDELMALNSTIPTQYWDGDEVVNSAVNSPQVFRGQAELYNALMDNGIDVYVISAAHEELVRMVASDPKYGYNVPPQNVIGVTTMLVNSTSGFLTNARKQIVEGTYDPEANLDLILGPYLWTPATWFAGKWAAILTYIDQWKRPILAAGDTPGSDSYMLFHGVDTAKGGIHLWINRRDAYLERIQGEIRNNTAAQIANGREVTADKNWVFVKPADIL

SEQ ID NO: 4632 - protein, 870 aa, Unknown
  Kingdom: Fungi, Phylum: Ascomycota
  misc_feature (101)..(108): Xaa can be any naturally occurring amino acid
MKSLTQALAWVLVGSTFVAAQVAPVRELEVSHDGTCGNGVTCLGSSFGGCCGASGGCGSQLHSDTIVIDDIFSPRFRIITNRTLALAYTSLGDQFDYQGHXXXXXXXXSVKLSARQASGLFCPSSNGTVYTAANGAQYEVECGVDHFSNDIWWPGNGFVTDNLQKCLDECARWPNCKSVSWINQYRPGGPCYIKDAITMPPMYADHVQGAKLVKPCTDGCPTATPDLNQFPYATPSSTIVTSVSSSTQSSTTTPSSSISTEVSSMSSLASGTISFSSTQTLTATTIASSANLSASSRVSASALATTCAHGFPKRASETSAVFKREVVDENCIPCEGQGGSLPYCGGIATTNNYKFTPQTCRTVYYTLNISNVTIAPDGIERIALTANGQMPGPVIEANWGDTIVVTVNNMLQDNGTSIHWHGLRQGNNSEYDGVPAITQCPIAPGDSLTYTILAEHFGTSWWHSHYAIQAWEGVVGPMVIHGPTSKSWDVDAGTIFLQDWSHKTVDSMYDDAQDAVNGGPRTMDNGLINGKNTWGVQGTRNQTGERFELPVKFEPGKTYLLRLINGAIQSTYKFYIDGHELEVINMDFTNIVPYTTNILNIQIGQRYMVLVKANQPAGNYWMRADNQAACSRCTQGLDIKGIVRYAGADNATAAPTTTAYNYTTECVDEPLASLVPMAKVDAFPSDQRFKDDVTVAPNSENLFKWYLSGTTFYSRYEDPTLVRIVADDTAPTYSGNLILDLPDMGKWIYIIVQSAIPLNHPIHLHGHDSLILGAGPGVYTDQPLNMVNPPRRDTVNMPAAGWVAIAFETDNPGAWLMHCHIESMGFALQINEGQSMIKDTVKDKCALYDTCANWNKWVDMRGFKQHDSGV

SEQ ID NO: 4633 - protein, 229 aa, Unknown
  Kingdom: Fungi, Phylum: Ascomycota
MKVFTILPALLAAAFAAPTTPLTSAPLETRTLGLIAKLLGSKCPANTAQPDGKLPKGRSVSTSVLVPISTKNPTTAYPNSDWAKVTPGDFCTIFNLVIDSDATQGKVCNLVFDFPDYLQAPGDFIFFGSGKFTFTGYDINAGAVPGETTYAMQPRPGPSPPNPPPVMKPGNSYIINSAPCGIPPGIGPVTVSGSLCSKDTTFLFRQSQKTCPLGFYVVLTDNNGSSAPH

SEQ ID NO: 4634 - protein, 399 aa, Unknown
  Kingdom: Fungi, Phylum: Ascomycota
MPSTSTFFAVSAAVGCALAQRVPATAQIVDQRIFNVLQNVPPPSVANGSTLFVWPGVTEESLLAKPFHIYDEEFYDVIGSNPSLTQIASSESDPIFHEAVTWHPARDEVFFVQNAGAPAAGTGLNKSSIIQKISLADAEKVRNGTLVAAPVTIVNTSNPQVINPNGGTNYKGNIIFAGEGQGDNVASALYVMNPDAPYNTTTLIDNYFGRQFNSLNDLVVSPKNGDLYFTDTLYGYLQDFRPVPGLRNQVYRYNFETGAITVVADDFTLPNGITISPNGKKAYVTDTGIALGFYGRNFSSPASVYSFDVAKDGTWENRKTFAYLPSFIPDGVHTDSKGRVYTGAGDGVWVYNTSGKLIGKIYTGTVAANFQFAGKGRMIITGQTKLFYVTLAASGAPIQ

SEQ ID NO: 4635 - protein, 406 aa, Unknown
  Kingdom: Fungi, Phylum: Ascomycota
MKAFTYLSYVLLSLASISLAHPGMSETMAAVRREANKAKRAESKVLIGDLKTLKDSQLTPIGKDIKAILLDQLDAESNAIDTSVPPSLGSAACKADLCCVWKWISYEMAAKFNGTSGRCNKFARQAVRLGFHDAGVWSNTSSYGGADGSILLSDEISRADNNGLTAIADQTKAWYKKYSPYGVSMADLIQMGANVATVVCPLGPRIRSFVGRKDNPKAGPTGLLPGHLDSASTLIKLFAAKTIDAHDLVALVGAHTTSQQHFIDTSRDGDPQDSTPGVWDVKFYPETTGNAAPRVLKFQSDINLSKDPRSAGEWREFSSPSNGQQHWNEDYAKAYTRLSLLGVNNINELKECTKVLPPFRPTFSSEDQVILDMWLQGQFDQLNNLVDDAIMLTGVGGGGSGTIIIS

SEQ ID NO: 4636 - protein, 506 aa, Unknown
  Kingdom: Fungi, Phylum: Ascomycota
MIEADVGDTIVVNAKNSLGNQATSLHFHGMFQQGTAQSDGPVSLTQCAIQPGGSYTYTFIANPAGTHWYHSHNKGQYPDGLRGKMVIHDKAWESSLNINSQMTYTMSDWYHRQMPDIINDYMSPSNTNGDLPSPDSILFDDKKQAQNIQIAAGKRYLLRIVNVGALACGQFHIEGYKLNVVELDGVQVQSTQADTILICAGQSYGVVVEGKSSLLGLTANANFIVKLTTDMLTQNIPPASQITIIGNIVQSLVGSLLSIITNILTLDWRPAATFDDFNTKPLDGQRLLSPVDNNIELATNQTYYAGIGTRIGLGSQPWVPAKVPSLFTALSTGSAAMDPATYGPGVNPWVVKSGQVIQIHYQNTHPYPHPMHLHGHVFQIVARGSGSWNGNEGSLPSVPAKRDGVFVPANGYVVLRFKANNPGVWFFHCHIDLHLVGGMAATIIEAPDVLQGQQSISSASQGLCSASNSPSNGNCNGAQGSISASDAASKCNNVLNFKGPYSAVVR

SEQ ID NO: 4637 - protein, 750 aa, Unknown
  Kingdom: Fungi, Phylum: Ascomycota
MKVSQIVFATGLIGHATATWNMYGNPFKSPNYNDNECSERQKGGFDWADLKDGESNFNYGDFDFTGGWKCSNSFGKRDHLTRRTFGSKCIKNKVSKQKPASFGCDKRKSGFSITHIDVSVEYDVDLELHYHMEDGSKCKQVAPCKSSGSTIQNTQCGGAKSVDVYLPKHDKSDKECEIGFHNIGFDCNPGKGYNPPSPPEIPPVSSAPFISQPASSAPPSTTPSCNGEECNTQPPATSSAAPPCDGEECNTQPPATSSAAPPCNGENCGESTTPVTTAPATEVPSTDVPAPTPPATETPCGGYGEESCESSTAVTSAPATETPATSAPPATETPEAPCGGEGQDSCEGTTVVTSAPATETTPATSAPPATETPETPDTPDTPDTPDTPCGGYGQESCEGTTVVTSAPVETPILSTAAPFTNSSAPATTAPPTQETAPPASQPPVPESPSAPACDGSYGESCEETTAVVTPPASSSVILTTGVPQPSSPPAPPVSPPDVLPKCMNTWLEISGDCKNNADASCYCKNKDFTKNVIDCVSAWCGTDDETRDALQYLIGICAEHVPENPGLVTDCPTYIPLNPTPATPTAPAGGVSTPAGEVGSSTIVPGTTPAPEVPETTPAPEVPGTTPAPEVPSGGVTGEVPASTPCTTIIYGTTTLTIPQVHFTTQTNEANGAVPTNPVGLVQGTAPAQTPASTTGAPYPITGTTLATFKPTGTGAYSPTAPAEFTGAAAPFGLQAKHAVLGALLAFFAL

SEQ ID NO: 4638 - protein, 170 aa, Unknown
  Kingdom: Fungi, Phylum: Ascomycota
MASRFSVVRAARQITSAAAKRPSPFACQQLRQTAQMPRLFTVSAQLKEKKYTEDHEWIEASADGKTYTLGISEYAAKALGDVVYIELPELELEVGEGDAIGAVESVKSASDILTPVSGTVAEINKELENTPGNINKDPEGNGWIAKITVSEEPAGKLMSESEYKAFTEDA

SEQ ID NO: 4639 - protein, 260 aa, Unknown
  Kingdom: Fungi, Phylum: Ascomycota
MFTKASVVALFASIAAAQLHPAVGEPSGNPITRPLNEVVPACKAFTITWQPTTFNTVSLLLLRGPSTNVVPLQTLAEGINNSGTFSWTPASSLEADESRYGLQLIDDVTGQYQYSTQFGISKNDCAVVVSSSSAAPSSSSTPAGYGTESSSTPAGYPVASSSHVASSSVHSSSVAPYPTTVKTVATTSAAHVASTGAPGYNSTIVQPTGSLSVPSSLRPSATGAGNSTSSATLPESTGAAGSIKAGLSLVGAAAFAALML

SEQ ID NO: 4640 - protein, 390 aa, Unknown
  Kingdom: Fungi, Phylum: Ascomycota
MKFFAIAALASLAHLASAVGVVGKAEGFATGVTGGGNATPQYPKDIKELTSMLTDSTARVIVLDKTFDYTNSEGTVTGTACASWGTGSKCQRILLDSCSAGQVKETVTYYKAAKSPIKVGSNKTILGIGAKGIIKGKGLSFAGKNVIVQNIQVSDLNHKYVWGGDALSFAGADLIWIDHVTTARPGRQHYVFGFTPSTRITLSSNFINGASDFSTGCDGYHYWVFEMVGTSDSITMKNNYITKTAGRGPALSGKTLLHAVNNVWFDVKGHLLEGGDAGARGIFEGNVFNNVNNVVADYAGRLFGSPDANTNKLCSTALGRACQTNLFQGTTTTGNKLTSKKDTSFFNEFKGLGIASAKTTAEIATRVPNAAGIGKLSALAGRSASVKFRE

SEQ ID NO: 4641 - protein, 434 aa, Unknown
  Kingdom: Fungi, Phylum: Ascomycota
MLRSIAACALAGAMAVNAIATISVKGSKFFTSDGDQFYVKGIAYQLVPDDPLIDATQCGLDAALMKTIGTNSIRVYHVDPSADHTECMKAFADAGIYLWLDLDTFNTQIEQSAPKWNDTQRDAFAAVMDEFQQYDNLAGFFVGNEVLTTGNGSVAAPYVKAAARDLKAHRDAKNYRNIPIGYSAADIATLRPMLQNYLACGSNASEALDFFSLNAYSWCGDSSYQTSGYNMLEANSTDYNIPIFMSETGCNTVRPRTFQDQTAIYGEMADTWSGSIIYEWIEEANNYGLISYGSKVDPASPSAPPDGFPRSGTPTPVEPDFANLSSVWKNLSPTGVKESAYTPSNSAPECPPQTSGAWEVNPTSALPSLGQTYNAEVATPTASGSGKAGPSGTVSGSAGQASASSTGAASDGLSRELTGMGAGLVAVMAVFVWL

SEQ ID NO: 4642 - protein, 427 aa, Unknown
  Kingdom: Fungi, Phylum: Ascomycota
MQSRSDALGKYRGYSESQTLTLIGNFKMRCDVAFTALLASGATAAAVKKGFVTTKGTTFQLDGKDFYFAGSNAYYLPFFEQASDVEKGLTAAKKAGLNVMRTWGFNDRNRTTVPGGLPQYGGEGAGATPLILQWWDKGKAEINLAPFDKVVAAAEKTGVKLIVAFTNNWADYGGMDVYTTNLGFKYHDDFYREPKIRSAFKKYIKAIVQRYKDSSAIMAWELANEPRCGADGVRNLPRSTNCTPDTITEWIDEMSGYVKSLDKHHLVTWGGEGGFNIPSDDWAYNGADGGDFDKELALKNIDFGVFHSYPDWWSKTVPWTVQWIKDHAASGRKAKKPVVHEEYGWLTDDKRQEYLGRSDNQTRLEVIGLWQETSLKEKMSDMYWQFGYGGYSGGPNHNDGFTIYLEDAEAKELVFEHAKKVNALNRK

SEQ ID NO: 4643 - protein, 357 aa, Unknown
  Kingdom: Fungi, Phylum: Ascomycota
MKSFKSLLVLSAILPATIAIATPSSYSISNPSILSWKLKPTNTTQQLRGLSTVSQDVVWVSGTNSTVLLTTDGGTIWSNVSPSLSAENSTSFQFRDVAAFSEKAAVVLSIGEGNASRIYQTLDSGKNWKLTFINTEPTAFYDCMAFENKRHGLAMSDPVDGKFRLIETWDGGATWKIIPSHGMPAALTGEFGFAASGTCIEAAAGRWYIASGGVDPGRIFRSDDGYKWKVGNSSIAGGAAAGVFSVRFRDRKNGIAVGGDYEKPAGGVNNAAWSRDGGETWHKARTFPGGYRSGVSWVPGRTGIAVAVGTSGSDITYDAGKNWHTIGNGTFDAVECLSKSTCWASGSGGRVARLKLA

SEQ ID NO: 4644 - protein, 642 aa, Unknown
  Kingdom: Fungi, Phylum: Ascomycota
MFCRFAAADRLIEEPHSDKTHILQMEEIRAASGLLFAMHTHLLRSDMLQRAVTLTDIDYFLPPKPVASINGCDEIKASFVDEPFVPFTVVKGEGYGTLDLATITTKFAEQDDVWQEGFLDALYVSGGSIHNTSTTVITGTASGSLKPGPYFINAAGQVYEAWRLYSDVTGAFTESTIAKGDGSYTVLPAGTLGQKLAVAVPSRLYFEKTVEKPLAGVRVGIKDIYDIKGLRTSNGNRAWYWLYPPANNTATPVQNLIDAGAIIVGKMLTSQFANGETATADWVSYHESFNPRGDGYQDTSSSSAGGGAGTAAYSWLDVSLGSDTGGSVRGPSQVQGLFGNRPSHGLVTLEHTMPMAPVLDTAGLLARDPLIWKAAAQAMYGSNVTLSNNYPSTIKTLAWPTEASDIANGLLIDFLANVTDFLSANTSAYNITASWSSDNPTLEPLAKMMNLTYAILITKQQTPLVREPFLADYAAAHAGRTPFINPVPLARWGWGDNQTATLEEGIANKTTFMAWANSTFLAPSPQTCSESLVMYVGSTARTNYRNVYLDEPGVPLGWGNSRISIFSEAPDFVVPVGEAPYNSTITNHVEYLPVTANFMAAKGCDGMLFSLISDLYEAGIVKEALAGQSGITGGQTLYRRGM

SEQ ID NO: 4645 - protein, 168 aa, Unknown
  Kingdom: Fungi, Phylum: Ascomycota
MDAYKKAGNRKDEPPKHEMVHFAGLLSSKREFGDFRTVLHTGLYSQVVAMEVPVNGEIGDEVHTVDQILMFTSGRGLATVAGKDQEVKAGDVVVVPAGTQHQFVTRGDQPLELITVYAPGEHLPTSVHKTKEIGDKEEEDGIDEAPEWSQRSKKENEEKGLVNESGKY

SEQ ID NO: 4646 - protein, 1673 aa, Unknown
  Kingdom: Fungi, Phylum: Ascomycota
MSVEPEYHLKHTNVSRPQLSHSSSQRSIAASQAASEGYYSASEHNSSDSDDRKRLFQTPTTRSHEQLQTQHQAPVTSLRGVGIPRGQLQQPHAAHIQARPISTIAEERRSMDNRRRSNLDPDSQATTPGQDTTPYIRFAIDQLTRDEEVRGSRVYPEVRQYEEDYPVERIVSDDGLGYMAQEQETQRRMSQHMSPNSHRHSKRHSIPRKPVAAPQNVQFSSPAPAYESPARTRQQPQYYQHQTPAQAQAEPLLYDDPRAQYPQASAFSAEKDVFVAHDLEHLPLRFVPAILRPVWLGFFVFLCLLMLAGLIASAVLSLRDGGNGLWNYNSFGDERYFVFEYLPTLLGMIIFLWLLQIQTALQRIVPFLAMASDSFHRRSEAVFLELHPMQFLLPRIEHFRAGHAAIGTCYIIFWLFAWTIPLLAASFNVRYDLTNSVWRWVAVQGIIWTVVALYILLIVALIIVLITLRKPTGLRWDPRSIADIIALLERSNVMAEYEGSETFAKGDWDRLRNRADRIGYWSTSNRTNDIFYGIGEENGETRRFSLEDGRIREKIPDRTYPERAHNDRPGDFHIRTDIRSPAVRLRFLPWYLKDGAVIAYIVVGLILLIAFYAVSYVNSAVRLGFLPAVTARTNAAGFSTSNFLYSFVPAVIGHFLFLAILSLDYSRRVLRPYIALSSKGGATAETSLLLDYPCRLPLSVTLSALMNRHFATALLSFVSLASISIPILAGGCFWTQYYSTDDVVRVSADLPGYYALCFFLALYIVGLFALLPGRKRAALPHRSNNLAEIISWVYQSPILGDRAFNRPQTKPELVTRLMGTAYADRTFSQSVRSLVRGDSPTDPALAEKEQRRIGVPQRDSVMDPGAIRYGFGIFVGRDGLEHLGIDRRQRRERPTGLVIWEEQQGHLKLKRSKRKKSKHDRKHSNLGWHAPQKSWINNLGHVLNGTGTHGFVFNGSQLPAGVPYGTYNWCNMPHVRSQEYPRAGEDYELQADSTSIHRHHKRTPYASNTFPKESYGWSCDDQGLFYYGKPINPADNESSSTYWSVYTSETNPFAQTGFNGSCQFPQITRQGLDDSWQHGKDLYGVYHDLLGFLPNDLSDKVTYRVTNNQITSQVAGMLIDGMYAPQDDVPLRIQPTGVDSLEPQYSCPFASTRYSSYGVGSKASNWTAHLTVAKPLFDSLDSISGIAPNSTEWHKSFDHYYDNLSARQCHAKPLPCNINDPTSCVTQEQADTVYRLGQYEYSFIYRDAPQSLQAAVGSYGVWLAELAQNIRDVVAGKSEVIYRHNVAHDGSVSRLLSILQIEQMVWVGMGAEMVFEVYGSKKDGGKRFLRVLWGGQVMRSSSPVLGEIDMLDLDVFLAYVDGLVGDKAQKVVQFSHAKGHLLTGTFTPTSTASKLTSAPHFTTPSTPITVRFSSSTGLPQIPDTDPAANPRGIAIRFHLPSSAGKRQHTDIIAHSTPYFPTRTGGEFLEFLRAAGGPDKDAVPEFLGRHPETVRFLQAGKPSPVSFATEKFFGVNAFRFVRDGVVTTVRYRVVPLAAEAHLDGDALKAKSLTYLFDELPVRLGAGPIEFRLLAQIAGEGDVTDDATVIWPEEREIVELGTLRIEEILGEEESRAQQKHIIFDPIPRVEGVEVSDDPLLEVRANVYLASGLQRRSATGGDAVKAGLEDAVKATT

SEQ ID NO: 4647 - protein, 885 aa, Unknown
  Kingdom: Fungi, Phylum: Ascomycota
MASDRDILPSWAKPSHYAISLYDIEFGGKFGYKGTVSINAKIAKDDGFSELVLNAHQLKVHSAELKTGNATKSASNISYDEKRQRVTLDFGEKINYSGEAILEVKFEGTINNIMAGFYRSKYTPKGEVPASVAKDDEFYYMYSTQFEACDARRAFPCFDEPNLKATFDVEIEVPKDQVALSNMPEKEIKESKRDGFHTVAFETTPIMSTYLLAWAIGDFEYVEAFTERKYNGKSIPVRVYTTRGLKKQGEFALDNCHKIVDYFSEVFQIDYPLPKVDLLAVHEFSHGAMENWGLITYRTTAVLFDPETSADSYRNRVAYVVAHELAHQWFGNLVTMDWWSELWLNEGFATWVGWFAIDHLYPDWNVWGQFVTDSVQQAFALDALRTSHPIEVPVYDGLEVDQIFDHISYLKGSSVIRMLSAHLGEKVFLQGVADYLKAHQYSNATTNDLWSALSKASGQDVRSFMDFWVRKIGFPVVTVAEEPGQIGIRQQRFLLAGDVKPEEDSTVWWIPLGLHAGSSPATASVHETGALTQKEETIRNVEGSFYQLNKNLTGFYRTNYPPERLVKLGEARHELTVQDKIGIIGDAYANSIAGFGSTAGLLALVENFQDESDYLVWSQILTNIGNVRSVLSGSEDVSEALRKYHLKLVTPAVEKVGWEFKEGEGFLTGQLRAALILSAGLVGHKATVDEALKRFEDYTSGKDKSAIHPSLRRAVFGIAIKNGGEAAYKAVQNEYLSTSSIDGKEICLVTMGRVQTPQLAQDFLKFVFSDKVATQDKHSGTIALANNSKVRPEVWKYIRENWDQTVHPALSGNLVVLERFLRFSLNKFADENVADEIAAFFKDKDTRGYDKGLEVIDDTIRSYAKYAKRDEAKIREWLKANNYLS

SEQ ID NO: 4648 - protein, 517 aa, Unknown
  Kingdom: Fungi, Phylum: Ascomycota
MSAALSTYLRLLEESAAETVVPCFLLSSVLFAYNLASAEVEEPEDPLAAILHCLRLLRGVKVVIGQHWMELRQNDIIDKLLAPIEFIHHPLPEATVCPPVLELKQLAEHLDTPQKETCLEAIESLHETYVRTTLCSTVKQEHSLIMAWSALLSDEFLEVCHACNPVGALIIVHWVLTAALGLASSSDALKILMGNDDGFGSGNLRELYKLLKDAGHEVLVVAPAQQQSGKGGTVVWAESANLTIPSQYDIVPAGAPAVGRDPSDDDIWYYDGTPAACTFVALDWVLPRYYPSWHQTADLFVAGPNYGTNLGAFVMGLSGTVGSTFAAVSRSIPGIAVSASNKAIPYFNVTSASHPATLAARVSFEVVDEFIQNTAAGQAVLPLGYGINVNIPELVNGTTPPIVKTRITGNANTDVAVYNETTGLFDWENIDPVAAGINAAYNGDTSLPGETWVVAGGGVSVSVFTMDYSAPENKYTELVYGKVSSLFSDAAKTQYSKRMVDERMRKRGVMMTGRDAL

SEQ ID NO: 4649 - protein, 644 aa, Unknown
  Kingdom: Fungi, Phylum: Ascomycota
MSAIGIDLGTTYSCVGIFRDDRIEIIANDQGNRTTPSFVAFTDTERLIGDSAKNQVAMNPINTVFDQKRLIGRKFNDAEVQADMKHFPFKVIEKAGKPVIQVEFKGEEKTFTPEEISSMVLVKMRETAESYLGGTVNNAVVTVPAYFNDSQRQATKDAGLIAGLNVLRIINEPTAAAIAYGLDKKTEGERNVLIFDLGGGTFDVSLLTIEEGIFEVKSTAGDTHLGGEDFDNRLVNHFTNEFKRKHKKDLTSNARALRRLRTACERAKRTLSSSAQTSIEIDSLFEGIDFYTSITRARFEELCQDLFRSTMEPVERVLRDAKIDKSSVHEIVLVGGSTRIPKVQKMVSDFFNGKEPNKSINPDEAVAYGAAVQAAILSGDTSSKSTNEILLLDVAPLSLGIETAGGVMTALIKRNTTIPTKKSEVFSTFSDNQPGVLIQVYEGERARTKDNNLLGKFELTGIPPAPRGVPQIEVTFDVDANGIMNVSALEKGTGKTNKIVITNDKGRLSKEEIERMLAEAEKYKAEDEAEASRISAKNALESYAYSLRNTLSDSKVDEKLDAGDKEKLKAEIDKTVAWLDDNQTATKDEYESQQKELEGVANPIMMKFYGAGGEGGMPGGMPGGAPGGAPGAGGDDGPTVEEVD

SEQ ID NO: 4650 - protein, 234 aa, Unknown
  Kingdom: Fungi, Phylum: Ascomycota
MKLTLLSLALLSGALAAPAPVADPEAFPISEVPNGLSIEDHALSKRQYSSSTYNQLTDGTACRPISVIYARGTNQQGNVGDAAAVGPLFFNQIASRVGGTSQLAIQGITYPANVLGFLQGGDAAGSTTMTNLISRTATRCPNTKIVISGYSQGAQLVHNAAQRTSSANAAKVAAVVVFGDPKRGQSFGPIASSKVLTICHTGDNICEGGTSITPAHLNYQQDAGTAAAFVAARV

SEQ ID NO: 4651 - protein, 351 aa, Unknown
  Kingdom: Fungi, Phylum: Ascomycota
MKVPLALSLLPLVIASPTYPTSQKLKPAPGLADLAKKAGLKYFGTAIDNVVLDNKQYTKIAYNVSEFNQVTPANGQKWVNIEPTRNIFNWTLGDQIVIPSKKAGQLRRCHNFVWHQQLPTWLTSQKWSKAELLSILENHIKNEARHYYNDCYAWDVVNEAFNDNGTYRSDIWLDTLGPSYIEYAFKFAKKYVAPGTKLYYNDYNIETVNNKSLAVQTMVKDFQKRKIPIDGVGLQSHFVTGASPSYDQIRAAQQLFTSLGLETALTELDVRTQLPDSAALQATQAKDYAQSVKACVDEKRCVGVTVWDFWDPVSWVPSTFPGQGDATLYNEDFSRKPAYYAVADVLQAAAK

SEQ ID NO: 4652 - protein, 198 aa, Unknown
  Kingdom: Fungi, Phylum: Ascomycota
MAAPASANIKNLQGKWVMNKSISDPFDPVLALQGIGWLTRKTLGAATVTLHLKQHTAEDGTSTQISIDQLISGGLKGSSENRVLDWEYRSHSDWLFGNVKSRSRYTTLAAVREEAQGKGVTEEDAKYLTEGWLPENEEGGVIETFADNEGNKWTGWQIWGFAEIGGERRYVRRVVVRKSDKNEAQKVRLVYDYTGEVA

SEQ ID NO: 4653 - protein, 659 aa, Unknown
  Kingdom: Fungi, Phylum: Ascomycota
MKVYSISLLAGLAATATASYDNNINFKSPSFDHPSMGIDLPKVERRHFQKRDYNAIIDPSRLNFTHGVASGDPYPDSVILWTRISPQLENDRSNVTVAGTVPLYSHETESYVRASTSPICVDYQVSTNQNITGGVVSEGRVYTTSDIDYTVKVEAKGLSPYTTYYYRFNVCGTSKQSPIGRTKTSPTENDDTTELGLAVFSCSNYPSGYFNAYGNAARRDEVDYFVHLGDYIYETNSGVLGRDARATNPPRTIFTLYDYRTRIAQYRTDLDLTLAHQNFAWITTWDDHEVSNNGYRDGSSAVNNTESSFLRSGGVSVDQRKMNAVRAYFEWMPIRQVNLDDNLRIWRNFQMGKLFDLIVLDTRNYDRSITDLNWNTDYVTSIRNDAGRSLMGSNQENWFYRTLSESKERGASWRVIGNQIVFSRVNISSWFGSEEEPYNVDQWDGYTSNRNRTYQHLYGNQIDNTIMLAGDSHANWVSDLLWVDPESAPFASTNNGINIPPYNQATGEGAIGVEFAVTAVSSSGFSGNIATTNAQAQELIRDNPELMWNEGYFRGYLALYLNANEARAEYYGTPTVRTRNSYDIPLANFTVKAGANHLQRPIAGGTVNSGYLKNADEPGRVAGVNGTLALNTVTGLWGPVPNALLADGNYITYPRTNST

SEQ ID NO: 4654 - protein, 275 aa, Unknown
  Kingdom: Fungi, Phylum: Ascomycota
MSLKYFALALAAVAAAAPGSPFQALEAQASNDNPCEPCKPSGSTDGSAPAVGSDMSLLYNDVLNSVKGITFDKRGLTPRAESGFCCAKSLDCVNVQSLNIAMCYDKFTTNFKLADGSYGSLTTGDYTSSDGTNVNLLSGDYSGGNIYSAAPQDKPNTSSLSVPPQYTGTGVGAAIPASELGSIIVYTTTIPGTTFTAPTTVPGTVRAATVNGVEVSTSIAPQTITHATTVAPQTTVVTTQVPESASSQGGAGAVGYDSSKSFGVSVLGALMYFLV

SEQ ID NO: 4655 - protein, 735 aa, Unknown
  Kingdom: Fungi, Phylum: Ascomycota
MLAPFLLLASAPLGALANDVLKTNGYSSCLNGDSDIKVNKLDIQFDRTTKKIKFDVSGTNGKEQKVMATLKVNAYGKEVYSNTFDPCEGDMKVDQLCPVPAGTFGASGEQSIPDKFISQIPAIAFSVPDIDSQATMQLTAKDGGAELACITSQVSNGKSLSTAGVSYIAAGIAGAALAVGGLSALAGAGQAGVAHSSPTFGDVVFWFQGMALNGMMSADIPGVYRSWSKNFAFSTGLVYWEGMQTSIDNFREMTGGNLTTNSVKFLSNATLVHVDQNMTLTKRSFDGISDVLLWTRDELETNVNGTTDGSEDNKVIHAVKGIQGYVEEYKIPNGNTFMTVLLWFAIVIAAITVGILLLKVILETWALFGSFPKRLTSFRKKYWWTLAKTITNLILLLYGIWVLYCVYQFKNGDSWGPKVLAGVTLAAFTAILAFFTWKIWSIAHKYKKMEGDNSALYDDKEVWRKYSIFYENYKRSYWWIFVPAIIYAFARGCVIAGADGHGLAQAAGQLIVEALLLCVLLWARPYSLKSGNWINITIQVVRVLSVVCILVFVEELGMTQTTKTVTGLVLVVVQAVLTGVLAILIAVNAIIICCKENPHRKKRKEAEKARDLDNLTPLDARNSLLMDPQEYKRGSLPSPFGPRAAGYDAVPLAEQNTAYNNGRRFEEDRGHLLADASTFGRAPSHTPSYSDDHDRSVSPQPRLPDLDFGQQTGYTQPNNAPWQPQQRGNNGGYAY

SEQ ID NO: 4656 - protein, 231 aa, Unknown
  Kingdom: Fungi, Phylum: Ascomycota
MLCKTSFFLAGALALGALAVPIPDCPDNQNENIYNPPNADNKATTGSLTVDQLTQIAPLTVSCSDADFPEECADAIAAVPALNKSFDTYGIKTAGEKAALVAYTLFESVNYKYKKNHSPGRPGQGTRMMAMPNFIAQYATAVAGADAVATASAAGGDAGLEAVLALVNSEDDLSFGSAAWFYSTVCTEDVKAGVQAGTVDGWHNFLTACVGTTLAEERDTPWVAAKAVILA

SEQ ID NO: 4657 - protein, 617 aa, Unknown
  Kingdom: Fungi, Phylum: Ascomycota
MAPSSVWLTAFLAASTSAAPSLARKGLNVLIEADLEGVTSSVKNLFTQGSDTSPPSNESSRCKVYPGDAAWPSDEAWAQLNKLTGNRLLSRPTPLAAVCYPSHPDYDAEQCATYSATWTQSYTHMHNPIEMMSPVAQGMTCTAPVIFDSRNCTRGGFPAYVVNATEPKHVQLAVNFARKSGVRLIVKNTGHDFLGKSGGKDALSIWTHYMKDIEYIEEYADEELGYSGPAFKAGSGVQAFEIYKAADEKGRVVVGGEGETVGVMGGYIQGGGHSPLTGLYGTGADNVLAFEVVTADGEFVVANSTSHTDLFWALRGGGGSTFGVATSVTVKAHPDLPVTASRFSISSKQTGNETFWAAIRSYLDINVANADAGTYTYWMIIPSNGSFTFQFSPFFAPNKTLAEATALLQPWFNKLDSLNITYAPNLTYFDNYYSAWRSSFPLESVQKANVATGSRLFPRANFKTAEKRQELYEHIRSSSEKNRVQVHFNMQAKSDSDNAVNSHWRPLVSFSMQSVRWPLNSTAAEILKIRTDFQAIDMQKWRDISPGAGSYLAEADRLEPDFGQAFWGDKYPRLLELKSKLDPLDVFFATTGVGSERWRVESVDGLPNENGKLCRVE

SEQ ID NO: 4658 - protein, 743 aa, Unknown
  Kingdom: Fungi, Phylum: Ascomycota
MVKSGLIAALAAYAHLTQAACPFMEADTRDVPASHPQVKRQDGSYSVPSNTDDFMAQYEVNDTNVYMTSNTGTPIEDQESLSAGERGPTLLEDFVFREKIMHFDHERVPERAVHARGAGAHGVFQSYGDWSNITGASFLSAPNKETPVFIRFSTVAGSRGSADTVRDVHGFAVRFYTDEGNFDIVGNNIPVFFIQDAMKFPDLIHAVKPRPDNEIPQAATAHDEAWDFFSQQASTMHTLFWAMSGHGTIRSFRHTDGWGVHTFRFVTDEGKSKLVKFRFRTLQGKASLLWEEAQVTAGMNADHNRQDLFDSIEKSLFPEWVFEAQIFEEEDQLRWGFDVLDPTKIVPEDIVPFTPLGKLTLNRNPRNYFAETEQVMFQVGHVVRGIDFTEDPLLQGRLFSYLDTQLNRHNGPNFEQLPINQPRVPVHNNQRDGAGQMYIPLNTAAYTPNTLNSGSPKQATQKEGRGFFTAPNRSTGGRLVRSVSSTFADAWSQPRLFFNSLLPVEQQFVINAMRFETAQLKSDVVKNNVLIQLNRVSHDVAVRVAQAIGMTAPEADDTYYHDNTTIGVSVAEAPLLKIDGLRVGFLTSNSASRDAVSSLRAALDEVNVGFAVVAEHLGDGIDQTYSATSAVQFDAIIVDGSADALFVPPGNLANSNATTNTTSSWRSTLFPAGRPLQILQDGYKWGKPVGVFGSGGQIFSAAGVEAGTPGVYAFGANGTASVVDQLSEGLKTFKFLDRYPLDN

SEQ ID NO: 4659 - protein, 790 aa, Unknown
  Kingdom: Fungi, Phylum: Ascomycota
MQVLSIVLCLWAAVVQGAVIAPLPRTADEAFAGANAIVLDETLQPRAAADGYWLNDLSGKGIAPFNPNPAAYKVFRNVKDYGARGDGVTDDSDAINRAISDGNRCGPWVCDSSTDTPAVVYIPSGTYLISKPIVFYYMTQLIGNPRSLPVLKASPNLEALALIDASPYNNNDGSPGWTSTNLFMRQIRNLIIDGTAKAPTQGFQAIHWPASQATTIQNVKIRMTQASNSVHTGIFVENGSGGHMADLDIEGGLYGMNIGNQQFTMRNVKISKAVVGISQIWNWGWLYSGLSISECGTAFSMSNGASSGKLEVGSVVIIDSEITNCPTFVDQAWSRTTSPTGAGQLVIQNVRLNNVPVAVKGPNGATVLAGGSTTIATWGQGNQYTPNGPQKFRGPMSVAARPAGLLDNGKFYSKSKPQYETLGTSNFISARSSGATGDGNTDDTTAVQDAINQAVSQNKVLFFEHGVYRVTNTLEFPPGLRAVGETFSIIMGSGRNFADQNKPRPVVRIGKSGESGYIEWSDMIVQTQGATPGAKLIEYNLRTARGSGIWDVHTRIGGAKGTGQQLAQCPTGTIRPECFAAHTNVHITSSATGAYFENNWFWTADHDLDDWNSTRISIYTGRGLLVEGRGTWLWANGVEHHAVYQYQFNKASDVFAGFIQTETPYYMPTPDGLTQPYVRQPGYNDPIYTAGQRAWGFRAVDSTNILIYGGGLYSFFINDDVSCSSPDAPNGRRICQPQILSIEGSTSFQAFALSEVASEQMLTINGSDYALWSDNLANYPNTIGYIKVNI

SEQ ID NO: 4660 - protein, 418 aa, Unknown
  Kingdom: Fungi, Phylum: Ascomycota
MRFSSSLTFSLLAGTLSHALPAPQDEPTPTVSAAPSSVTFIEASADTAVAADQLDQLSQFAQRQVNATLAKNNSKRGGCNLFNVAIRREWNSLSKYEHKSYTDAVLCLQKKQTKTPASLIPGARSRYDDWVGTHINQTMTIHYTGTFLGWHRYFTWQYEQALRNECGYKGYQPYWNWGLTAFTGLERSDMLDGSEYSMSGNGEFIPGRGDVILGGNGLPEIPIPAGSGGGCVTSGPFKDMKVNLGPVALGLTNGSTISNGDGLSYNPRCLKRDLTNYTNQRWANASSIVSLILENQDIESFQMVMQGVPGSGNIGVHGGGHYSMGGDPGRDLYVSPGDPLFYLHHGMIDRTWWIWQQLDKKTRQSEKGISGTNTFLNNPPSANTTLDTPIDLGFAAGPPVTMNDLMSTTEGPLCYIYL

SEQ ID NO: 4661 - protein, 608 aa, Unknown
  Kingdom: Fungi, Phylum: Ascomycota
MHSYNSLLVAVAGLATSAIAQDASSAVSAASSAVSSVALGIASSASAAASGTAATSATSTFSQSNVPTGTPLPGNYGGVYRPQVHFSPPQGFMNDPNGMFVDAEGVYHLYYQYNPTANVAGEQHWGHATSTDLFTWVNQQIALFPGSEDEGVFSGSAVIDANNTSGMFPNQTNGVVAIYTINTPQQQTQDIAFSYDGGYTFEKYENNPVIRPGGTNPTQFRDPKVIWYEPTESWVMVIAYPIDFEVGIFTSPNLIDWTPTSNFSRYGLSGLQYECPNMVEINVQNATDGEPESRWAMTISINPGAPLGGSVTEYFLGDFNGTHFIPDDALTRLTDIAKDNYAGQFFYGIPSDQDQISMAWASNWQYTNVVPTAGQKLGDGFRSAMSVARGHYIKNLPRQGLTMVQYPANLDAVIDSELASNSSLGNGTLLVDYSQVESGALYFEANITGVSGGDSLDGTLNFTALSSVSGESVSGGMILPGDPVIWMDRGKTSGFENPFFTDKFSYGVVYDPNGDGALRLSGIIDRSIIELFFNGGEAAATSVFFPTRPLDTLIVQAAGLNETLTSSVAVWSLKAAWLDQADSNDTVLGNVTTGGNSTSSSKRSIELF

SEQ ID NO: 4662 - protein, 176 aa, Unknown
  Kingdom: Fungi, Phylum: Ascomycota
MTLQTPATDATAPLFSSELISPEVLKALPEGYTCRPIQRQDYHNGFLDVLRVLTTVGDVSEEAWNERYTWMSSRNDEYYLIAILDASSRIVGTGALIVERKFIHQLGLVGHIEDIAVAKDQQGKKLGLRIIQALDFVAEKVGCYKTILDCSEANEGFYVKCGFKRAGLEMAHYYGR

SEQ ID NO: 4663 - protein, 432 aa, Unknown
  Kingdom: Fungi, Phylum: Ascomycota
MLVAIAHNLLTHADSIKQAAKALSANMRSYYTGDRVGDTPGNLPDPYYWWECGAMFNALIDYWYYTGDDQYNAITTQAMEHQIGDYNAFMPPNQTKTLGNDDQAFWGMAAMSAAENKLPDLGDGKPSWLALAQAVFNTQKDRWDNKTCGGGLKWQIFTFNNGYNYKNTISNGCFFNIAARLYKYLGNDTYADWAEQAWEWELAVGLMSQDYHFYDGTDDNQNCSSVNHIQWTYNAGVHMAGAAAMWNVTQNDLWRTRLKGLIDGAGVFFKNNVMTEVACENNGKCDVDQRSFKAYLARWMAYTAIIAPWTREFIDPLLQASAKAAAAQCIGGANQTSCGLRWIDNGANDGSFGVGEQMAALEVVQGLLYPTVAGPATQNNGGISVSDPNAGADVPQTPVTFDTVTTGDKAGASILTIIVLAAVVAGAWWMVS

SEQ ID NO: 4664 - protein, 608 aa, Unknown
  Kingdom: Fungi, Phylum: Ascomycota
MMRFTAAWALPALLTSASARFVMYADQWHQIRPTNAEDRAGIDHIVLAFAAANNTAGYTPYVPISTIRSEFPNAKVLIAVGGWGDDIGFNTVSRSDSSIQQFADDVNTMLTNTGADGVDIDWEYPGGNGADYKQVYNEEKRYQIEAFPKLLAATRTAIGPNKLLSIAVPGKKGDMIAFTSDTGPKIWASVDQINIMTYDLMNRRDNVTKHHTSVAGSEDTIKNYLDIGAPPSKINLGFAYYAKYFTTAGDCSASPLDCPIVPAEDPITGKDTLKSGAWTFERQHMAPVDASSLSISTDGTCGPDKGTKCASGCCSQYGNCGTSPEHCSGACQHAFGTGCTDADVAGSWQNAAAGGVTDEVAGGQYFYDAANGLFWTWDTPDLISRKFEDIVHKYDLGGVMAWSLGEDSNDWRHVRRMAEEVSKKRPDTPQPSSSPKPKPKPKPRPSGKPKPKPSNKPKSPPTYPARPPPPLYHTSPPSPTYSQAPSPADWRSLPGNPSLESNPDLPYDVVWVDGTPEGPEGAYEATPGAPEDYSVKWRGEPKGAYDRITVPVEAGAGAGAGAQVDRVPATTEQGAAYQLNDAQEEGEGYEQVCTLRRVRRHVQRRGGV

SEQ ID NO: 4665 - protein, 1271 aa, Unknown
  Kingdom: Fungi, Phylum: Ascomycota
MTQWCSAGWRAITVGLLSVLTGSAIAGPDLTTKHEKGRCAIRGQCGAQSFFGSELPCPDNGLAKAPTEDVRKQLVDICGAKWADTDVCCEADQLDVLKTNLDRATPIINACPACKENFFNLFCTFTCSPDQSLFINVTDTAPKGDKYLVTQLTHLVSDEYAGTFYDSCKDVKFGATNGKAMDFIGGGAKNYTQFLKFLGDKKFLGSPFQMDFPRPDDAEFPDMKAMNKHAYPCDTEDELYRCACLDCGASCTELPEVTEVKQCHVGLLPCLSFAVILVYSILLALLCLGVAFHVAIKKHSQQKNERLRLLQDLEPSDDEDEGDIVHNVGMLDRPTKHYFVNTWCDRLFSRLGYVCARFPVITIVTSVVVVGLMSLGWLRFTIETDPVRLWVAPDSAAAQEKAFFDEKFGPFFRAEQAFLVNDTHKGAPVLSYETLDWWFGVEDQIRRLKSSQSGVTLDQVCFKPIEDACVVQSVTGYFQGDFANLSPSSWQDDIMDCVDNPTQCLPEFQQPLDPHLLFGGVNQSALDAQALVVTWVVKNHAEGTPELQRAMDFEDEMKNYLKLVQEDATNRGLRLSFSTEVSLEQELNKSTNTDAKIVVVSYIIMFLYASLALGSTTLTVRSVLRNPANALVQSKFMLGTVGILIVLMSVAASVGLFSAAGIKVTLIIAEVIPFLVLAVGVDNIFLIVHEFERINISHPEGSIPERVSRALGRMGPSILLSALTETTAFALGCAVGMPAVRNFAAYAAGAVFINAILQVTMFIAVLSLNQQRVETNRADCFPFLRVSKADSGYLNPSAGEEGALQRFIRKTYAPALLGKKTKVVILAIFFAIFTAGIALFPAVELGLDQRVAMPSDSYLIPYFNDLYDYLDVGPPVYFVTKELNVTERKPQKELCGRFSTCDQGSLANIVEAERKRPEVSYLAAPAASWLDDFFLWLNPENEKCCVEKGKPCFANRTPAWNMTLYGMPEGEEFIHYLERWIDAPTTEDCPLGGKAAYADALVIDAKHNTIPASHFRTAHTPLRSQSDFIAAYTAARRIAKEISQDVETKVFPYSKFYIFFDQYTSIVRLAGALIGSALAAVLVITSIMLGSIATGLVVTLVVAMTVSAIIGSMAVLGVSLNAVSLVNLIICVGISVEFTAHIARAFTFPSRATMERAPRHRFRGRDARAWTAMVNVASSVISGITITKILGVGVLAFTRSKIFEIYYFRVWVALVLWASTHSLILLPVLLSLVGGKGYVDPESEGGLEQDLRRRQYPALLGDDDEEYDSDD

SEQ ID NO: 4666 - protein, 716 aa, Unknown
  Kingdom: Fungi, Phylum: Ascomycota
MQFLSVVALTASLAATVVAAPAPAITPAPLPDQVAKRASSCTFSGSAGAASASKSQAACATIVLNNVAVPSGTTLDLSKLADDTTVIFQGTTTWGYKEWAGPLLSIGGRKITVQGASGSVLNPDGARWWDGKGGNGGKTKPKFLALHSLTDSTVTNVNIKNTPVQAVSIASCDGLTITGMTIDDSAGDTGSLGHNTDGFDIGTSSNVIIDGAKVYNQDDCVAVNSGTSITFQNGLCSGGHGLSIGSVGGRTSNVVDTVTFYNNVIQNSVNGIRVKASVGDTGSINKVTYNKITLKNISKYGALIEQNYDGGDLKGTAGTGIPITSLVVENITGTGAVSSSGYDVVVTCGSSSSCTGWTWSNVAITGGKTYSSCTNVPSVTKLLADGRERMKSKITTTIDHQKATRAKVQHAENKAVVLRAELAALKSLLLTISKETEQHGSNLKADIDQYAKADCRTFCRAVHVRLPPSAAQSMFVSHAKCVTSSTPSSILVKERPHRTQEDFVGRDMLLELHEHFFRCTTFCFDLEVQPLMVFSSLSNNECCLGYVPAGLLTRVQLEVECNKFSLVESEDVHLDEETLNKRDLFWSDGWGRVPQEPPTCLVAFFECFFAFCSGIAINLCFRRQVDEKDREMAVTQFVPPIQSTLKRFEMAGYQMSLEFLPPLITECPKSVMVKGAQPYKAYKAAYKLFKQQEIDRKAQETARLSEELPSFYDDAY

SEQ ID NO: 4667 - protein, 1037 aa, Unknown
  Kingdom: Fungi, Phylum: Ascomycota
MRSTFSTLATVAAGLLASTVSAQGKVAIYWGQGAYQKELSVVCNDPSVDIVNIAFVNGFPKDRNTYPDTNFGKPFHFNPDGTDSKLLSSCPIIREGITVCRNNGKKVLLSLGGGSPTDYYIASDDAAKWLAEFLVGSFGPRTDRKWPRPFGNSFVDGFDLDIESASADGKQKFQFYAELVNYIKALSPNMLISAAPQCVIPDAHLDDAIARAPFDYIFTQFYNTDACSAKTGWLQRNQQETGFTFNKWTQRLQEISYNKNVKLFMGLTAGKNGGNENHYLLPEQANDLVVKYQNTPLWGGVMLWEATVSQNNTVYGQGYSSWIKYSIDGTFKQKYKPVVSSTIRSSSTLVSSTRSSTVVTTSATPTSSSTRVSSSSSVRQSSSSVVSSSSVASSSSVASSSSAHVTSSSVASSSSSVSVSSSSSTHVASSSSAPADVSSSSVEYSASSSSVASSSVKYTDYFSTDLPTPTPTHDGSSSATAEPSTVYPEDVSSTVVHSSSSADVTSSASSTYEVSSSADITSSASSSTSAVTSSATDYYTDASSSTPSPSASESSADYSSYPVSSSSANYEVSSSTTPIDASSTPCTTSTELYPESSKTPEAPSSASEYSYTESSSATSSYATESTKTPEASTSYSASSSVEYSTEYSAEYSTEYSTESTKTPEVSSSYPASSSTPAEASSTPCTTSTELYPTSSKTPEASSSATGYYPTGYEVVSSKTPEASSSATDYEVVSTKTPVASSSATDYEVVSTKTPVASSSSASEYSYNSESSPAVSTKTPVPTEYEIYSSSTPTVTKPAESTTTVVTTTYLDTCSTGLTTKTATITKTVCNACTKPSDKPEGDYPSDWTTSVYVDKTLTVTITKPIHPATDVPAYPTTASESTAPKPSAPAVEYPVEKEEHETPAKSSSVPYEATKPSPKPEVPSYPEAPAEKPASSKPSYPEDATVTLSQYVTLTKVATPVAYTPVAYATPIGHQGYPVGNGTVPSGTGAVKPSATGTGKPVKPSPSGYTPPEFEGAASKLGMGMTGVVAVVAFFVL

SEQ ID NO: 4668 - protein, 589 aa, Unknown
  Kingdom: Fungi, Phylum: Ascomycota
MLFTSILKALPAALLFAKAQGTPLGDLESRQATIDAFIQSQSATSINGVLANIGGGGNKAPGVPVGIVVASPSRTNPDYWYTWTRDAALTYKALVERFIAGDRSLRQKLDDYVTAQAYLQGVSNPSGGPDSGGLGEPKFNVDRTAFTGAWGRPQRDGPPLRATALTIYANWLIDNGGRSQALNTIWPVIAKDLAYTVRYWNQTGFDLWEEINGSSFFTLAASHRALVEGAALATKLGQTCSGCAAAAPQVLCFAQSFWTGSYIDSNINVNDGRTGKDANSILSSIHTFDPNAKCTDATFQPCSARALANHKAVTDSFRSVYAINRGIAQGKAVAVGRYSEDVYYNGNPWYLTTLAAAEQLYSALYQWDKQASITVNSVSLGFFRDLVPSIATGTYAKGSATYKTITSAVKTYADGYIAVVQKYTPSNGGLAEQFDKNTGAPVSAVDLTWSYAAFLTAVERRAGIVSPTWGEPSNNVPPRTCTGTPACNAKITFNVRATTTFGDNIFVTGQLTQLGNWSPADAKALSAARYTSSDPLWTADIDLPASTVFEYKYIRKTAAGAVVWESDPNRRFTTSAGCGSSATVNDSWR

SEQ ID NO: 4669 - protein, 644 aa, Unknown
  Kingdom: Fungi, Phylum: Ascomycota
MHWSIAVLSYVLGSALAQNSSSGSNTTAPSMGPAVLTADMVTSMGNNTLFNRWRPTYHFISPAGWLNDPCGMLYDPTTDTYHLHYQWHPNHVNWGNISWGHATSKDLVTWTDVGGWEDDQAQSIGTGPEPDSRNTSYYGLGIFSGSAQPYNLTGGQDGTLIAFYTAVQYLPTNWALPYINGTEKQAIAISNDGGQTWEQYEGNPILSDHPEGWNVTGWRDPFVEPWPEMDAILGQDEPHWYMVLGSGIKGENGGGRIPFYSAPQSNLTDWTFLGALWEPTPNQTLGSLLETGTYGFNFEVSNFFSLTDEDDDVHYYVLMGTEGGNLTWHPRAQWGLWNEGQVTRRENGSAEFTPVSGGVIDSGLLYAVTSFNDTKNNRRVQWGWANEENNGFGLLQSGYQGAMALPREMYVIKTRGLVNADGGLTTKGNTRVVEHGNGTFTGYTLGARPLLDVVEALRGEERPIEAVTNWTSSMIVAEGSAHMELAVTLSNCTGPAGVTIAASLGGEEYTHIYYDPSNYTVNVDRSQSSTIDEFANYTMIGYFYPYTFANGTTESLHMDIFIDGSLVEVYINDRFWLTTRIYPARLDSTNIGIYVGENSTVQVSDFKTWEITANSFPERPVNSSSELLFDTPEETNNYVWWPGY

SEQ ID NO: 4670 - protein, 610 aa, Unknown
  Kingdom: Fungi, Phylum: Ascomycota
MRYSLITSLLAVAGANCKPTSHIESETVHVENLRAVPAGWTVVGAPAGNEKLPFRIAVRSADDEILERTLMEVSDPSHARYGQHLKRDELKDLVKPRAESTRAVLSWLEESGISPNDIRNDGEWITFHAPVERAELMLSTTFKTYQNEVRRDVKRIRSLSYSVPRAVRNHIDLIEPTTRFGQIKAERSNVLTQEAAPFSVAAVNATCNTTITPACLKDLYNFANYEIDPNGPVRLGVSGFLEQLARYADLNQFVSRFAPNAGSNFSVVPVNGGTLDQNAADDSVEANLDIDYTVGLVDPTIETTFYSTAGRGILVPDLDQPTEADNANEPYLDFLTYIADLPDDELPQVLTTSYGEDEQSVPTSYAKKVCDIIGQLGTRGVSVIFSSGDTGVGSACQTNDGKNTTRFLPIFPASCPYVTSVGGTYKIQPERAVSFSSGGFSDLWERPAYQDQAVGAYLEKLGSQWDGLYNPNGRGFPDVAAQGQGFRVVDQGREISVGGTSASAPVFASVVALLNNARLAAGQPALGFLNPWIYSKGYQGLTDIKDGGSTGCTGRSIYSGLKAPKVPYASWNATDGWDPVTGYGTPDVQKLLELSQNQSQNQSYSVPGKR

SEQ ID NO: 4671 - protein, 565 aa, Unknown
  Kingdom: Bacteria, Phylum: Proteobacteria
MSERLERLIDQGTGRIPADIVLKGGQFYDLATGELVSSDIAICGDRIVGTYGTYSGTTEIDISGKIVVPGFIDTHLHIESSLVTPHEFDRCVLPYGVTTVICDPHEIANVLGTEGIQFFLDSALETIMDIRVQLSSCVPATHLETSGADLPIEKLLPFRNHPKVIGLAEFMNFPGVIHKDHVCLAKLEAFQGGHIDGHAPLLRGLDLNGYLSAGIRTDHECTSAEEALEKIRKGMHILVREGSVSKDLHALLPLLTERLSPHLALCTDDRNPLDIAEEGHLDHMIREAIAGGADRLAVYRAASISAARAFGLTDRGLVAPGWRADLVVVDSLENCRSEMVFAGGRRVTDDLFATRRPVTPVGLDSVKAGHVNAAAFGVPYTEGETSVIGVLPGKIITEHRRFRLPADGNQTGIDLGRDIIKVAVIERHGLNGNHANGFVQGFGLKKGAIASTVGHDSHNICVVGVNEDDMAMAANRLGEIKGGFVVVEDGKVTGEIALPVAGLMSLEPYESVRDTLHHLRQAAFALGATLQEPFLQLAFLPLPVIPHLKISDRGLVDVDKFMLIG

SEQ ID NO: 4672 - protein, 531 aa, Unknown
  Kingdom: Bacteria, Phylum: Proteobacteria
MAPRVLVSDELSETAVQIFRDRGVDVDFQPQLGKDKDKLAEIIGNYDGLAIRSATKATEKLIAAATNLKVIGRAGIGVDNVDIPAASRRGIIVMNTPFGNSITTAEHAIALMFAVARQLPQADASTQAGKWEKSKFMGVEITGKTLGVIGAGNIGGIVCKKAIGIGMHVLAYDPFLSAERAQEMGVTKVELDELLAQADFITLHVPMTDKTRGILGRENLAKTKPGVRIINCARGGLVDEQALADAIKSGHVAGAGFDVFEVEPAKESPLFGLPNVVCTPHLGASTTEAQENVALQVAEQMSDYLVKGAVSNAINMPSITAEEAPLLKPVIKLADVLGAFVGQVTESAIKEIEILYDGSTAAMNTKALTSAALAGLIRSQVADVNMVSAPIMIKEKGIILSEVKRDKSGVFDGYIKLTVKTENQTRSIAGTVFSDGKPRFIQIKDINLDADVGSHMIYITNTDVPGMIGFIGTTLGNAGVNIANFQLGRKDAGSDAIALLYVDGPVTEEVLDKLRANEAIRQAKLLTFNVD

SEQ ID NO: 4673 - protein, 641 aa, Unknown
  Kingdom: Bacteria, Phylum: Proteobacteria
MSASIEITNVTKRYGALTVLDDISLSIKAGEFVVFLGPSGCGKSTLLRMIAGLEDVTEGTISVAGQRVDTLPPGKRGVAMVFQSYALYPHMTVAQNMSFGLENIGLPKAEIERRVAQAAATLEIAHLLDRKPAKLSGGQRQRVAIGRAIVKEPKAFLFDEPLSNLDAALRGRTRLELAQLHARLGSTMIFVTHDQVEAMTLADRIVIMHNKKIEQIGTPMEIYQRPASRFVAGFVGSPAMNFVAVKSATSNGNTLTIGTSGLGDVSADIRLPARFSPEGASLGIRAEDVIVLPAGQSGIPLTAEVVERLGDRTLIYGHLSDGTKLTAETDGRSEARIGDVLQIALDTSALHLFNAEGWSNGLFVLPYLIVFLVLLVFPLFWGVWLSLHKVDLFGPGRFVGLGNYARVLADPVFLQALRNSIVFVLVSVPSLVALGLFLALALNKTTRTTSFLRGLFFSSSVLSVTIVTLIWRFVFIPGDGLLAVFSEQFGIQPVNFLSTSGWSLFSVGVATVWWCLGLPMMLFLAALQQIPNDLYEAAALDNASPWRVLTRVTLPSIARTIMLVTIIQIVMQFQLFGQAQIMTNGGPNGTSRPLVMYIYEVGFVRWDVGKAAAASEFLFLIILVAAMAQYLVSSRKSEVSE

SEQ ID NO: 4674 - protein, 1486 aa, Unknown
  Kingdom: Bacteria, Phylum: Proteobacteria
MARNTTFGVLTTLLFSLLASTTLAEEAAVPAKTEQALPSIVVSEVKTRHIVDRVVATGAVKAVEETYVSPLVDGLSIRTLNADVGDRVEADSTLATLNPDMLELQKSQYAASLAKANAALAQYQAQLAEAQANADEAVRVSERSKKLAEAGSMSTAQRDQEKAAATAALARVNSAEQLVSVANADIKVVEAQISDVELRLARTDVKAPVAGVISARTAKVGAIANGSGEPLFTMIRDGAVEIRAEIIETDLPKLEIGQRAKVTLADGKTEIEGKIRLISPVVDTQTRLGNVYITLLDTDKARVGMYARAQIIVTEKDALVLPLSAVTKSKDGMVTRKVDGDVAHVAKIETGIEDDGFIEIRSGLAEGDKVITKAGAFVRDGDRIKPMNFSAWAIRNPIAPILGFALLLFLGIQSFYALPITKFPNIDVPVVAITVTQNGASPSELEMQVTKEVEDAVASISGVDEIQSTVTDGQSVTSVVFRIEKPTDEAVQDTKDAIDRIRSDLPADVEEPVVTKIDVEGQAIQTFSVTSPDMTLEELSWFVDDTIKRALQGQIGVGRIDRYGGSDREIRVELDPNKLDSFGITAPDVNNQLRSTNVDLGSGRGQIGGNEQTIRTLGDARNVAQLANTTIALPNGRFVKLSDLGTVTDTYEEPKSFSRFNGDASVTFAVFRSKGASEVSVAETVAKSLDAVRAAHPEVNIAMVDDAVYFTYGNYEAALHTLMEGSLLAVLVVLLFLRNWRATLIAAVALPLSAIPTFWIMDLMGFSLNLVSFLALTLATGILVDDAIVEIENIARHIKMGKTPYRASLDAADEIGLAVIATSFTIIAVFVPVSFMPGIAGQYFIQFGLTVAFSVFFSLMVARLITPLMAAYLMRPEDGVEDHHDNDGRLMKAYTRLISFTTSRWYMRYATMIAAFGFLVGSLYLMAQVPGSFMPPDDSSRVVLSVELPPNATLAETDATTTRIYDAIHNIDGVESVFILGGASPKGDLELRRATVRVILGKIDHSLVKTLVNKGLGGLPIIGQYMPKMELEGRKRPQWDVEKDIFAQLKGIPDVRITKLNDRGERELTFNFLSSNEQDLNDAIGTLEAKLRASPILSNVSSEGALPRPELQIFPRKDEIARLGITPQQISQTIRVATTGDVDAALTKISLDDRLIPIRVQTSLDVRRDLQAIGSLKVKTASGATVPIDSIADLSYAEGPSSILRNARNRVASIGSDVPQGTALDTSTAEFKRIVDETKLPPTVRLAESGDAKIQSEMMQSFGNAMLLGLLMVLVVLILLFKDVIQPFTILLSLPLAIGGVAVALIVTRNAFSMPVMIGVLMLMGIVTKNAILLVDFAVEMKRHGMGRVQAMIEAGRKRAQPIIMTSIAMSAGMIPSALGVGEGGSFRAPMAIAVIGGIIVSTVLSLVVVPSFFLIMDDVSRLLGWLFGRLVGKKDEELEVLENEALTGIVTDQAKAIDEIQERLDKLEGPKRTGNVISHPALAAE

SEQ ID NO: 4675 - protein, 821 aa, Unknown
  Kingdom: Bacteria, Phylum: Proteobacteria
MVNRTVNEAIPHAAPRASNSGVLAKEIIERLTYRIGKDPKVAKPHDWLTAAILVVRDRITDNWMESTRQVYASNAKRVYYLSLEFLIGRLMRDAVTNIGLMDELREALASFGVDINVIAGLEPDAALGNGGLGRLAACFMESMATVDIPAYGYGIRYVHGLFRQQMADGWQVELPETWLAHGNPWEFERRESSYEIGFGGSVETVNIDEEVTRYVWKPADRVIATACDTPVVGWRGKRTNTLRLWTAHPIDPILLDAFNAGDHIGALRESNKAESLARVLYPADATPAGQELRLRQEFFFSSASLQDILRRHLQQYPDFSNLPDKVAIQLNDTHPAVSVSELVRLLMDIHGLDFETAWDLTRHTFAYTNHTLLPEALETWPVPLFERLLPRHMQIVYAINAKILREARKEKEMTDAEVRSISLIDESGERRVRMGNLAFVGSHSINGVSALHTELMKETVFADLHKLYPTRINNKTNGITPRRWLMQCNPDLFSLIRESIGDEFMDNAEALQALDAFADKPDFQEKFAAIKRSNKVKLAQLVQSRMGVRLDPSAMFDIQIKRIHEYKRQLLNIIEAVALYDQIRSQPELDWVPRVKLFAGKAAPSYHNAKLIIKLANDVAKVINNDPAVRGLLKVVFVPNYNVSLAEVIVPAADLSEQISTAGMEASGTGNMKFALNGALTIGTLDGANVEMRDWVGEENIKIFGMTAEEVAKVRAEGHNPRAIIEQSRELAQALQAIASGVFSPDDRNRFAGLIDGLYNHDWFMVAADFDAYAKAQREIDTLWTDTGSWYSKTIRNTARMGWFSSDRTIRQYAGEIWRAG

SEQ ID NO: 4676 - protein, 392 aa, Unknown
  Kingdom: Bacteria, Phylum: Proteobacteria
MAKTAKPDVRPNNTHFSSGPCSKRPGWTLDALSDAPLGRSHRAKVGKTKLQQAIDLTREILDVPADYRIGIVPASDTGAVEMALWSLLGERGVDMLAWESFGAGWVTDVVKQLKLKDVRRIEAGYGELPDLTTVDFDRDVVFTWNGTTSGVRVPNADFIPADRKGLTICDATSAAFAQNLDFAKLDVVTFSWQKVLGGEGAHGVIILSPRAVERLLTYTPAWPLPKIFRMTSGGKLSEGIFKGETINTPSMLCVEDYIDALLWAQKIGGLKALMARADANTKVITDFIAANNWIANLAVKPETASNTSVCLKIVDKDVEALDADGQAAFAKGVVALLEKEAVAYDIGAYRDAPSGLRIWAGATIETADMEKLMPWLSWAFETQKATLSQAAA

SEQ ID NO: 4677 - protein, 927 aa, Unknown
  Kingdom: Bacteria, Phylum: Proteobacteria
MAEMLKVVGYPSLDVLIDDTVPPSIRQKSPLEWGAPMTEREALDKMRETANRNKKLVSLIGQGYYGTITPPVIQRNILENPAWYTAYTPYQPEISQGRLEALLNYQTMVCDLTGLDVANASLLDEATAAAEAMAMAERVSKSKEKTFFVDENCHPQTIALLKTRAEPLGWSVLVGDPDTDLVAADVFGAIFQYPGTYGHVRDFSNLIARLHQTGAIAVVAADPLSLALLKSPGEMGADIAIGCTQRFGVPVSYGGPHAAYMSVKDAYKRSMPGRLVGVSVDARGNRAYRLSLQTREQHIRREKATSNICTAQVLLAVMASMYAVFHGPKGIKAIAQSVHQKTVRLAMGLEKLGYTVEPAVFFDTITVEVGKLQGIILKTAVAEEVNLRKIGDTKIGISLDERSRPVTLEAVWRAFGGDFKVEEFEPDYRLPEALLRTSEYLMHPIFHMNRAESEMTRYIRRLADRDLALDRAMIPLGSCTMKLNATAEMLPITWPEFSEIHPFVPADQAEGYRYMIDDLSQKLCAVTGYDAVSMQPNSGAQGEYAGLLTIRAYHLAQGDDHRDVCLIPTSAHGTNPASAQMAGMKVVVVKVSDNGDIDMDDFRAKAEQYGANLSCCMITYPSTHGVFEENVREVCEITHKHGGQVYMDGANMNAMVGLARPGDIGGDVSHLNLHKTFCIPHGGGGPGMGPIGVKAHLAPYLPSHPEVPELGGTGAVSAAPFGSASILPISWSYCLMMGGEGLTQATKVAILNANYIAARLKGAYDVLYKSAKGRVAHECIIDTRPLVDSAGVTVDDVAKRLIDCGFHAPTMSWPVAGTLMIEPTESETKAELDRFCDAMLAIRQEARDIEEGRMDRTNNPLKNAPHTVEDLVGEWDRPYTREQACFPPGAFRVDKYWSSVNRVDNVYGDRNLVCTCPPLEEYAEAAE

SEQ ID NO: 4678 - protein, 422 aa, Unknown
  Kingdom: Bacteria, Phylum: Proteobacteria
MLKRRKLRVMTRLMAAVALLFAVFAHQAPATAKTLDPITAQDYTLPDGTIADICFGMEGVSDGDHSRSHEKQVPFCDYCRLASTALLPEPPDEAYLIFDFLQVAERAVFEPAPVDRFSLTGAANAFAHASFENDKAISERGFKAILQIPHGCDGKPTTEVQVKLPEGFVFAKPQPKAGWTLEIIKGDYQKSYDNHGTPVASGPLEIRWKGGELPDEYYDTFVISGRISGFDKETELAFPVAQLCGTDGKVVWDEIPAPGQSAHALEHPAPTVTVAPASAADEHAGHGAPASVTLGALELSAGSVKAMVPGAKVGGGGLTIRNGGTTDDRLVAVESPAAGRVELHEMSMENDVMKMRKIEDGIAVPAGQTVELDGKQHLMFMDVVKPFAEGDSVKVTLTFEKAGKVDYTLPVGGIAGSGHQHN

SEQ ID NO: 4679 - protein, 309 aa, Unknown
  Kingdom: Bacteria, Phylum: Proteobacteria
MAALSTLRSINSDMETTQGRISSGLRVGSAADNAAYWSIATTMKSDNKALSTVQDALGLASAKTDTAYTGLENSIDIVSTIKAKLVAAREPGVDKEKINKELTELKNQLTSTAQSASFSGENWLYNSSTDALGTKEMVGSFTRAADGTVSVGVVNFDASTSVLIDTNDTDLGQLTKGIEIVQPDGTSTADATYYLVTVDGATQTGTSVELSSTTEDDDIEGMISAVDAMLTNLTDAAATLGATNSRLSMQDDFMADLMDVIDKGVGRLVDADMNEESTRLKALQTQQQLGIQALSIANSDSQNILSLFR

SEQ ID NO: 4680 - protein, 309 aa, Unknown
  Kingdom: Bacteria, Phylum: Proteobacteria
MAALSTLRSINDGMETTQGRVSSGLRVETAADNAAYWSIATTMKSDNKALSTVQDALGLGAAKTDTAYTGLENSIDIISEIKAKLVAAREPGVDKLKINKELTELKNQLSSVAQSASFSGENWLYNESTDALGTREMVGSFTRAADGTVAVGVLNFDAATSVLIDTNDTELGQLTKGVEVVQPDTTTTADATYYLIAVDGATQTGDIVELASDTADDNIEGMISAVDAMLTSLTDAAATLGATNTRISMQDDFMADLMDVIEKGVGRLVDADMNEESTRLKALQTQQQLGIQALSIANSNSENILSLFR

SEQ ID NO: 4681 - protein, 328 aa, Unknown
  Kingdom: Bacteria, Phylum: Proteobacteria
MTSIMTNTAAMAALHTLRTINNNMEEVQARISSGYRVETAADNAAYWSIATTMRSDNAALSTVQDALGLGAAKVDTSYSALSSSIDVVSEIKAKLVAAREPGVDKTKINKELAELKAQLASAAESASFSGENWLYNESTDAVGTKSIVSSFNRSTSGNVSVSTLDYDTSTSIMIDVQDTSRGQLTKGIEVVQPDTITDPTVPTTADATYHLLYVDGSTAPTGSKLIELTTDSTDDDIDGMISAVDAMLSTLTDSAATLGAITSRIDMQESFVANLMDVIDKGVGRLVDADMNEESTRLKALQTQQQLGVQSLSIANTNSENILRLFQQ

SEQ ID NO: 4682 - protein, 282 aa, Unknown
  Kingdom: Bacteria, Phylum: Proteobacteria
MTLSLVKGDTMATITINPDVAYGADMLALDFSTIYYADSYFYGGTVFRAYYGDTIDEFRGTGFKYDTYGTPIGGTVTSYAGFYQGQRLATIDGVKIAVKDIVKVAGTYGMSDDKALIKAAFTGNDKLAGAKGADKLYGYNGNDALKGNDGDDYLYGGAGNDKITGGKGHDYLRGEGGADTFIYKSVKDSTVDKSRRDTIYDFEGAKGDKIDLSGIDANSKTSTENAFSFIGTKDFSKKAGELRYDKKASDTYIYGDTNGDGKADFAIHLDDAVTLQKGYFVL

SEQ ID NO: 4683 - protein, 340 aa, Unknown
  Kingdom: Bacteria, Phylum: Proteobacteria
MNPHAILTSSLLAATLLTVPSVAAAAEINVYTTREPALVAPLLEAFTKSTGTKVNTVFLKDGLAERVASEGESSPADILMAVDAGNLVDLVDKGVTQPVESDVLKAAIPEQLRDASGNWFGLSMRARVLYVAKDLDLASFNYEDLADPKWKGKICIRSGQHPYNTALFADYIAHHGAEETEKWLAGIKDNLARKAAGGDRDAAKDILGGICDIGIANSYYVGLMKSGKGGEEQAQWVEAIKVVLPTFKDGGTQVNISGAAVAKHAPNKAEAVKLLEYLVSDEAQKIYAEANYEYPVKPGAAIDPIIASFGELKIDNKPLSEIVSHRKQASELVDKVGFDN

SEQ ID NO: 4684 - protein, 320 aa, Unknown
  Kingdom: Bacteria, Phylum: Proteobacteria
MSFDGKTLRYQYYFYGYDKLTDEDRKWGTATDTVIKGTTTINGLKVGSTQLFTMTVTDSAIGFDFHGMAIWKTGYTNAKNKNVVAQFNGAFFEDVKNTMQPIIGVTIKTNIKEIDANDVRFHENDLSVDFRGATTFDDSSLILNVIFAATKNGAIVFQGKKDSVFVQGQDAADKLFGSSANDVLEGGKGNDILMGNAGQDTLYGGAGSDDLYGGAGQDVFVFKSKSDLGTKTTNTDTIFDFNSKDDKIDLSAIDANTKLAGDQAFSFIATKSFSGTAGELRYEKKSSATYVYGDVNGDKKVDFVLHLDTAQTLAKEFFIL

SEQ ID NO: 4685 - protein, 283 aa, Unknown
  Kingdom: Bacteria, Phylum: Proteobacteria
MATIYLGDDGSGADFRSFDFSFLNDYPSYAYSFTGVSAYRDDSNRTYFQGDKLIYTGLDGGILLNPTEQGKEISAIVGGTIKGMVITENGVNIVSASGLTVSAASLYKAVIANDSDAIKTLLLSGNDTIHGTRYGDIIEGRGGNDTIYGNDGRDTLKGGVGDDVLVGGAGGDKLYGQAGNDSFVFKSVKDSYGTSSSTRDTIYDFTKNDKIDLSAIDANTKTTVDDSFSFIGTKAFSGKAGELRYEKQASDTYIYADVNGDKKADFSIHLDDAVNLHKGYFVL

SEQ ID NO: 4686 - protein, 124 aa, Unknown
  Kingdom: Bacteria, Phylum: Proteobacteria
MADLAKIVEDLSALTVLEAAELSKLLEEKWGVSAAAPVAVAAAGGAAPAAAEEEKTEFDVILVDAGANKINVIKEVRAITGLGLKEAKDLVEGAPKAVKEAVSKGEAADLKKKLEEAGAKVDVK

SEQ ID NO: 4687 - protein, 260 aa, Unknown
  Kingdom: Bacteria, Phylum: Proteobacteria
MRISKRFAGAVSAAVFALMATSAMADGEKIVIGTEGAYPPFNNLETDGTLTGFDIDIAKALCEQMKADCTFVTQDWDGIIPALIAKKFDAIIASMSITPERKEKVDFTNKYYNTGPAIVVPKDSTLTEATEDALAGKTLGAQGSTTHSNYAEAHMSKSELKLYPTSEEYKLDIANGRIDGVIDDIVVLSEWLKTEDGACCKMLGALPIDPVINGEGAGIAVRKGDDALREKFNAAIDAIRANGKYKEINDKYFGFDVYGG

SEQ ID NO: 4688 - protein, 372 aa, Unknown
  Kingdom: Bacteria, Phylum: Proteobacteria
MKKSLLSAVAFSAMVAFGGAAWADVIVGVAGPLTGPNAAFGAQLQKGAEQAAADINAAGGINGEQIKVVLGDDVSDAKQGVSVANKFVADGVKFVVGHFNSGVSIPASEVYAENGILQVTPASTNPTFTERGLWNTFRTCGRDDQQGAVAGSYIATNFKDAKVAVIHDKTPYGQGLADETKKAMNEAGVTEVVYEGINTGDKDFSALIAKMKEAGVSVVYYGGLHTEFGLMERQAADQGLKAQFMSGDGIVSNELASIAGDAVDGTLMTFAPDPRKNPAAKELVEKFRAAGFEPEAYTLYAYAALQVIAEAAKAAGGNDSQAVAEAIKAKGPFQTAIGELGFDEKGDITRPDYVMYTWKKGEDGKYSYFENQ

SEQ ID NO: 4689 - protein, 330 aa, Unknown
  Kingdom: Bacteria, Phylum: Proteobacteria
MKKTLLGLLAFSMMSATALAADIKPAIIYDLGGKFDKSFNEAAFNGAEKFKTETGVEYREFEIANDAQREQALRRFAGDGNNPIVMAGFNWAAALEKVSAEYPETKFAIIDMVVDKPNVKSIVFKEQEGSYLVGVLAGLASKSKTVSFVGGMDIPLIHKFACGYVGGAKSTGADVKVLEAYTGTTPDAWNDPVKGGEIAKSQIDQGSDVVYHAAGGTGVGVLQAAADAGKLGIGVDSNQNMLQPGKVLTSMLKRVDVAVYNSFLSAKDDKFEFGISNLGLKEDGVGYAVDDNNKALITPEMQAAVDKAKADIIAGTVQVHDYMTDEACPY

SEQ ID NO: 4690 - protein, 159 aa, Unknown
  Kingdom: Bacteria, Phylum: Proteobacteria
MGPCARPAGQREILMKLKTIALAIAVASIGLGAVSAADNPVEIREGLMKKIGGSMGALAGIAKGEKPYDEAIVKASLTTMSESIKAFPDQFPAGSDAGSEASPKIWENMDDFKAKAAKLGADVDAQLAQLPADQAGVGAALGVIGKNCGDCHQSYRIKK

SEQ ID NO: 4691 - protein, 391 aa, Unknown
  Kingdom: Bacteria, Phylum: Proteobacteria
MAKSKFERNKPHVNIGTIGHVDHGKTSLTAAITKYFGEFKAYDQIDAAPEEKARGITISTAHVEYETPNRHYAHVDCPGHADYVKNMITGAAQMDGAILVCSAADGPMPQTREHILLARQVGVPAIVVFLNKVDQVDDAELLELVELEVRELLSSYDFPGDDIPIIKGSALAALEDSDKKIGEDAVRELMAAVDAYIPTPERPIDQPFLMPIEDVFSISGRGTVVTGRVERGIVKVGEEVEIVGIRATSKTTVTGVEMFRKLLDQGQAGDNIGALVRGVNRDGVERGQILCKPGSVKPHKKFMAEAYILTKEEGGRHTPFFTNYRPQFYFRTTDVTGIVSLPEGTEMVMPGDNVTVAVELIVPIAMEEKLRFAIREGGRTVGAGIVASIVE

SEQ ID NO: 4692 - protein, 90 aa, Unknown
  Kingdom: Bacteria, Phylum: Proteobacteria
MNKNELVSAVAEKAGLSKTDASSAVDALFDVIQAELKNGGDVRLVGFGNFSVSRREASKGRNPSTGAEVDIPARNVPKFSAGKGLKDAVN

SEQ ID NO: 4693 - protein, 140 aa, Unknown
  Kingdom: Bacteria, Phylum: Proteobacteria
MAIERTFSMIKPDATKRNLTGAITKMIEDAGLRVIASKRVWMSKREAEGFYAVHKERPFFGELVEGMTSGPTIVQVLEGENAILKNREIMGATNPANADEGTIRKTHALSIGENSVHGSDAPETAAQEIKYWFSDTEIVG

SEQ ID NO: 4694 - protein, 418 aa, Unknown
  Kingdom: Bacteria, Phylum: Proteobacteria
MGTIEGNSNNNSLVGDDSYGVTNMIYGYGGDDFLRGGFLAKNYIWGGDGNDTIEGGSQYGDFLYGEGGDDDISTFWRSFVYMNGGSGNDTLRAGSGGASLDGGKGIDTMYGGEGGDWFYVDDARDIVIENFVPQFDNVYNPPDIVTASTSYALSSGALIEALNVSSIKSTKAINLTGNDYGQSINGNAGDNVLNGKGGNDELMGRLGADTLIGGSGTDTARYVSATTGVTVSLAKPSINTGEAKGDTFSSIENLVGSKYADKLYGDTAANTLTGGAANDFLSGAAGKDKLLGEAGDDKLNGGLDADILTGGSGKDTFVFSTALGSANIDTIKDFNVKDDVIHLENSVFTKLAKTGALAAAQFVANTKGAATDKLDRIIYETDTGKLFYDADGNGSGKAVQFATLKAELAITHEDFIVI

SEQ ID NO: 4695 - protein, 286 aa, Unknown
  Kingdom: Bacteria, Phylum: Proteobacteria
MSKYKLLAAVALVALMAGKAPVLAQDAADPVIAKVGDTEITKSEVDLAVSGLDPQLAQMPEEQKRAAALSGLIDVKLLAKDADKEGLQNDEAFKKRIAYLTERELHNAFFKKHVVDAVTAEEVKARYDVEIAKITPPEEVKARHILVKTEDEAKAIIKELDGGKDFSELAKEKSTDPNKDDGGDLGYFTKERMVPEFSEAAFKLEKGKYTEAPVKTQFGYHVILVEDKRTQAPPTLEQVEPQVKQLVMRDKYVALLEAAKKESAVDITDPALKKAYDEANKAEAAN

SEQ ID NO: 4696 - protein, 283 aa, Unknown
  Kingdom: Bacteria, Phylum: Proteobacteria
MLLSEMSPFKRLLGGVAVAAIALTLAACSDEKKDAAETAKPAETVDTATKTEIKPADNMMTSSTMASTPMTAAANQTPAAAETQVAQAAAPAAKAELPQPEGEIDVAKLMAPGALPEMALGKDDAKVTIVEYMSMTCPHCARFHNETFDAIKAKYVDGGQVRFVVREFPFDPRAAAAFMLARCAPAGQYFPMVSMLFKQQEQWAAAQNGRDALLQMSKLAGFTQESFEACLTNQKLLDDVNAVMQKGAKDFGVAATPTFFINGKKYSGEMSVDTMSGLIDSML

SEQ ID NO: 4697 - protein, 1209 aa, Unknown
  Kingdom: Bacteria, Phylum: Proteobacteria
MSLYGMMRTGGSGMNAQANRLGTVAENIANANTTGYKRASTEFSSMILPASNGSYNSGGVETKVRYSISAEGSKVYTTSASDLALDGGGFFIVSGGNNQEYLTRAGAFTQDGDGNLVNSAGYKLMGYEYTEGVDPTVVVNGFDGLSAVNLASDGLVANGSTVGSMGANLPSGAADGDISTTSLIVYDSQGNTRILDFNYEKVSDNNWSLEIVDRESGTSLATKTLAFDADGTMTTTPTTVTTTSMVGLTGTGATLGAIEIDLAKTTQLGYKFNPDGGTIDGNAPSKVAGFQIDDDGIVYVKYENGKLDPRYRIALANVQSPDNLVPQSGNVYSQGVDSGVIVTGFAGSGDFGSVISGALESSNVDIAEELTSMIESQRTYTANSKVFQTGADLLDVLTAIVSKNIANAGNADYTRRLALLGTSLNGTQVLSIQRSQNEALLKQNIASISQSSAQSSLLSGLETLKSALGGNDYEMAPSTYLASFRDALQTYAATPGNSTIAATVVSAAGDLVTSLNKTSTSVQSMRLDADKEIATSVASLNSLLSDFETVNTAVQSAVGSGTDASDALDQRDKILKQISEIVGISTVTRGSGDTVIYTNDGTVLFENKARQVTFTATSGFDATTTGNGIYVDGVPLKAGSGGNTSAEGKLGALLQLRDDIGPQYQTQLDEIARGLVTLFQEGDPSGTPAVPYAPGLFTYTTSTPPATVPATGTVSAGLAASLIVNPLAKETPQMIRDGGFNGVVSNTTNASGFSDLLDGFIDAFDGNLDFDTTTGLDASSSLSSFATSSIGWLEQLRSDASTANDNKTALLSRTGEALNNITGVSMDEELSLLLDLEQSYKASAKLVSTVDAMMAALLEANAMRLTIQQSQTEVVKLEQEVTTGRHADVGVALGGAASKSLDLQRELARMTTLTDTNAVVTQRLSASQEALSSISSAAQSTMEALIALSGSDSADQLAIAKTEVTNSMSIFNSAINTSFNGEFLFSGINTDVKPVATAYDDPAGSAAKASFDSALSTFMAAQSPPLTSMNEFTTAQMTDFIKNTLEPMYLDTDPTTGDQSQWTTDWSSASDQTMSSRISTTEVVPSSTTANSEGVRKFALANVIAYELLGADVSSDVRNLVSQTAVGYIGEAISGIDAQRSALGISEARVEKANTSLDAQIKLVKTHVNDLEGIDTYEASTRMNTLLTQIETSYTLTSRLQQLSLINFL

SEQ ID NO: 4698 - protein, 530 aa, Unknown
  Kingdom: Bacteria, Phylum: Proteobacteria
MLRGVDILADAVKVTLGPKGRNVIIDKSFGAPRITKDGVSVAKEIELEDKFENMGAQMVREVASKTNDIAGDGTTTATVLAQAIVREGGKAVAAGMNPMDLKRGIDLAVAEVVKDLQAKAKKITTPEEVAQVGTISANGEKQIGLDIAEAMQKVGNEGVITVEEAKTAETELEVVEGMQFDRGYLSPYFVTNPEKMVADLDDAFILLHEKKLSNLQAMLPVLEAVVQTGKPLVIIAEDVEGEALATLVVNKLRGGLKIAAVKAPGFGDRRKAMLEDIAILTGGQVISEDIGIKLENVTLDMLGRAKKVSISKENTTIVDGNGAKAEIEGRVAQIKAQIEETTSDYDREKLQERLAKLAGGVAVIRVGGSTEIEVKEKKDRIDDALNATRAAVQEGIVPGGGTALLRSSVKITVKGVNDDQEAGINIIRRALQALVRQIADNAGDEASIVVGKILDKDQDNFGYNAQTGEYGDMIAMGIVDPVKVVRTALQNAASVASLLITTEAMIAELPKKDAPMGGGMPDMGGMGGMM

SEQ ID NO: 4699 - protein, 122 aa, Unknown
  Kingdom: Bacteria, Phylum: Proteobacteria
MFANMAASLIEHEQIVTTLPKAKEIRPIVEKLVTLGKRGDLHARRQAISQIRDVAVVAKLFDAIASRYATRNGGYLRIMKAGYRHGDNAALAVIEFVDRDTSAKGAKDLARVAAEAEAAEAA

SEQ ID NO: 4700 - protein, 327 aa, Unknown
  Kingdom: Bacteria, Phylum: Proteobacteria
MKILKTMLGITAAAAVSLLSTSTFAQTYPERTITMVVPFAAGGPTDTVARLVAESMSKDLGQQIVVENVGGAGGTLGAGRVAQSDPDGYTILLHHIGMATSATLYRKLAYDTLNAFEYVGLVTDVPMTIVARKDFEPTDLKGLIDYVKANKDTVTVANAGIGAASHLCGMMFMSAIQTPLVTVPYKGTGPAMTDLLGGQVDIMCDQTTNTTKQIQGGTIKAYAVTSPERLPVLKDVPTAIEGGLADFTVGIWHGVYAPKGTPAEVTERLSKSLQVALKDQNVIDRFAELGTVPSSEADATPAALKAKLEGEIARWKPVIEAAGQYAD

SEQ ID NO: 4701 - protein, 274 aa, Unknown
  Kingdom: Bacteria, Phylum: Proteobacteria
MNIVTKLLAGAALLVAAHSAQAGETLDRVMENKAMVVATNSSWPPQSFLDDNNEMVGFDIDVSREIAKRLGVEVSFQTPDWATLTGGRWQGRYDLGVGSVTPTKARAQVIDFAGIYYYSPYVYVVHKDSTAKSVDDLNGKVIGVETATTSEDFINRKLEIDAPGLPPVEYKLTPGEVRTFADSMLPFDDLRLGDGVRLDAVIAPEQTAMNAIKNGYPLRILDGGYAFREPLVVIDEKVDPEWTAKVGGIIEEMKKDGTLASLTSKWYGKDYSAD

SEQ ID NO: 4702 - protein, 148 aa, Unknown
  Kingdom: Bacteria, Phylum: Proteobacteria
MKCKIFAVVTAAIVTAAFGAAANATDFEIHMLNKGKDGVMVFEPAAIKVAKGDTVTFVPTDKSHNAETVKDLIPAGAEAFKGKMNETIKVTFGTPGAYLIKCAPHFAMGMAAVVVVDDNPANLADVKAAKLPKKAHERIEAGLQSLGL

SEQ ID NO: 4703 - protein, 345 aa, Unknown
  Kingdom: Bacteria, Phylum: Proteobacteria
MKSVLKLMAGVAIITSMHTAVMAKDLVVGVSWSNFQEERWKTDEAAIKAALEASGDKYISADAQSSAAKQLTDVESLISQGANALIVLAQDSDAIGPAIEKAAAEGIPVVGYDRLIENPAAFYITFDNKEVGRMQAREVFKVKPEGNYVFIKGSSSDPNADFLFAGQQEVLKEAIDAGKIKNVGEAYTDGWKPENAQKNMEQFLTANDNKVDAVVASNDGTAGGAVAALDAQGLAGSVPVSGQDADKAALNRVALGTQTVSVWKDSRELGKRAAEIAATLASGKTMDEIEGVTTFNGGPKGVEMKSVFLAPLPITKDNLNVVIDAGWISKEEACAGVKGDVAACK

SEQ ID NO: 4704 - protein, 741 aa, Unknown
  Kingdom: Bacteria, Phylum: Proteobacteria
MSNTPKILYTLTDEAPFLATQSLLPIVEAYTATAGIAVETRDISLSGRILALFPDYLKDDQKEADHLAELGQLATTPDANIIKLPNISASVPQLKAAIKELQDQGFALPNYPDVPTDDVSRDIKARYDKVKGSAVNPVLREGNSDRRAPLSVKNYARKHPHRMGKWSKDCKSHVSHMDGGDFYGSEKSATLANAGSLKIELFKADGSSVVLKEKTAVKAGEIVDAAVMSRNALASFVQAQIADAKAKGVLFSLHLKATMMKVSDPIMFGVVVEEFYKDVLAKHADVLKQAGFDPNNGIGDLFARLPQLPEATQEAIKADLAAEYGKRPGLAMVNSDKGITNLHVPSDVIVDASMPAMIRDSGGMWNADGKLQDTKAVIPDRCYAGVYQAVIDDCRTHGAFDPATMGSVPNVGLMAQKAEEYGSHDKTFQIPADGTVRVTDEAGTVVFEHAVQTGDIWRMCQTKDAPIQDWVKLAVNRARLSGTPAVFWLDTARAHDAQVIAKVETYLKDHDTNGLDIRILAPVEATAFSLDRIRKGEDTISVTGNVLRDYLTDLFPIMELGTSAKMLSIVPLMAGGGLFETGAGGSAPKHVQQFVEEDYLRWDSLGEFLALAASLEHLGNRYDNAGATVLAKTLDQANGQFLDNDKSPSRKLGGIDNRGSHFYIALYWAQALAAQDDDAALKARFAPLAKALADNEQTIVGELAAVQGKPVDIGGYYRPDVAKASAAMRPSSTFNSALSAL

SEQ ID NO: 4705 - protein, 807 aa, Unknown
  Kingdom: Bacteria, Phylum: Proteobacteria
AEPVAAPKAAAPAAAPAAAAEAAPAATPAKAAAASAPACAAKQDARGAVTNGVLNAGEAPLASPAVRRRAWDLGVELRYVPATGPGGRILQADLDAYAAAGGKAQPVGGSAGGSSYARRTGEQQVPIMGLRRKIAQKMQQSWTTIPHITYVEEIDVTEVEALRAKLNERWAKERGKLTLLPLLARAVVLAARDFPQMNARYDDQANIVTRYEGVQLGIATQSEVGLSVPVVAHAESLDLWQTATEIARLANAVRVGKATREELSGSTITISSLGAVGGVVSTPIINHPEVAIVGVNRIIERPMFREGQVVARKLMNLSSSFDHRIVDGMDAAEFVQAIPMSNTLQTQLLIIGGGPGGYIAGIRAGQLGVKTIVVEGVNPGGTCLNIGCIPSKALIHAAEEFAKVTAYAAGTSPLGISVQAPSLDLAKTVAWKAGIVKKLTGGVSALLKKNGAQLIKGWATIVDGKTVEIAGAAEDGGTLRITCEHLLLATGSVPVELPFLPFGGKVISSTEALSPTSLPKQLIVVGGGYIGLELGTVYRKLGCEVTVVEAQERILPAYDAELTKPVATHLEKSGVKLLTGHSVLGLADNGQLRVRDKDGNEIALDADQILVAVGRRPKTDGFNLESLQLDLTGKAIKIDDQCKTSMRNVWAIGDVAGEPMLAHRAMAQGELVAEIVSGKKRHFVPAAIPAVCFTDPEIVVVGLSPDEAKAQGIETKVALFPFAANGRAMSLESTDGFVRVVARSSDHRILGWQAVGVQVSELSIAFVQSIEMGATLEDIAGTIHPHPTLGEAVQEAALRALGHALHI

SEQ ID NO: 4706 - protein, 846 aa, Unknown
  Kingdom: Bacteria, Phylum: Proteobacteria
MNLMTNAPAKLPVVKRCAFGAHELTLETGEIAKQASGAVIVRMGDTVVLVTAVGSKRAKDGLDFFPLTVEYRERFYAGGRIPGGFFKREGRPTEKEILTSRLIDRPVRPLFPDQFRHEVQVIATVLSVDPLIDPDIPAMVGASAALRLSGLPFKGPIGAVRIGRHGDSFLVNPTTEELKASDLNLVVAGTRHGVLMVESEANVLSEEIMLAAVSLGHHAMQPVIEAIEELAQEAKVTKWEWSHPPRDLALADTVRTQIGNNLNSALLITDRIARKKRVQAIRNEVLIALAAPTTSATGWEVAQVRAELDDLEYTAVRRMVLQDRRRLDGRGLEDVRPISIQLGVLPRTHGSAVFTRGETQAIVTTTLGTTRDGQVIDAVTGEYKEHFLFHYNFPPYCVGETGPMIGPKRREIGHGRLAKRGVAAIMPSMEAFPYTIRIVSEITESNGSSSMASVCGSSLALMAAGVPVKGPVTGIAMGLVKEGDRFAVLSDILGDEDHLGDMDFKVAGTIDGISALQMDIKIDGVTAEIMEVALAQAREGRLHILREMAKAIQAPREQMSEFAPRLLTIKIHPDKIREVIGKGGATIQALTKETGTQIDIRDDGTIVIASTSGGAADTARRRIEQITAEIEPGRVYEGKVAKVLDFGAFVTIAPGKVGLVHVSQISDERVENPNSVLSEGDVVKVKVLEVDMQGRVRLSMKAVDGTKVLLPESAEILFDNDARLRLLRGVNILANAVKATLGPKGRNVVLEKSFGAPTITKDGVSVAKEIELADKFENMGAQMVKEVASRTNDDAGDGTTTATVLAQALIREGAKAVAAGMNPMDLKRGIDKAVIAAVAELKNISK

SEQ ID NO: 4707 - protein, 856 aa, Unknown
  Kingdom: Bacteria, Phylum: Proteobacteria
MAKLLVLHGPNLNLLGTREPGVYGHTTLAQIDQALLAQAQAAGHALENLQSNAEHVLVDRVQAARDDGTAFILINPAAFTHTSVALRDALAAVDVPFIEIHLSNPHAREPFRQHSYFSDKAVGVICGVALWGCLCGAAIAADRSAEGIDCAQPSGTMESDLCASDVASEADTELNAVYARARQQLRSQAAEGACTHCADAEKQLILAQRAWMQLRDHDCDAVYAFNADGTSRNGAQMRCLTTLARDQAPMDLRKIKKLIDLLEESNLAEIEIKEGEESVRLSRAPVSGYGMVQAQPQMMMAPAPAQAAAPAMPMQSPTEASTGGTAKAGNALPDGHVLRAPMVGTFYSSSSPDKPAFVSVGQAVKAGETLAIIEAMKMFNPIEADVSGTIVAILGENGQPSMLDKVVIANRGEIALRILRACHTLGIRTVAVHSTVDRNLKHVAMADESVCIGPAPSSESYLNIPALIAAAEVTDAQAIHPGYGFLSENADFAERVEESGFIFIGPKADTIRLMGDKVEAIRAMKAAGVPCVPGSGGPLTDDIVANTKIAREIGYPVIIKASGGGGGRGMRVVHAEASLKAAIETTKSEAKAAFSNDQVYMEKFLENPRHVEIQVLADGQGNAIHLGERDCSMQRRHQKVVEEAPAPGITAELRDEIGKVCVEACIRIGYRGAGTFEFLFEDGRFYFIEMNTRVQVEHPVTEMVTGIDLVCEQLRIAAGQKLTIKQSDVVLTGHAIECRINAEDAETFVPSPGQITAFHPPGGPGVRVDTHIYSGYRVPPNYDSMIGKLIVHGPDRETAIARMRVALSELVVDGIKTNVALQQRIMRDKGFQAGGQNIHYLEKRLAERKNKSIALT

SEQ ID NO: 4708 - protein, 455 aa, Unknown
  Kingdom: Bacteria, Phylum: Proteobacteria
MSTDRFVSPDDIRSLFAQAMSTMYRTEVPLYGTLVDLVAEINDAVLTANPALAEQLDRTDERARLDQERHGAIRVGTAEELATLGRLFALMGMYPIGYYDLSVAGVPVHSTAFRPRTAQALARNPFRVFTSLLRLELIENAALREQSAAILAQRRIFTDTALALIAQAERDGGLDEADARRFVIEALETFRWHGDATVSLDTYHALHDAHRLIADVVSFRGPHINHLTPRTLDIDAAQAGMLARGIDAKAVIEGPPPRRCPILLRQTSFKALEETVHFPSGDAGDAGTHTARFGEIEQRGLALTPKGRALYDQLLAQARDSGGAGSTGQDYPTRLAEAFTAFPDDHDTLRREGLGYYRYALTDAGRANPAAVADLPAEALIAAGLASADPIVYEDFLPVSAAGIFQSNLGGEEQRAYAAHANRDAFEQALGMTVEDEFAIYARLQAESLASLRGA

SEQ ID NO: 4709 - protein, 387 aa, Unknown
  Kingdom: Bacteria, Phylum: Proteobacteria
MAQVINTNTMSLNAQRNLSTSGSSLATTIQRLSSGSRINSAKDDAAGLAISERFGTQIRGTDVAIRNANDGISLAQVAEGSLSEIGNNLQRVRELAVQASNATNSASDRKALQAEVTQLVSEIDRVAKQSDFNGTKLLDGSFSSQLFQVGANAGQAIAIDKVVDATTANLGTSSFKSAKLTAAAVVAEKTQVGGTISVKAADGSVNTVDLGKIDLAAGATAAEQNKAVVSAINGKLGETGILAELNEAGTEITVTQVKNGGDLAAGAVTTAAGTVALTKKTWDGTANSGAGDWGTAAPAYTTLAVASETKHVKDLDVSTVTGAQKALSLVDEALNSINSTRADLGAIQNRFTSVVANLQTSTENLSASRSRIKDTDFAKETAELTRT

SEQ ID NO: 4710 - protein, 378 aa, Unknown
  Kingdom: Bacteria, Phylum: Proteobacteria
MAQVINTNTMSLNAQRNLSTSGSSLATTIQRLSSGSRINSAKDDAAGLAISERFGTQIRGTDVAIRNANDGISLAQVAEGSLSEIGNNLQRVRELAVQSSNATNSASDRKALQAEVTQLVNEIDRVAKQSEFNGTKLLDGSFSSQLFQVGANAGQAIAIDKVVNAKADSIGQSSFASDGKLEMGAAAALVSGEIKGLTIGSVALSDISFEQGTSAVTADAEKQTVQNALNATVTAINAKLGETGVYAAQAVDASGVAIAGEITLTSIKSDLDSDGVAALAVTGGGASVTVDADIGEGDDGAQQLKNVDITNVIGAQRALEIVDNALGAINNTRADLGAIQNRFTSVVANLQTSTENLSASRSRIKDTDFAKETAELTR

SEQ ID NO: 4711 - protein, 410 aa, Unknown
  Kingdom: Bacteria, Phylum: Proteobacteria
MAQVINTNTMSLNAQRNLSTSGNSLATTIQRLSSGLRINSAKDDAAGLAISERFGTQIRGTDVAIRNANDGISLAQVAEGSLNEVGNNLQRIRELAVQASNATNSTSDRKALQAEVTQLVSEIDRVAKQADFNGTKLLDGTFTSQLFQVGANAGQAIAINSVVNAKADSLGAASFANVYEGTSLAAADAATADSVFSKLQIVVTSEGGTATPINIGDIKVKAGESITAATAAAINSKLGETGVMAKVDKGVISLTSVKAGQSFALDIAGPDSTSTDPVPTPIDDLELVGLDTADATGGSLTGVETSFVKDLNVTTAEGAQQALEIVDKALESVNSVRADLGAIQNRFTSVVANLQTSSENLSASRSRIRDTDFAKETAELTRTQILQQAGTAMLAQANQVPQNVLSLLQR

SEQ ID NO: 4712 - protein, 594 aa, Unknown
  Kingdom: Bacteria, Phylum: Proteobacteria
MRLLTPLSLACLLVLATSPALADVFINELHYDDNTPAGDVGEAIEVVATAGEDLSGYRLYLYNGSNPSAAAVYANNPVPAGTASCGSARLATVNYPTNGIQNGPNDGIALVDASGKVVQFLSYEGTITAAGGPAAGLTSQNLPVSETNSTAPGTSLQLTGTGSQYAHFTWAESATQTFGACNHGQTFSGGGPTGPNTAPSVTATTPEQGASTFPAAADLSVTFSEPVTLSSGAFALSCGQSGTVALSHPTTGTRFTLTTNTALVAGEACRFDIRATRVKDAQGARPAADTRIAFTVVTATTPDPGNPGTPGEYYARVNTSTPSQLRCSLHETIKGHTAYPYSGSGTSTWTILEIADEDPNNSGKILDAYRNRSYTKVSGRAGTGSGLTYNREHTWPNSLGFASTTGDKGLPYAPYTDTHMLYLTDAQWNADRGNKPFATCDSNCGERATEANNGFGGGSGGYPGTSNWVRTPDGNGGSFEVWGHRKGDMARAVMYMAIRYEGGKDARTGQSEPDLELTDDRNKIVKTSASPAYMGLLSTLIDWHLSDPPDAAERARNEVIFSFQGNRNPFIDHPEWATPTLFTSAKPATCQLAN

SEQ ID NO: 4713 - protein, 1001 aa, Unknown
  Kingdom: Bacteria, Phylum: Proteobacteria
MNRNSNKLRDAVVLALIASAAGTGSAVAQETTGTTNLDRISVTGSRIRQVDVETAQPVLTISRADIQNQGFSSVGDILQNISAAGSPNFSRASPLTSNQEAGGQYIDLRNLGAQRTLVLVNGKRLGISPDGYQDISIIPTSMVERIDVLKDGASSIYGSDAMAGVINIITRKNFDGLEANVYKGQYSQGDGEKETYDFVMGFSGDRGSLTVGAEYHKEEGVWAKDRPFTADTYPDWDPASSLTPVGQYGNYNRFANQFNRNAAGALVLNAQGIPVRRSAGWSVANQGSDAIGANDFHPQTAADQSRSSDQMHLLTPLERRSLFVSGNYDITDNVRFTTDLSYTKRQSQRQIAGYPLQSSAFGVPMAGAVYQTNPDGSRTLVSNGSYFNPNGNRDFYQADVATYLDDDGNPLYQQTNDVDFRRRGWEVPRTTDSTLTTWRFAAALEGSFEIGDRFFNWDVGALYNENDSLLINNGNFYIPAVAAAVGPSFLNSAGQVVCGTPGNEIAGCVPWNPYAGYGAGSDQYSLGDPNVQNYLFREEHATGKTTTHNYFANLSGTIVPLPAGDLGFAIGYEYRKESGAFNPDAIAQSGDSTNLASGPTKGSYALDEFYLELNIPILADLAFAKELTLDVATRYSDFTSFGDTTNNKFGLKWRPIDDLLVRATYAEGFRAPTIGDLYGGSSQTFPTNFVDPCDSVYGDVRGSARCVQDVGQGYRQLSQGFVPTTGRAAQSPVPFNSGSNPNLTPETSESKTVGFVYSPSYVTGLSVGVDWWSIRIDNTIVSDSPNLIMEDCYVRLIESRCSMFSRDPNNGNIVGTLNYGNRNAGYTETEGFDFDISYSRDTDFGRFSAKSATTYVGKYEEKSTDDVDAVPSQNNGFGAFFRVRSNLGLGWSMNDLSVNWNMRYYSGTKENCRFATRCTLPNYSAPDTLGVISPKTELGAVTFHDVQVSYATPWNATVAVGANNVFNKVGPMMTSQPSSNFSYYGGYDIGRFLYMKYSQKF

SEQ ID NO: 4714 - protein, 889 aa, Unknown
  Kingdom: Bacteria, Phylum: Proteobacteria
MTALSDRGADRRSIASPPAIDIAARAVPGCGRARPVRAYFIRGRCPVTSSNKTILATCLLAALASTAGAAPATGERLQDWPHVTSAIGPDAALEARVREIVAQMTLAQKVGQMTQPEIKMITPDEVRQYYIGSVLNGGGSWPGMDKHATVAQWLQLADAYRAASLATDARTPVPVIWGTDAVHGHNNVYGATLFPHNIGLGATGDAALIERIGQATAHAVRATGIDWVFAPTLAVAHDPRWGRTYESYSSDPHVIRAFAQAYVKGAQGRFGDDGNVVATAKHYIGDGATDNGRDQGEALVDKATMINVHGQGYYGALGEGVQTVMASFNSWNDRSGGVDYGKMHGNKALLTGALKEKMGFDGFVVSDWNGIAQVPGCRNDSCAQAINAGIDMVMVPDDWKAFIANTMAQVERGEIPLARIDDAVTRILRVKLRAGLFDHKPSDSRYAGDAAAVQHRELARQAVRESLVLLKNDAKVLPLRRDARVMVVGKSADNLSDQSGGWSLTWQGTENRNADFLHADSVLGALRAELGTQNVAYSADATALDPTRFDVVVAVIGETPYAETNGDILASDSVSHSRAYPQDLAVLRVAQASGKPVVTVYFSGRPMYTNDLLNQSQAFVAAWLPGTEGKGITDVLVAGKDGKPVHDFRGRLSFPWPGVPCPAPIDRPDPKQPPLFALGHGLSYRTPGKVARLPEANPDNCGEVTTLPIFNRADTPPFGLHVAAGGATQPLGNDLNATLRWPTAAPVVQVRTVQINTQQDAKEVTWLAPAQLLARSSSRRNLGALARTQGALQFDVQLVHRPASPVKVTMQCGTGCEGGVDIAPLLAKLAPGQKQTVTVPLACFARQGVDLGAVEAPFVVTADKPFAASFTQVRVSTNSAGGEGAVACP

SEQ ID NO: 4715 - protein, 439 aa, Unknown
  Kingdom: Bacteria, Phylum: Proteobacteria
MKKMPRWLAVVAALLLPFAAMAQQKGLDIDIIGGNASATPITVVPMPYQGSAGAPQTDVAAVVRADLDRSGQFRTLPEAQIVEKPTRGSEIQFATWRALKQNYIVVGRVMDAGAGAYRVEYELYDVPKGERLLGLAMTARGNAMRDVAHQMADAIYEKITGVRGAFWTRIAYVTASGKGDAMRYALMVADSDGFNPQTIVRSAEPLLSPSWSPDGNKLAYVSFERGNSAIYIQNISSGARELVTSFRGINSAPSFSPDGRRLALSLSRSGNPEIYVMDLGSKQLTQLTNHFAIDTEPTWSPDGSSVYFTSDRGGRPQIYQVASSGGSASRVTFQGNYNATPSLSYDGKKLVVAQGSGNTYKIAMMDSSTGSARWNTLSPGSLDESPSFAPNASMVLYAAREGGRGVLYAVSADARVRQRLVLADGDVREPSWSPYRTKR

SEQ ID NO: 4716 - protein, 702 aa, Unknown
  Kingdom: Bacteria, Phylum: Proteobacteria
MPDPIARRAVTSFSSPAPLPRRRRWLLALALAAAAGMPTLVQAANCTGAPEWNGAAIYLAGQTLQKGGVLYRANQDIWNAPPDHPAGAPYYTNLGACDGSGSNQPPSVALTSPAAGASFTAGSSITVSANASDTDGSISKVEFFRGGTSLGIDTSAPYSVVWSNASAGSHTFKAVATDNNNAVTSSATVNVTVTAASNDTTPPSVPGGLASPSRTATTVNLAWNAATDNSGGSGVAGYDVYRNGSLVGSPSATQYTDGGLAASTAYTYTVRARDNAGNASAQSGSISVTTAAGGGGGGTKRVIGYFTQWGIYGRNYQVKNIDTSGSAAKLTHINYAFGNVRNNRCEVGVTQASDPNTGVGGDAYADYGKSFAAGDSVSGTGDTWDQPLRGNWNQLKQLKAKHPNVKVLISLGGWTWSRGFSSAAQPANRQAFVASCIDAYIKGNLPVADGAGGAGAALGVFDGIDIDWEYPVACGLSCGTPADNANFTALLAEFRRQLDAVRPGLLLTVAVGAGVDKIRVTDPASYHPYLDFINVMTYDFHGAWDPQTNHHSALFDSPADPSTGDQKLYNSNDAMEAFLSRGVPASKLNLGIGYYGRGWTGVASGNNGLYKSASGAAPGTYEAGIEDWKVLKNLNWPVYTDNVAKATWISNGTTFWSLDTPAMVTEKMGYVKAQGLGGAFFWEFSGDDAQGTLTKAISDGLK

SEQ ID NO: 4717 - protein, 478 aa, Unknown
  Kingdom: Bacteria, Phylum: Proteobacteria
MAEQFDVVVIGAGPAGYHAAIRAAQLGLKTACIDAALGKDGKPALGGTCLRVGCIPSKALLDSSRQFWNMGHIFGDHGISFKDAKMDVEAMVGRKDKIVKQFTGGIAMLFKANKVTAYYGFGELQPGNIVKVKQHDGSEVELKGTNVIIAAGSDSIELPFAKFDGETIVDNVGGLDFTEVPARLAVIGAGVIGLELGSVWKRLGSEVTILEALPDFLAAADAEVAKTALKEFKKQGLDIRLGAKVSKAEVTGKGKKKEVALTYTDGEGEKSLIVDKLLVAVGRRAATKGLLAEGTGVKINERGQIEVDAHCHTGVNGVWAVGDCVRGPMLAHKGFEEGIAVAELIAGLPGHVNFDTIPWVIYTEPELAWVGKTEQQLKDEGIPYKAGSFPFAANGRAVAMIEPTGFVKVLAHAETDRILGMHLVGANVSELVHEGVLTMEFSGSADDLARICHAHPSLSEVVHDAAMAVSKRAIHKAN

SEQ ID NO: 4718 - protein, 179 aa, Unknown
  Kingdom: Bacteria, Phylum: Proteobacteria
MARGINKVILVGNLGNDPDVKYTQGGMAITRISLATTSVRKDKDGNQQERTEWHRVVFFGKLGEIAGEYLRKGSSVYVEGSLRYDKYTGQDGVEKYSTDIIADEMQMLGGREGGGGGGAGGERPQRQQAPRQEYGGGGGGGGGQRGGGGGGYGQQRPQQQAPQQSAPPMDDFADDDIPF

SEQ ID NO: 4719 - protein, 725 aa, Unknown
  Kingdom: Bacteria, Phylum: Proteobacteria
MTTIRSIHAREILDSRGNPTLEAEVILEDGSFGRAAVPSGASTGTKEAVELRDGDKTRYLGKGVRNAVSNVNTTIATALKGFDAADQEGLDRRLIDLDGTENKGRLGANALLGVSLANAHAVAASKKQALWQHLANGRDVTLPVPMMNIINGGAHADNNVDFQEFMVLPVGFTSFSESLRAGTEIFHSLKSVLKGHGLSTAVGDEGGFAPDFRSNVEALDTILEAIGKAGYTAGEDVLLGLDVASSEFYENGKYNLVGENKRLTSEQFVDFLADWAAQYPIVTIEDGLAENDWAGWKLLTDRIGNKVQLVGDDLFVTNPKIFKEGIESGTANAILIKVNQIGTLTETLEAIAMAHAANYASIVSHRSGETEDTTIADIAVATTATQIKTGSLCRSDRVAKYNQLLRIEEALGAGARYAGRDAFYRFWFGPGNSGEVMMLEAQVENQKRDNAGLQQRNDALAAEVKDLKEGEAAIEERARSELGMIKPGEKFYRVVEDAPVPPPRAPTAVTDPDAPHQDYLLAGDRVLLAHTLEALLSHPVVAGVMVVVAENDADWPGWQSLADKPILTCIGGATRAGSVLAGLHALPDDVRADEFVLVHDAARPNLAAADLGRLLEVGRADPVGAILAAPVRDTLKRAGDDGGIDATEPRERLWRALTPQLFRRHQLARALQEAADAGVEVTDEAMAMERQGLRPLLVEGSEDNFKVTTPADLSRFEFVLSRRER

SEQ ID NO: 4720 - protein, 1730 aa, Unknown
  Kingdom: Bacteria, Phylum: Proteobacteria
MSRTVVLAAAISLALAACSGKESTPVTDTQPAPTQQPADASANPLLSASTLPFQAPPFDKIKDSDYLPAFNEGMKQHLAEVRKIADNPEPATFDNTIEALERSGETLTRVSRIFFGLVQADTNDARQKVQEEVAPKLAEHQDEINLDPKLFARIKTIYDQRDALGLDPVQKRLVERDYQEFVRAGAQLNDADKASLRKLNVEETTLATQFHTRLVAATAAGAVVVDDKAKLAGLDEDAINTAAADAKARNLEGKYLLPLQNTTQQPVLGSLSDREQRAAVLKASETRAEKGDANDTRETIQRLAQLRAQKAKLLGFENYAAYSLADQMAKTPAAALKLLTDTVPAATAKARGEISEMQKVIDAQKGGFKLAASDWDFYAEQVRKAQYDLDESQIKPYFEMDNVLQNGVFYAATQLYGITFKPRTDIPTYHPDMKVYEVFDKDGTSLALFYTDYFKRDSKSGGAWMDVFVEQDGLTGAKPVVYNVCNFTKPAAGQPALLSFDDVTTMFHEFGHALHGMFSKVKYPSIAGTSTSRDFVEFPSQFNEHWALDPKVFANYAKNYKTGEPMPQALVDKILKARTFNQGYATTEYLSAALLDLAWHTQPADAKLQDVAPFEAAALKKFKVDLPQVPPRYRTSYFDHIWGGGYSSGYYAYFWAEVLDHDAFEWFKENGGLTPENGQVFRDKILSRGNSVELADLYREFRGKDPYRPLVGETLPFFWVAAPLGRALGPYALSGECPPASACGRPLPLYFASKGIGAQRPPHRPRASRPHVHAFGDLTAPQVIQRDLQRVHETLRAVPARHADALAHIRRQARLRGARIVVVHFHIGVVQMRQQALQARAVHACTGIEQGDFATAVIGHAQRIQQFLLRATGADRHRGARIDRAVHQRFENERRQRLRGTDQLPGRFRPPDDEDRHGSALHGLQAMGGDRQRQAAGILAAAAAHHPRGRGMLRMQVLVQRVIVVAGHLDVRHRQVLQRGAQCLAVARPLRCIDRCGGDQDQRRAAALGALQAAHQRRQGVAVAAGEPVSGDPRRQRRRVRYGVRRAGQGTCPPSVRSQPHPPWSARMDTPAAASAPADHRLLRWLKKEALPLLVMLGLLAAARDTLANHYQVPSGSMQHTLMPGDRVVVDMRAYGVRLPFTSVELLHTGQPQRGDVAVFDSPQDGTRLIKRIAAVGGDRVELHDGHLSINGHPLAQAGVGEIEDFGQHLAQLDLGQGGGPDITGLTVPAREVLMLGDHRGNSADGRFFGLVQASALYGKASHVYYRRGEGLTWQALPIRLWIDLSALPILSADSSLRPVHAGLIGMNGDTAAVPDRSPPTTTAAPAGDQIQQGSPAFRRTAAALFLAGFSTFGLLYTVQPLLPEFSRHFGVSAANSALTLSLSTGLLAVSMLIAGLISDRIGRRSVMVAALLASSVLSVATAMVDDWTTLLVLRTLLGIALSGVPAVGMTYLAEEMDSRALGLAMGLYVGGNAIGGMSGRLIAGIVADHWGWRWGIGVVSLIALLSTVLLWIQLPPSRHFQSRRGGLRELPSRWRSLFGDPGLPWLFATAFVLMGVFVTLYNYLGFHLLAPPYGLSQTVVGLIFSVYLVGTFSSAWMGQQANRHGRSRVLAICYGLIALGIVLLAMPWLGCMAAGIALVTFGFFGGHSVASSWVGSRAGAMRAEASALYLFAYYLGSSVAGVLGGVFYTHWDWLGVCGFVGVLTVAGGVIAWRLGQRVQPATAALALSR

SEQ ID NO: 4721 - protein, 315 aa, Unknown
  Kingdom: Bacteria, Phylum: Proteobacteria
MPHGNYRPPPSQMLRSWPSEPSIAPLNTPAGIRSNLPSPSLQGVPMAASRVRLHVEDSGGTGRPVVLIHGWPLSAESWRAQVPALREAGYRVVAYDRRGFGRSDKPADGYEYDTLADDLAGVIEDLDLKDATLVGFSMGGGEVARYVAKHGESRLHSVVFASAVPPYMLKTSDNPEGPLTQEKADEMREGLEKDRDTFFDGFTKDFFSANGELKVSEEERQAAIKLCQQSDQTAALGCMKAFGTTDFRGDLEKVTVPTLVLHGDSDGTVPFEGSGKRTHAAIAGSEVVVLKDAPHGCNASHADAFNKALLNFLKK

SEQ ID NO: 4722 - protein, 698 aa, Unknown
  Kingdom: Bacteria, Phylum: Proteobacteria
MSRFASACLVAGLISAGAAGTAMAADAPADKYAWLEDVTGDKPLAWVKEQNAKSEGRLAATPAFKQMETSIREVLDSDAKIPGVQKIGDYYYNFWKDKQHERGLWRRTTLAEYRKASPQWETVLDLDALNKAEGENWVWHGADCLRPDYSRCLIALSRGGADADVTREFDLANKTWIKDGFFRPESKGGLNWIDRDTVFVYTDFGTGTMTTSGYPRVAKLWKRGTPMASASVVYEGKPDDMYIAAMHDDTPGYERNLVSRTLAFYNNELYLRADDGTLTKIDAPNSAEKGLRKQWLTLELREPWTVGGKTYAAGSLLATKLDDYLAGKRDFDVLFAPTDTTSLAGTSWTKNHLVLNVLDDVKSRLSVLTPGDSGWKTTAFTGAPSFGTVAVSAVDADDSDAVWMTVTDYLTPTTLAIAEIGKQPEVLKTMPTFFNADGKVIEQHFATSKDGTRVPYFVVHRKDMKLDGSNPTLLYGYGGFEISLTPSYSGGMGRAWLEKGGVYVVANIRGGGEYGPRWHQAALKQNRHKAYEDMAAVARDLVSRKITSAKHLGVQGGSNGGLLTGNMLTQYPELFGAVVVQVPLLDMKRYSHLLAGASWMAEYGNPDTADWAFIKTFSPYHLFDASKTYPPVLFTTSTRDDRVHPAHARKMAAMMIDAGKDVTYYENIEGGHGGAANNAQAAHMSALAYSFLWEQLSK

SEQ ID NO: 4723 - protein, 328 aa, Unknown
  Kingdom: Bacteria, Phylum: Proteobacteria
MKAPVRVAVTGAAGQIGYALLFRIASGDMLGKDQPVILQLLELPVDKAQAALRGVMMELEDCAFPLLAGMVGTDDAEVAFKDADIALLVGARPRGPGMERKDLLLENAKIFTAQGAALNKVAKRDVKVLVVGNPANTNAYIAMKSAPDLNPRNFTAMLRLDHNRALSQLSTKLGKPVGGMEKLIVWGNHSPTMYPDYRFATAEGASIAEAINDQEWNASTFIPTVGKRGAAIIEARGSSSAASAANAAVDHIRDWVLGSNGKWVTMGVPSDGSYGIPEGVIFGFAVTTENGEYTLVKDLPVDDFSQKYIDKTLAELEEERSGVAHLLG

SEQ ID NO: 4724 - protein, 683 aa, Unknown
  Kingdom: Bacteria, Phylum: Proteobacteria
MLPPSPRSRRSVATLTVAIGLALASQAHADASADAASAKQMDTVVVTATGAQQWIKDAPASISVITREEIERKPVSSIGQLLSTVPGVTGGYALSGAQSKIRLRGLPEQYTLILIDGRRQGNSSGVNYRDDLGPQDLNWLSPDMIERIEVVRGPMSSLYGSDAMGGVINIITRKIANEWGGSVTYNYSKPDSSTRGNTLQMGGLFSGPLTQNLGLRIGANVTDRESDRGEYQTPGNKAENANALLNWRVNDDHTVGVEASRGEQRNRGAGDVGAWGLSKLVQTGYAIKHDGRYGDAATSKTTLVQNDYEDKGSTVGNHSKETVFDTAFTRSFHWGFEQSLNIGGQWKREELENSDTIGTVPVTWTGTGRITPTSEADSWALFAEDHITLHERFILTVGLRWDNTDNYDDNLSPRVYGVWHPSDAWTVRGGVSQGFRAPTLKQGTAGAATQSGGRGCTALTVEGWTSRSVSADGTTGCYMAGNPNLEPETSTNYEIGVGFDKNGWLASATYFLTDFDDKIQQVPLRDIPGQTSSFVNGFWWTVAQNVEKARTRGVEASVTVPLHEHLTWTTNATRMLESKNRTTGSNLLVVPKLTANTSLDWQVSDDWSLNLSAQHIGEQLVSTSSSTFAKAYTTWDLVAGFDVNQSLTLRAGVLNLGDVSTIEEGNDYDGGARTFFVGATARF

SEQ ID NO: 4725 - protein, 187 aa, Unknown
  Kingdom: Bacteria, Phylum: Proteobacteria
MSLINTQIQPFEANAYQNGEFIKVSDSTLKGHWSVLIFMPAAFTFNCPTEIEDAADHYAEFQKAGAEVYIVTTDTHFSHKVWHETSPAVGKAQFPLVGDPTHQLTNAFGVHIPEEGLALRGTFIINPEGVIKTLEIHSNEIARDVSETLRKLKAAQFTAANPNQVCPAKWKEGEKTLTPSLDLVGKI

SEQ ID NO: 4726 - protein, 366 aa, Unknown
  Kingdom: Bacteria, Phylum: Proteobacteria
MRFTLQREAFLKPLAQVVNVVERRQTLPVLANFLVQVQNGQLSLTGTDLEVEMVSRIAVEDAQDGETTIPARKLFEIIRALPDGSRITVSQTGDKITVQAGRSRFTLATLPANDFPSVDEVEATERVAIGEATLKELIERTAFAMAQQDVRYYLNGLLFDLRGDALRTVATDGHRLALCETELEKASGAKRQIIVPRKGVTELQRLLESGDREIELEVGRSHVRVKRDDVTFTSKLIDGRFPDYEAVIPIGADREVKVDREALRASLQRAAILSNEKYRGIRVEVSPGNLKISAHNPEQEEAQEEIEADTTVSDLAIGFNVNYLLDALSALRDEHVVIQLRDSNSSALVREASSEKSRHVVMPLRL

SEQ ID NO: 4727 - protein, 272 aa, Unknown
  Kingdom: Bacteria, Phylum: Proteobacteria
MRPMLSLLAVPVALAALSYAAPSHAAEGDDRFALRLGAMQIDSDNTIRGNTNIAGQDVGFSEDFGLGGKEWEPRIDGMFRISNRQRLLFNYFKYDKDRRETLDQGVSFGDTNVPAGSFIKGELKYQVASLVYDYSVVDTEKFDLGLQLGAEYAKVSTTAYADVGDLYQGRFLDEKADGVAPVVGARLSFTPSEKWMITFQGQYLNTKWGNFDDYDGDLSRANAIVDYRFTKNFGVFAGYDWFKLDVDQSGSDGTIGLKQEFKGPVAGVSFVF

SEQ ID NO: 4728 - protein, 363 aa, Unknown
  Kingdom: Bacteria, Phylum: Proteobacteria
MKLHTASIAALSLAIALGLSACKPGAEGQAAAPATDAPAAAPAAGDRLTAEISGAGASFIFPLVSKWSADYNTATGAKINYQSIGSGGGIAQIKAGTVDFGSSDKPLSSEELAQAGLGQFPSAIGGVVPVVNIDGLEAGKLRLSGALLADIFLGKVKTWNDPAIVAANPGVTLPDGKITLVHRSDGSGTTFNFSNYLSKVSPDWKSKVGEGTSVQWPDGVGGKGNEGVASYVKQIKGSIGYVELAYALQNGMPYASMQNAAGNWVQPSAETFAAAAASADWASAKDFNLVITNAPGDQAWPITATNFMLMHKQPKDAQRSKDTLAFFKWAFEKGQTQANELHYVPLPAELVTQIEAYWTSEFK

SEQ ID NO: 4729 - protein, 781 aa, Unknown
  Kingdom: Bacteria, Phylum: Proteobacteria
MPALRHAPVSTRLLSRSLSAAVLPRRRALALACASATLMLSAAASAQDAQPASATSLDTITVTADHRERNLQEVPVSVGVVQGEKIRDYTAGGDDTLLALSGKVPSFYAETTTGRIFPRFYIRGLGNIDFYLGASQPVSIIQDDVVLEHVVLKSNPVYDVDQIEVLRGPQGTLFGRNTTAGIVKFDTIKPSQDYSGRAQASYGSYGSVAIDGGFGGPINDIASFRVSALYQHRDDYVDNTYSGPSADGTVSPKKNAMGGFDDRNVRAQLLLQPSDNFSLLASAHARDYDGTSTLFLRSALTKGSNKTDVPRDKVAYDEADNNPQAYKTYGGSVKAIYDFGNVSLTSITAYETTSGYSRGDTDGGAAVNYPVNGVPNGYGQSMGQIRDLDQWTQEFRLANADDNRLKWQVGAFYFDGRDTTDFYQRAWFLQGNARNPKNWVRLRNVNTSWAGFGQVSYDVTDKFTLTAGLRQTKDEKKTRLLKTADTAAGAVTYKGRTYVEMSDTTPSWDLSAMYAFNPQLSVYARVARGFRGPTIQGRSAVFNADFTTANSETILSWEAGIKSSLWDNRLRVNAAAFTYVVNDIQLNGNDSDGNGVLFNADKAKAYGLEADMELRPIPNLALSAGVSLLHSKIQDDRVYAQVCALNGAVVCTVNDPTIKVGANTFAQINGNPLPNAPKYNINLAARYDMPVNDSDVFFVSTDWNKQGYTSFVLYDSAEFNSKGSFEGGLKLGYSANYGAWEVALFARNITNEKNLKGVIENYMAAVYNEPRTVGVSLNMNW

SEQ ID NO: 4730 - protein, 363 aa, Unknown
  Kingdom: Bacteria, Phylum: Proteobacteria
MNKKILTAALLGGLAFAQAASAQDFDDRWYLTGSAGFNFQDSDRLTNDAPFVTLGLGKFISPNWSLDGELNYQNPNFDANQDLNWSQYGASLDLRRHFIQEGRGWNPYLLFGLGYQKSEEEYAALNNNGPRERKDGNFAAKLGVGVQTTFEKRVAVRAEVAYRADFDDQSIAAPSEDWFGDVLASVGVVIPLGPAPVAAVPAPAPVAPSCADLDDDGDGVNNCDDKCPNSQPGQTIGPDGCPVPVSIDLKGVNFDFDKSNLRPDAVAILSEASEILKRYPDLRVEVAGHTDSKGTDAYNQKLSERRATSVYNYLTQNGVDASRLVGPIGYGESRPIAPNTNPDGSDNPEGRAKNRRTELNVQN

SEQ ID NO: 4731 - protein, 1088 aa, Unknown
  Kingdom: Bacteria, Phylum: Proteobacteria
MTHSRCLRMSKLTLGLVAALAAAPAFAQSTSAGVGGQVTSAAGSPVVGAEVTITHTESGTVSRATTDASGRYNARGLRVGGPYTITINKSGEGTKTEEGVYLNLNQVNTVNANLAGDIAAGATNLEAVQVVAVAGGSDVFSAYKMGTGTNVDRQTIESLPSVNRNIQDYIRLDPRISQVSKADGAISVGGQNTRYNAIRIDGIGAGDPFGLESNNLPTERQPVSMDAIQEINIDIANYDTTIAGGTGAVINAVTKSGTNNFGGTVYYAYRDKDMVRKDLEGVRFNGFDDEKTYGMTLGGPIIKDKVFFFANYEKMERSAPGVSLTDSPYGKGTITDADIARAQQIATGYGFDAGSLNAPANKTEVEEYALKIDWNISDNHRAAVRYNKLEQNVVRFPQISNSAVSLSSFWYQQPKTYESWMGELFSDWSENFSTEFKLSHKEYTSVRTTPSSLPQIQVRGFGNGGNDSLYFGTEQNSHVNAVESKELSAFGAATWYVGDHTVKFGFDYSDNDLLNYYGRNVNGAYVFSNLADFAAGRVNQYVVRAPRAGGSYDDIPAKYTLKNTGVFVQDSWAVNSNLTVQAGVRVDMPDFSSQRLYNPRIMELYGYDNTKLPDDKLVQPRFGFNYTFDTDRPTQMRGGVGLFGGAAPNVWLAGAYQNTGLNYTEYTVRNQNGIFTPDTNPPYIPAAGAGARQNVDIAAPDLKLPSVWKTNIAFDHELPWYGIVASAEFLYTKVNNAIYFERLDLRGKNGPVAATRIGQDGRELYWNDAGYVPCVGLAASPTNCSVREGAAGAGGKANRPDDMGDVLLMKNTDKGSSRQFTAGLNKPLTENWGWSLAYTYTAAKEVSPLTSSQNTSNWGSTLIGTANENVAYDSRYAIKDRVTGSINWKKAFFRDYNTSVGLFYEGRSGRPFSYIYYNDMNGDAAATTGAGYFNDLFYVPNGYGDVKFTGGAAMEKQFFDWLAANPQLEKYQGQIAPANAFRTKWTNSFDVHISQEFPGFMKEHKGELALDIMNVGNLINKKWGHIEDYGFNSTARVASYAGIDPATGKYIYNFTGSTDTPTIQENNNDKGNTGVSRWSMQLTLKYKF

SEQ ID NO: 4732 - protein, 702 aa, Unknown
  Kingdom: Bacteria, Phylum: Proteobacteria
MRQTVSLLPAVVPGRHTRALGPALLALSLAAACTAHAQSAPDGGARARSATDLDAIKVTAERTHTDTGALGDRAVRDTPFAISVVGREDIEKRQVVSLGEAFLTDPSVVTQVSAYASGWSSPIRNRGIDLSYDSYRVNGLQVSSWGTEWPLEVMEQVELLKGPGGFMYGFGQPGGIVNYVTKKPTEVTTLSAQLGWREAGIVSGQVDVGGRFGNEDMFGYRFNAYQEKGETFNGGDVNRKVGALSLDARLSDRLTWTFDGVFQSRELSNESPQYYFIGLTELPRPLAGDIDNSIDGSYYDTRSSLLSTALNWQINNDWKASLSYGVTTSWNDVNKIFAYIDDVNGDYDINTYELGGKSEWKLAQAIVQGRFQTGPLSHQVVAGVSHQTGLGWDRPYEWNTLGRGNIYQRPTLRHDAVGSRVLSRGSETVQQAVFVSDTVSFADGWSLLAGARYNDFENKGAYHTYPVTPTYALMYKPADAVTVYASYVESLEAGSRVGSDYINAGDVLDPTISKQVEIGAKIEYPRWSANAAAFRLERGANIDLITSAGKLLVQDGITLYEGVEVSGDVRLTDAFTLGGGVTWLDPTYDKLSPGSASQEGNRTAGAARWQGVLHADYSIPQIEGLSVYALARYYGDVYYDADNTLKLPDYTLVNAGVGYRMQAAGHPVTWRAGVENLANKKYWSNAGVGLPRTFAVSVRFDM

SEQ ID NO: 4733 - protein, 171 aa, Unknown
  Kingdom: Bacteria, Phylum: Proteobacteria
MNKTTRVLLVSLLSVAALAGCSKKVKEVPAAPVDTGSTTAPTGPSTSGLYGPGDLDTDSCLRQRVVYFDLDKEDVKPEFQAIMACHAKYLRDRPSSRMTLQGHTDERGSRAYNQALGERRGNGVSSALQANGGSASQLTVVSYGEERPVCTESGESCWSQNRRVEIVYTAQ

SEQ ID NO: 4734 - protein, 924 aa, Unknown
  Kingdom: Bacteria, Phylum: Proteobacteria
MKIKILTGLALAASVAFAPAAHAEIVIGLVAPLTGPVAAYGDQVKNGAQTAVDVINKNGGILGEKVVLKLADDAGEPKQGVSAANQLVADGIKFVVGPVTSGVAIPASDVFAENGVVMVTPTATAPDLTNRGLTNIFRTCGRDDQQAEVAAKFVLAQLKDRQIAIIHDKGAYGKGLADAFKKTLNAGGVTEVMYDALTPGEKDLSALTARLKSEGVDVVYFGGYHPEAGLLVRQLHDIGAKATVIAGDGLSNSEFANIGGTAADGTIFTNAADATKSADSKAAAEALKAANIPAEAFTLNAYAAVEVLKAGIEKAGSAEDSEAVAAALKGGEPIPTAIGKLTYGETGDLTSQAFSLYKWQGGKIIDQGTGREKADIVLKGGRFFDLVTGELVASDIAICGDTIVGTCETYHGVEEIDISGQIVVPGFIDTHLHIESSLVTPHEFDRCVLPYGVTTVICDPHEIANVLGAEGIQFFLDSSLETIMDIRVQLSSCVPATHLETAGADLPIEKLLPFRDHPQVIGLAEFMNFPGVIHKDPICMAKLEAFQGQHIDGHAPLLSGTGLNGYLSTGIRTEHECTSAKEALEKIRKGVHVLVREGSVSKDLHALMPIITERLSPYLALCTDDRNPLDIAEQGHLDYMIRTAIANGVKPLAVYRAASISAAKAFGLRDRGLVAPGWRADLVVIDTLQNCKASMVFSAGRRVTDALFATRKSVAPVGLDSVKARRVLAAHFGVPVTEGKTSVLGVLPGKIITEHRRYKLPSDGNQTSVDLDNDIIKVAVIERHGKNGNHANGFVQGFGLKKGAIASTVGHDSHNICVVGVSEDDMALAANRLGEIKGGFVVAENGRITGEIALPVAGLMSLEPYESVRDTLHTLRQAAYALGTTLEEPFLQVAFLPLPVIPHLKISDKGLVDVDLFKLITAEG

SEQ ID NO: 4735 - protein, 531 aa, Unknown
  Kingdom: Bacteria, Phylum: Proteobacteria
MAPRVLVSDELSETAVQIFRDRGVEVDFQPKLGKDKDKLAEIIGNYDGLAIRSATKATEKLIESAKNLKVIGRAGIGVDNVDIPAASRRGIIVMNTPFGNSITTAEHAIALMFAVARQLPAADTSTQAGKWEKSKFMGVEITGKTLGVIGAGNIGSIVCSRALGLKMNVLAYDPFLSPERAKEMGVTKVELDELLAQADFITLHVPMTDKTRGILGAQNLAKTKKGVRIINCARGGLVDEAALADAIKSGHVAGAGFDVFEVEPATESPLFGLPNVVCTPHLGASTTEAQENVALQVAEQMSDYLVKGAVSNAINMPSITADEAPRLKPFIKLADVLGSFVGQVQESATKEIEILYDGATANMNTKALTSALLAGLIRPQVADVNMVSAPIMIKEKGIILSEVKRDKTGVYDGFIKLTVKTENQVRSVAGTVFSDGKARFIQIKNINMDADVGQHMIYITNTDVPGMIGFMGTTLGEAGVNIANFQLGREANGGDAIALLYVDGPVSEEVLDKLRANPAIRQVKPLTFNID

SEQ ID NO: 4736 - protein, 1377 aa, Unknown
  Kingdom: Bacteria, Phylum: Proteobacteria
MTASIDINNVSKHFGGLTVFEGLSLSIPAHEFVVFLGPSGCGKSTLLRMIAGLESVDDGEIHINGERIDDQPPGKRGVAMVFQSYALYPHMTVRDNMAFGLKNIAVERSVIDARIAEAARMLEIGHLLERKPGQLSGGQRQRVAIGRAVVKEPKAFLFDEPLSNLDAALRTRTRIELAQLHQRLKSTMIFVTHDQIEAMTLADRIVVMNNRQIEQIGTPMEIYNRPASRFVAGFVGAPAMNFLPVTIGTDAGLVTVETASGIRMATAIPATGIAPGAFELGLRSEDVRITSQGSGNADGVVDVVERLGERTLVYVRLADGQQLVGSDSGDSRVSVGDRVGLSFDSTKAHLFDASGRAWHAREGAGAVSVKRARSVDIYAPQWRNFLFVAPYLVFFVTLLVVPLFWGIWLSFHKADTFSSGPFIGFGNYVRLFNDRIFLQSIWNTFYFVLLTVPSLALLGLFLALCLNRRTRSAAVLRGLFFSSSVLSVTIVTLIWRIVYIPDIGLLSMIFGLFGARAPAFLSDPSLAMIGIAIATVWWCIGLPMMLFLSALQQIPQDIYEAAALDNANRWQTLRSITLPSIKRTFVLVVIIQIVFQFQLFGQALLMTRGGPNNLTKPIVFYIYETAFRRWDLGLGAAASEILFVLILVAAMNSNIIGRSFGDRVLYGLVILLAIVMAAPVLYVIALSLKDNNALMVDPHSVFQLPYTIKNYIDTIGTSSVFLWVFNSIVVAGGMTIMTLILSSLAGYGFARLNFPGRDVLFVLVLLGLAVPEQAVLIARHQIFSWLGLHNSYPGLILPGLSSAFGVFLMTQYFRAIPKELDEAAILDNASRFRVFWKVLLPLTVPAQATLGIFTFLGAWNDYFWPLISATKKEMFTLTVGIASTQMNFAQSQGIGFLMAQAVFAGAPILIIYLFFQKYIVTAVSGAAATAKPEEEETIMTLRTLFLATISAAAVLVASPSFAETELQVQRFFGACDADFGKNTDISKAVGECGIITSMINKFAADNPDIKINVTTVEWPGYDQLTAQFASGDAPDIVTIHESVLSDYQSKDLLVPLDDMLKTVGVTSDKFTDAAKEGVTKNGKIYGLPIDNWTMLYHINMDLFKTAGLVNADGTPILPKSPEELLAQAEQFKQKTGKPYFVQNLANETALYARNLYTYLFQQNSDFFADPKKVKFNTPEARKIVEMYKTIFEKDDTTKDLDYGGSINAFLGGEGGVHLNGTWMVGDYNAQSEKPGTALNKGGYAVYPYPQLFPGAKAQYADGHSWAVSKKDRTPEQEAAIAKFLKFFADNDFEWSRTGHLPAYKAVIESAEFKALPHRDTIAPIATLGKPLPSAVQRQFAIQDIVGEEMSAAITGQKDVDSALADMESRVNELLANL

SEQ ID NO: 4737 - protein, 1491 aa, Unknown
  Kingdom: Bacteria, Phylum: Proteobacteria
MQRIAPIAGFTALLLLGSTLQTVAQAEGEPVQASRNNLPAIVVTEVAKRDLVDRVIATGTIRPVDEIYVQPQVEGLALDKLNVDVGDKVEAGAVLAELSRDSLLLQKSQLEANRAKAEAGVAQSKAQVIEAQANLDDAVRQKDRAARLGQSGSGSVSQVEQTAAAADVAKARLEAARQTVTVGEADIKVVDAQIEDIDLKLARTGVKTPVAGVISAKNARIGAIASGSGNPLFTIIRDGAIELVADLSETDIQKVEVGQKARLTVAGGNQKIEGTVRIVSPTVDPTTRLGAVHIVLPANSPARAGMYANAEIVIASANALALPLSAVTSGRDGSTSRKVENGVIRQVKIETGIQDSGFVEIKQGLSQGDKVVEKAGAFVRDGTTMNFSAWSIRNPIAPLLAFALLLFLGIKAFYDLPITRFPNIDVPVVAITVTQSGASPSELEAQVTKEVEDAVASISGIDEIQSTVTDGQSLTTVLFRIEKPTEEAVQDTKDAIDKIRSNLPAGIEEPVVSKIDVEGQAIQTFAVSSPNMTLEELSWFVDDTIKRALQGQPGVGKIDRYGGADREVRVSLNPSKLDAYGITAAEVNNQLRGTNIDLGSGRGQVGGNEQTIRTLGDARNVAELSNTTIALPNGNFVKLSELGRVTDTYEEPKSFSRFNGNPAVTFAVFRAKGASEVTVSETVAQNLDKVRTDHPDVAIQMVDDSVYFTYGNYEAALHTLMEGSILAVIVVLLFLRNWRATLIAAVALPLSAIPTFWVMDLLGFSLNLVSFLALTLATGILVDDAIVEVENISRHIKMGKTPYRAALEAADEIGLAVIATSFTIIAVFVPVSFMPGIPGQYFIQFGLTVAFSVFFSLMVARLITPLMAAYLMRADDAVDDHHDNDGRLMKAYTRMVTGTTRRWWARYLTLLGAIGFLVASLMLLAQVPGSFLPPDDSSRVVLSIELPPNATLDETDATTAKINDAIKGIDGVESVFILGGASPKGDLELRRATVRVILKKIDHSLLKTIVNQGFGSIPLIGPHLPKIEENGRTRPQWDVERDIFASVHDIPDVRIIKLNDRAERELAFNFLSSSEEDLNQAVGILESRLRASPILANVSSEGALPRPELQIRPRKDEIARLGITPQQISQTVRVATIGDIDAQLTKISLDDRQIPIRVQTSLDVRRDLAAIRALKIKTASGATVPLYSVADIDYSEGPSSIKRNDRNRVVAIGSDVPFGTALDTSTNEFKRIVEETKLPPTVRLAESGDAKVQGEMQQGFVNAMLLGLLLVLVVLILLFKDVIQPFTILFSLPLAIGGVAVALIVTQNALSMPVLIGILMLMGIVTKNAILLVDFAIEMRRHGMERVQAMVEAGRKRARPIIMTSIAMSAGMLPSALGVGEGGSFRAPMAIAVIGGIIVSTVLSLIVVPAFFLIMDDLSRLLSHLFGRFVGKKEEEHPILSSEELSNVARENSEAIASMEERMAAVEKNAPKDNRNGKSDNVLRLPPLAAE

SEQ ID NO: 4738 - protein, 820 aa, Unknown
  Kingdom: Bacteria, Phylum: Proteobacteria
MINKLATNDLPRPAPRSSEPDVLASEIIERLTYRIGKDVKVAKPHDWLTATILVVRDRIIDKWMESTRKAYQNDSKRVYYLSLEFLIGRLMRDAISNLELMEEIRQALTSLGVEFDVIAGLEPDAALGNGGLGRLAACFMESMATVDIAAYGYGIRYVHGLFRQQMADGWQVELPETWLAHGNPWEFERRESAYEIGFGGTVETIGGYEDPQRFLWKPAERMIAMAYDTPVVGWRGTRVNTLRLWSAQPIDPILLDAFNAGDHIGALRESNKAESLTRVLYPADANPAGQELRLRQEYFFSSASLQDILRRHLQQYPDFTNLPDKVSIQLNDTHPAISIAEMMRLLCDVHGMDFEEAWTITRGTFSYTNHTLLPEALESWPVPLLERLLPRHMQIIYAINANTLIFARKEKKLSDGQIRSISLIDEGGERRVRMGNLAFIGSHSINGVSALHTELMKETVFSDLHMLFPNRINNKTNGITPRRWLMQCNPGLTSLIRDAIGDAFMDDAEKLLDLDRFAKDSSFRDKFAEIKRQNKVRLANTVAQRMGIRVDPSALFDIQIKRIHEYKRQLLNLIEAVALYDQIRSHPELDWVPRVKFFAGKAAPSYHNAKLIIKLANDIARVINNDPAVRGLLKVVFIPNYNVSLAEIMVPAADLSEQISTAGMEASGTGNMKFALNGALTIGTLDGANVEMLEHVGEDNIVIFGKTADEVAKARSEGHNPRAIIENSAELAQAVSSIASGVFSPDDRSRFTGLMDGLYNNDWFMVAADFDAYAQAQRDVDAIWSNPSSWFEKTVRNTARMGWFSSDRTIRQYATEIWRA

SEQ ID NO: 4739 - protein, 392 aa, Unknown
  Kingdom: Bacteria, Phylum: Proteobacteria
MTDIVKPDVRPGNTHFSSGPCSKRPGWSLDALADAPLGRSHRAKVGKAKLKQAIDLTREILNVPADYRIGIVPASDTGAVEMALWSLLGERGVDMVAWESFGAGWVTDVVKQLKLKDVRKFEADYGFLPNLAEVDFDRDVVFTWNGTTSGVRVPNADFIPADRKGLTICDATSAAFAQDLDFAKLDVTTFSWQKVLGGEGGHGVIILSPRAVERLTTYVPAWPLPKIFRMTSGGKLIEGIFTGETINTPSMLCVEDYIDALLWAKNLGGLKALIARADANAKVIFDFVAENNWIANLAVADETRSNTSVCLKIVCKDVAALDAGAQADFAKGMVALLEKENVALDIGAYRDAPSGLRIWAGATIETADMKAVMPWLKWAFETQKATLAKAAA

SEQ ID NO: 4740 - protein, 1422 aa, Unknown
  Kingdom: Bacteria, Phylum: Proteobacteria
MSPRERATPEAYLADTAELKVTPLHSLHLSLGARMVPFAGYDMPVQYPAGVLKEHLHTRASAGLFDVSHMGQVIVKAKSGKVDDAALALEKLVPVDILNLKAGRQRYGFFTDENGCILDDLMITNLGDHLFVVVNASCKEADLAHMKAHLSDSCEITLLDDRALIALQGPRAEAVLAELWAGVSDMKFMDVREIPLHDVPCIVSRSGYSGEDGFEISVPADKAEEIAEALLEHPDCEAIGLGARDSLRLEAGLCLYGNDIDTTTSPIEASLEWAIQKARRAGGDREGGFPGADRILGELGNGTSRRRVGLKPEGKAPVRGHSKLFADAEGKTEIGEVTSGGFGPTVEGPVAMGYVPTDYTTPGTAIFAEEHEWLKIEGDVATVGITTHAAEQLGDLVFVELPEVGATFSKNGEAATVESVKAASDVYCPLDGEIVEINQAIVDDPSLVNSDPQGAGWFFKLKLSNTADADALLDEAAYKELPYDFANRRHIGPSPAEMEEMLKVVGYKSLDALIDATVPSSIRQKDPLAWGAALTEREALDRMRETANKNKVLTSLIGQGYYGTITPPVIQRNILENPAWYTAYTPYQPEISQGRLEALLNFQTMISDLTGLDVANASLLDEATAAAEAMSMCQRVAKSKANAFFVDANCHPQTIALIETRAAPLGWKVVIGNPFTDLDPVDVFGAIFQYPGTHGHVSDFSGLISRLHQTGAIAAVACDLLALTLLKSPGEMGADIAIGSSQRFGVPVGYGGPHAAFMAVKDAHKRSMPGRLVGVSVDARGNRAYRLSLQTREQHIRREKATSNICTAQVLLAVMASMYGVFHGPQGIKAIAQQTHQKAVLMAKGLEKLGYKIEPDTFFDTITVEVGHMQALILRAAVAEGVNLRKVGSTKIGMSLDERTRPATLEAVWRAFGGNFSISDFEPDYRLPKDLLRTSAYMTHPIFHMNRAESEMTRYIRRLSDRDLALDRAMIPLGSCTMKLNATAEMLPITWPEFSDIHPFVPADQALGYKEMIDDLSAKLCAVTGYDAFSMQPNSGAQGEYAGLLTIRNYHLARGDAHRDVCLIPTSAHGTNPASAQMVGMKVVPVRAKENGDVDIDDFRAKAEQYAENLSCCMITYPSTHGVFEETVREICDIVHKHGGQVYLDGANMNAMVGLSRPGDIGSDVSHLNLHKTFCIPHGGGGPGMGPIGVKAHLAPYLPGHPASDGRAGAVSAAPFGSPSILPISWSYCLMMGGEGLTQATKVAILNANYIAARLKGAYDVLYKSEAGRVAHECIIDTRPLNDSCGVTVDDVAKRLIDCGFHAPTMSWPVAGTLMIEPTESETKAEIDRFCDAMLTIRQEARDIEEGRADKLNNPLKNAPHTVEDLVGEWDRPYSREQGCFPPGSFRVDKYWSPVNRIDNVYGDRNLVCTCPPMSEYQEAAE

SEQ ID NO: 4741 - protein, 333 aa, Unknown
  Kingdom: Bacteria, Phylum: Proteobacteria
MTTIKHAAFAAFAAALSTTSAFAHTSFVNGTAEEDSTIVAALQVPHGCEGGLATTEVQVVLPEGFISAKPQPKAGWELEIIKGDYQKTYKNHGKDVKSGPVEIRWKGGNLSDDFYDTFNIQGKIAGVAPGKTLPFKVKQLCGDKGTASWDQIAAEGKDPHSLDNPAPVIRITAKQNEEGEGHAHHDHGAMADTSASAGVVKVGELELSAASTKAMLPGQPVGGGFVTIRNTGTSDDRLVSVSSPLAGRAEIHEMAMANDVMKMRKLNDGIVVPAGQTVELSPGGLHFMFFNVKKPFAEGDKVPVTLTFDKAGEVSIELPVGPANPGEAKHNHN

SEQ ID NO: 4742 - protein, 289 aa, Unknown
  Kingdom: Bacteria, Phylum: Proteobacteria
MSSINFNSSATNALQTLRDVNSKLQNTQNTVSTGLKVSSAKDNVAYWSISTTMKSDNKALGAATDALGVGAAKVDTAYAAMDSAIDVVNEIKSKLVTASESSVDKDQVNLEIEKLQEQLTAIGQAASFNGENWMVTSTKTTVVDGFTRKEDGTVKINTAEFQAGSYAMFSTIASGVGSGGILSAVMTIELTSAATQGKIDTYLSTVETALKELTKGAAALGAMSTRIDLQDKFASKISDAMKAGVSKLVDADMEEESARLASLQTQQQLAVQSLSIANNSSQSILSLFR

SEQ ID NO: 4743 - protein, 280 aa, Unknown
  Kingdom: Bacteria, Phylum: Proteobacteria
MSALQTLRSINSDMKDTQSSVSSGLRVGQASDNVAYWSISTTMKSDNKALGAATDALGVGAAKVDTAYAAMDSAIDVVNEIKAKLTTASESSVDKKQVQLEIDKLQEQLTAIGQAASFNGENWMVNDTKTTVVDGFIRKEDGTVKVNTAEFQAGSYAMFSTIASGVGSGGILGAIMTIELTSVTTQGQIDTFLNTVQTSLDSLTDGAAALGALKTRIDMQDSFSSKLSDAIKSGVSRLVDADMEEESARLSALQTQQQLAVQSLSIANSGSQQLLSLFRG

SEQ ID NO: 4744 - protein, 240 aa, Unknown
  Kingdom: Bacteria, Phylum: Proteobacteria
MNSDKKALNAAADALGVGAAKVDTAYAAMESAIGAVNEIKAKLVTASEQSTDKGQIQLEISKLQEQLSAIAQGASFSGENWLVTQNTQANVVDGFVREADGTVKVTVATFNVGTYALFSTIGANGLGSGGVLGSIMSVALTSVSTQGDIDGFMNIVESALSKMTDSAAAIGALQIRVELQDKYSSKLSDAIEAGVSRLIDADMEEESARLSAVQTQQQLAIQSLSIANSSSQNLLSLFRQ

SEQ ID NO: 4745 - protein, 140 aa, Unknown
  Kingdom: Bacteria, Phylum: Proteobacteria
MAIERTFSMIKPDATKRNLTGAITKVFEENGLRVIASKRVWMSKREAEGFYAVHKERPFFGELVEGMTSGPTIVQVLEGENAILKNREIMGATNPAQAAEGTIRKTFALSIGENSVHGSDAPETAAQEIAYWFAETEIVG

SEQ ID NO: 4746 - protein, 372 aa, Unknown
  Kingdom: Bacteria, Phylum: Proteobacteria
MNIKSLLIGSAAALAAVSGAKAADAIVAAEPEPLEYVRVCDAFGTGFFYIPGTETCLKFGGYVRFQTEFGRDRSGTSDWDSFTRAQFEVDTRTDTELGALRGFIGFRGNADSGVGGATAGTSGNQGSGVFVDQAFIELGGLKVGKFYSWWDDGLSGEADVLSTNALFNSIRYTYDAGSFWAGISVDELEGTNAGFVTVTGPGVGTQEADNNVGITGGIGGNLGGAAMQLIGSYDVDQEEGAVRLIATAEIGPGTLGLAGVWASGANAYYAESEWAIAAEYAIKATDRLTITPGGQWFGNVADRAAILLPGATATTTGIITNDFSNRDAWQAGITVDYKITEGLTTKVAVNYYDEDGGNNDEWNGFVRLQRSF

SEQ ID NO: 4747 - protein, 257 aa, Unknown
  Kingdom: Bacteria, Phylum: Proteobacteria
MLNPTRLFAAASIAALSLFAGSAMAQDKIVIGTEGAYPPFNVLEADGKLTGFDIDIAKALCEQMKAECTFVTNDWDGIIPALQAKKFDAIVASMSITPERLEKVDFSEKYYNTPPAIAVPKDSPIKSVEDLKGKTIGAQGSTTHANYAEKHLADSELKLYPTADEYKLDITNGRIDGVIDDIVVLSQWVKSDAGACCKILTAMPVDEQINGKGAGIAVRKGDKALADKFSAAIKAIRANGKYKEINDKYFDFDVYGQ

SEQ ID NO: 4748 - protein, 181 aa, Unknown
  Kingdom: Bacteria, Phylum: Proteobacteria
MTNIIAQLEAEQAAKIEAKRKLPEFSPGDTVRVNVRVTEGNRTRVQAYEGVVIARSGGGLNENFTVRKISYGEGVERVFPVYSPLVEGVEIVRRGKVRRAKLYYLRDRRGKSARIVEDTGVRARKLNDAERQAAAEEKARIEAEKVAAAQALAAEKAAAEAAEAKAAEEAAAAKAAEGAAE

SEQ ID NO: 4749 - protein, 141 aa, Unknown
  Kingdom: Bacteria, Phylum: Proteobacteria
MRHGNSGRKLNRTASHRKAMFANMAASLITHEQIVTTLPKAKEIRPIVEKLVTLGKRGDLHARRQAISQIKDQDAVRKLFDAIAARYANRNGGYIRIMKAGFRQGDNAAMAVVEFVERDVDAKGAADKARVAAETAAAEAA

SEQ ID NO: 4750 - protein, 273 aa, Unknown
  Kingdom: Bacteria, Phylum: Proteobacteria
MPTVNQLIRKPRQAQVKRNKVPALQENPQKRGVCTRVYTTTPKKPNSALRKVAKIRLTNGFEVIGYIPGEGHNLQEHSVVMIRGGRVKDLPGVRYHIIRGVLDTQGVKNRKQRRSKYGAKRPNAEKREINPDPKFGDLVVTKFMNAIMLHGKKSVAESIVYGAFDAVQGKTKQEPLGVFHSALDNVAPHVEVRSRRVGGATYQVPVDVRPERRQALAIRWLIAAARKRNETTMVDRLSGELMDAANNRGSAVKKREDTHKMADANRAFSHYRW

SEQ ID NO: 4751 - protein, 354 aa, Unknown
  Kingdom: Bacteria, Phylum: Proteobacteria
MKSIISLFAACAIGAAAFASPVWAQDKGTVGIAMPTKSSARWIDDGNNIVKQLQDAGYTTDLQYADDDIPNQLSQIENMVTKGVKVLVIASIDGTTLSDVLKQAGEQGIKVIAYDRLIRNSGDVSYYATFDNFQVGVLQATSIVDKLGLKDGKGPFNIELFGGSPDDNNAFFFYDGAMSVLKPYIDSGKLVVKSGQMGMDKVGTLRWDPATAQARMDNLLSAYYTDAKVDAVLSPYDGISIGIISSLKGVGYGTKDQPLPVVSGQDAEVPSVKSILAGEQYSTVFKDTRELAKVTVNMVNALMEGKEPEVNDTKTYENGVKVVPSYLLKPVAVTKDNVEKVLVESGYYKADQLK

SEQ ID NO: 4752 - protein, 169 aa, Unknown
  Kingdom: Bacteria, Phylum: Proteobacteria
MAEIKDPENTLIMETTTGKVVIQLLPDVAPGHVARIKELVSEQAYDGVVFHRVIADFMAQTGDVKFGKKSSADFNPARAGMGGSEKPDLKAEFSAIPHVRGTCSMARSQSPNSANSQFFICFTDSPWLNKQYTVWGQVIEGMDAIDKIKKGEPVKDPDSIVSIRLASAA

SEQ ID NO: 4753 - protein, 69 aa, Unknown
  Kingdom: Bacteria, Phylum: Proteobacteria
MATGTVKWFNATKGYGFIQPDDGAQDVFVHISAVERAGMSGLKDGQKISYELVQDRRSGKMSADSIVAA

SEQ ID NO: 4754 - protein, 359 aa, Unknown
  Kingdom: Bacteria, Phylum: Proteobacteria
MVAFSGSAWADVLIGVGGPLTGPNAAFGAQLQKGAEQAAADINAAGGINGEKIKIVLGDDVSDPKQGISVANKFAADGVKFVVGHFNSGVSIPASEVYAENGILEVTPAATNPVFTERGLWNTFRTCGRDDQQGGIAGKYLADHFKDAKVAIIHDKTPYGQGLADETKKAANAAGVKEVIYEGVNVGDKDFSALIAKMKEAGVSVVYWGGLHTEAGLIIRQAKDQGLKATLVSGDGIVSNELASIAGDAVEGTLNTFGPDPTLRPDNKDLVAKFKAAGFNPEAYTLYSYAAVQVIAEGAKAAGSLDAEAVAAALKKGTFKTVLGDISFDEKGDPKLPGYVMYEWKKGPDGKYSYFQQGM

SEQ ID NO: 4755 - protein, 209 aa, Unknown
  Kingdom: Bacteria, Phylum: Proteobacteria
MSNKFKSYAVAVAAMVAASPVVAADLTSSYEAPPTYNEPASSSWTGAYAGGHIGAAMPSANPFRDGKGLALGVQGGYNYDLGGAVVGGELEATHLGDTRVSVPNGNLRERWRVAAKAKAGVKMDETLIYGTAGLTVTSLRDGDNVVGPDGMKEGYLLGAGIEHKFNQQISGKVEYNYVATNDVRTFSGATTSRTDISDNVVKGGLNYHF

SEQ ID NO: 4756 - protein, 205 aa, Unknown
  Kingdom: Bacteria, Phylum: Proteobacteria
MSKRESSKYKIDRRMGENIWGRPKSPVNRREYGPGQHGQRRKGKMSDFGTQLRAKQKLKGYYGEIREKQFRATYDEANRRKGDTSENLIGLLESRLDAIVYRAKFVPTVFAARQFINHGHVTVNGVRVNIGSYRCKVGDVIEVRQKSKQLAIVLEAVQLAERDVPDYIEVDHNKMTATFARVPALADVPYAVIMEPHLVVEFYSR

SEQ ID NO: 4757 - protein, 579 aa, Unknown
  Kingdom: Bacteria, Phylum: Proteobacteria
MIQMQTNLDVADNSGARRVMCIKVLGGSKRKYASVGDIIVVSIKEAIPRGRVKKGDVMKAVVVRTAKDIRRADGSVIRFDNNAAVLIDNKKEPIGTRIFGPVPRELRGKNHMKIISLAPEDKGRTGEVIQVMPKEDRAVVRGVNMVKRHQRQTQSQEAGIINKEASLHISNIAIADKDGKPTRVGFKVVEGKKTEYVNRIRGAMQEKFSYANVMMIPKLDKIVINMGVGEATADSKKPTVAAGDLAAIAGQKPVVTRARNSIAGFKVREGMPIGAKVTLRGARMYEFLDRLVNIALPRVRDFRGLNPKSFDGRGNFAMGIKEHIVFPEINYDKVDQMWGMDIIVCTTAPTDDEARALLTEFNFPFLEKNKRRRKTVASQAGKRAALKAIVMNQSLPIEERFQATLKLASLPRDGSKTRIRNRCEVTGRPRAFYRKLKMSRIALRDGHMTMTDPLGDMLTRIRNGASRRKSSVSTPASSLRARVLDVLQAEGYIRGYSKVDFENGKSEFTIELKYYEGASVIREIGRVSKPGRRVYVSVKSIPQVANGLGITILSTPKGVMADHQAREQNVGGEVLCSVF

SEQ ID NO: 4758 - protein, 319 aa, Unknown
  Kingdom: Bacteria, Phylum: Proteobacteria
MTSKLDQLRAITTVVADTGDIEAVARLKPVDCTTNPSIVLKALGTPAFADTVKEAVAWGRKQGGASEGVIAAVADRLAISVGAALVDLVPGRVSTEVDADLSFDTKASIDKAHSIIAAYKERGIERERILIKLASTWEGIKAAEVLQAEGIDCNLTLLFSQAQAIACAEAKAFLISPFVGRILDWYKKSTGETYTAETDPGVLSVRQIYNYYKANGISTVVMGASFRNVGEIEALAGCDRLTISPALLEELDKDTGTLERKLSPDHAKAEPLQSLDEKSFRWQLNEDAMATEKLSEGIRLFAKDLVSLREIVRKELAAA

SEQ ID NO: 4759 - protein, 336 aa, Unknown
  Kingdom: Bacteria, Phylum: Proteobacteria
MTVKVAINGFGRIGRNVLRAIVESGRTDIEVVAINDLGPVETNAHLLRYDSIHGKFPAEVKVEGDTITVGGGKPIKVTAVRDPATLPHGELGVDIALECTGIFTARDKAAAHLTAGAKRVIVSAPADGADLTVVFGVNHDQLTKDHLVISNASCTTNCLVPVVKVLDDLIGIDHGFMTTIHSYTGDQPTLDTMHKDLYRARAAALSMIPTSTGAAKAVGLVMPHLKGRLDGTSIRVPTPNVSVVDFKFVAKKATSVAEINEAIKAASNGALKGVLGYTDEPLVSRDFNHDSHSSIFATDQTKVMEGNFVRVLSWYDNEWGFSNRMSDTAVAFAKTI

SEQ ID NO: 4760 - protein, 91 aa, Unknown
  Kingdom: Bacteria, Phylum: Proteobacteria
MNKNELVSAVAEKAGLSKADAASAVDAVFETVQNELKAGGDIRLAGFGSFSVSHRKATKGRNPATREEVDIPARNVPKFSAGKGLKDAVNS

SEQ ID NO: 4761 - protein, 544 aa, Unknown
  Kingdom: Bacteria, Phylum: Proteobacteria
MAAKEVKFGRSAREKMLKGVDILADAVKVTLGPKGRNVVIDKSFGAPRITKDGVSVAKEIELEDKFENMGAQMVREVASKTNDIAGDGTTTATVLAQAIVREGQKAVAAGMNPMDLKRGIDLAVSEVVKDLQAKAKKINTSEEVAQVGTISANGDTQVGRDIAEAMQKVGNEGVITVEEAKTAETELEVVEGMQFDRGYLSPYFVTNPEKMIADLEDAYILLHEKKLSNLQAMLPVLEAVVQTGKPLVIIAEDVEGEALATLVVNKLRGGLKIAAVKAPGFGDRRKAMLEDIAILTGGTVISEDLGIKLENVTLDMLGKAKKVSISKENTTIVDGSGQKTDIEGRVAQIKAQIEETSSDYDREKLQERLAKLAGGVAVIRVGGATEVEVKERKDRIDDALNATRAAVQEGIVAGGGTALLRSAQKITVKGVNDDQEAGINIVRRALQSLVRQIADNAGDEASIVVGKLLDKDDDNFGYNAQTGEYGDMIAMGIVDPVKVVRTALQNAASVASLLITTEAMIAELPKKDSAMPAMPGGGMGGMDF

SEQ ID NO: 4762 - protein, 532 aa, Unknown
  Kingdom: Bacteria, Phylum: Proteobacteria
MRYKFGIIAAALLSATCFANVASAKTFVYCSEGSPEGFDPGLYTAGTTFDAAAHTVYSRLLEFEKGTTKPIPGLAESWEVSKDGKEYTFKLRPGVKFQTTDFFTPTRDLNADDVVFSIERQIKTDNPWHQYVPGTSWEYAAGMGFPELIKSVEKVDDMTVKFTLNRPEAPFLANLAMPFASIVSKEYTDKLAAEGKQAELNQKPVGTGPFTFVGYQQDAVIRYKANKDYWGGAPKIDDLVFAITTDAAVRYQKLKAGECHLMPYPNAADVQSMKSDSNLKVMEQEGLNVAYLAYNTTQAPFDKVEVRKALNKAINKKAIVDAVFQGMATPAKNPLPPTMWSYNDKIEDDTYDLDAAKKMLADAGVKDLSMKVWAMPVSRPYMLNARRAAEIIQDDFAKIGVKVEIVSYEWAEYLDRSKAKDRDGAVMLGWTGDNGDPDNFLDTLLGCEAVGGNNRAQWCNKEFNDLVKKAKVTTDQAERTKLYEEAQVVFKKEAPWATLDHSLSIVPMRREVTGFVQSPLGDFTFENVDITE

SEQ ID NO: 4763 - protein, 204 aa, Unknown
  Kingdom: Bacteria, Phylum: Proteobacteria
MAAAAFSAAQAADAVNEVPQAPVAVEQPAPIKDWSGAYLGGTVNYDWGRFSGSNNGRDADGFGGGVYGGYNWQNGQIVYGGEADLAYGDEKGSAGGTLEGKQKLNGSLRARVGYDMNPFLIYGTGGLAVSNNEIRDTATGSKDDKTALGYTVGAGVEALVTDNITARLEYRYTDYQDKDFAINGGNVSRGFDDHSVKAGIGVKF

SEQ ID NO: 4764 - protein, 287 aa, Unknown
  Kingdom: Bacteria, Phylum: Proteobacteria
MLRYNRIAAAVIVAGLGLHFPAFAQEDAVVATVGDLEIRQSELDLAMSNLDSQLAQLPDEQKKVAALSSAIEVKLLVEGATTEGLDKTDDFKKRLNFISDRELHNAYFRKHVADAITDAEVKARYDKEVAALPKEEEVKAAHILVATEEEAKDVIKQLDAGKDFAELAKEKSTDSNKDDGGDLGWFGKGRMVPEFEEAAFKLEKGAYTKEPVKSQFGFHVIKVEDKRISPPPAFEQVEPQVRQLVMRDKYMDLIKKAKAEQKVDIKDETLRKEYDEVNKAQDAQPQQ

SEQ ID NO: 4765 - protein, 168 aa, Unknown
  Kingdom: Bacteria, Phylum: Proteobacteria
MFAVIKTGGKQYRVSANDVLTIEKLEADAGATVEFTEVLVVGVGADAKFGAPFVAGATVKAEVVEHNRGKKVIAFKKRRRQNSKPGGSSRNGRDSNSKRLGVKKFGGEAVIPGNIIVRQRGTQWHPDANVGMGKDHTLFALTAGNVNFRTKANGRVFVSVAPKAEAAE

SEQ ID NO: 4766 - protein, 98 aa, Unknown
  Kingdom: Bacteria, Phylum: Proteobacteria
MASTNFRPLHDRVVVRRVESEAKTKGGIIIPDTAKEKPQEGEIVAVGSGARDESGKIVALDVKVGDRILFGKWSGTEVKLDGEDLLIMKEADIMGIIG

SEQ ID NO: 4767 - protein, 742 aa, Unknown
  Kingdom: Bacteria, Phylum: Proteobacteria
MSLTPKIIYTLTDEAPALATRSLLPIVQTFAKSAGITVETRDISLAGRIIALFPDYLDDSQKLGDALAELGALAVQPEANIIKLPNISASMPQLKAAIKELQEQGYKLPDYPDAPANDTERDVKARYDKVKGSAVNPVLREGNSDRRAPLSVKNYARKHPHKMGAWTADSKSHVAHMDSGDFYGTEKSALIADAGDVKIELTAADGAKTVLKEKTPVKAGEIIDAAVLSTAKLKTFLQAQIDDARAQGVLFSVHLKATMMKVSDPVIFGHVVSVFYKDVLAKHAAVLKQAGFDPNNGIGDLYAKIQSLPADQQAAITADIDAAYKTLPQLAMVNSDKGITNLHVPSDVIVDASMPAMIRDSGKMWNAEGKLQDAKAVIPDRCYAGVYQAVIDDCKQHGAFNPVTMGSVPNVGLMAQAAEEYGSHNKTFVIPAAGTVRVTDASGKVLLEQAVEAGDLWRMCQTKDAAIQDWVKLAVTRARVSQTPAVFWLDEKRAHDAQVIAKVKQYLNDHDTNGLDLRILPPVEATKFSLKRIREGLDTISVTGNVLRDYLTDLFPIMELGTSAKMLSIVPLVAGGGLFETGAGGSAPKHVQQFLEEGFLRWDSLGEFMALAASLDHLGRAYDNARALVLGKTLDLATAKFLDENKSPDRKVGGLDNRGSHFYLATYWAQALAEQTDDRALAALFAPAAAAFVQGEAKILEELKAAQGKPVDIGGYYQPNEDKASRAMRPSATLNQVLANIG

SEQ ID NO: 4768 - protein, 708 aa, Unknown
  Kingdom: Bacteria, Phylum: Proteobacteria
MHEDLDAYLQGQGGGSAARGPAYAERNDEEQVPVIGLRRKIAQKMAESKRRIPHFSYVEEIDVTELEDLRVSLNAKFGESRGKLTLLPLLARAMVIALRDFPQINARYDDEAGQVTRYGAVHIGIATQSDGGLMVPVMRHAETRDLWSMAAEIGRLAQAVRSGGAGRDELSGSTITITSLGPLGGIVTTPVINHPEVGIVGVNRIVERPAFRNGAVVARKLMNLSSSFDHRVVDGMDAARFIQATTKTTTLLVIGGGPGGYVAAIRAGQLGVPTILVEGDRLGGTCLNIGCIPSKALIHAAEEFDKARHYAGQSALGISVSAPAIDIGRTVAWKDGIVGKLTGGVGALLKKNGVQVVQGWASLLDGKTVEVESADGSRQRIQCEHLLLAAGSEPTPLPSVPFGGMVVSSTEALSPADIPKKLVVVGGGYIGLELGTVYRKLGAEVAVVEAQDRILPTYDAELTKPVAAALAKLGVELHLGRKVLGLNGAGTAVRIQDASGAETALPADRVLIAVGRRPRTQGWGLENLQLDRKGNALRVDDQCRTSMRDVWAIGDIAGEPMLAHRAMAQGEMVAELVAGKRRHFHPAAIPAVCFTDPEVVVAGLSPAEAEAAGLDCLAASFPFAANGRAMTLESTDGFVRVVARRDNHLIVGWQAVGRGVSELSTAFGQSLEMGATVEDVAGTIHAHPTLGEAVQEAALKALGHALHI

SEQ ID NO: 4769 - protein, 1013 aa, Unknown
  Kingdom: Bacteria, Phylum: Proteobacteria
MNLMTNAPAKLPVVKRCAFGAHELTLETGEIAKQASGAVIVRMGDTVVLVTAVGSKRAKDGLDFFPLTVEYRERFYAGGRIPGGFFKREGRPTEKEILTSRLIDRPVRPLFPDQFRHEVQVIATVLSVDPLIDPDIPAMVGASAALRLSGLPFKGPIGAVRIGRHGDSFLVNPTTEELKASDLNLVVAGTRHGVLMVESEANVLSEEIMLAAVSLGHHAMQPVIEAIEELAQEAKVTKWEWSHPPRDLALADTVRTQIGNNLNSALLITDRIARKKRVQAIRNEVLIALAAPTTSATGWEVAQVRAELDDLEYTAVRRMVLQDRRRLDGRGLEDVRPISIQLGVLPRTHGSAVFTRGETQAIVTTTLGTTRDGQVIDAVTGEYKEHFLFHYNFPPYCVGETGPMIGPKRREIGHGRLAKRGVAAIMPSMEAFPYTIRIVSEITESNGSSSMASVCGSSLALMAAGVPVKGPVTGIAMGLVKEGDRFAVLSDILGDEDHLGDMDFKVAGTIDGISALQMDIKIDGVTAEIMEVALAQAREGRLHILREMAKAIQAPREQMSEFAPRLLTIKIHPDKIREVIGKGGATIQALTKETGTQIDIRDDGTIVIASTSGGAADTARRRIEQITAEIEPGRVYEGKVAKVLDFGAFVTIAPGKVGLVHVSQISDERVENPNSVLSEGDVVKVKVLEVDMQGRVRLSMKAVDGTKVLLPESAEILFDNDARLRLLRGVNILANAVKATLGPKGRNVVLEKSFGAPTITKDGVSVAKEIELADKFENMGAQMVKEVASRTNDDAGDGTTTATVLAQALIREGAKAVAAGMNPMDLKRGIDKAVIAAVAELKNISKPTTDDKAIAQVGTISANSDESIGNIIAEAMRRVTKEGVITVEEGSGLENELDVVEGMQFDRGYLSPYFINNQQSQTADLDDPYVLLHDKKISNVRDLLPVLEGVAKSGKPLLIIAEDIEGEALATLVVNTIRGIVKVVAVKAPGFGDRRKAMLEDMAVLTGGTVISE

SEQ ID NO: 4770 - protein, 448 aa, Unknown
  Kingdom: Bacteria, Phylum: Proteobacteria
MFEKILIANRGEIALRIQRACRELGIKTVVVHSEADREAKYVRLADESVCIGPAPSRESYLNMPAIISAAEVTDSEAIHPGYGFLSENADFADRVEKSGFVFIGPRPDTIRLMGDKVSAKRAMIEAGVPVVPGSEGALPDDPQEIIRVAREVGYPVIIKAAGGGGGRGMRVVYTEAALLNAVTMTRSEAGAAFNNPEVYMEKFLENPRHVEIQVLADGGRNAVWLGERDCSMQRRHQKVIEEAPAPGIARRLIERIGDRCADACRKMGYRGAGTFEFLYENGEFYFIEMNTRIQVEHPVTELITGIDLVQQQILIAAGEKFTLRQRDITFKGHALECRINAEDPFRFVPSPGRITNWHTPGGPGVRIDSHAFNGYFVPPNYDSMIAKVITYGDTRDQALARMRTALSEMVVEGISTNIPLHRELLQDARFIEGGTSIHYLENKLAQRP

SEQ ID NO: 4771 - protein, 455 aa, Unknown; identical to SEQ ID NO: 4708
  Kingdom: Bacteria, Phylum: Proteobacteria

SEQ ID NO: 4772 - protein, 389 aa, Unknown
  Kingdom: Bacteria, Phylum: Proteobacteria
MAQVINTNTMSLNAQRNLSTSGSSLATTIQRLSSGSRINSAKDDAAGLAISERFGTQIRGTDVAIRNANDGISLAQVAEGSLSEIGNNLQRVRELAVQASNATNSASDRKALQAEVTQLVSEIDRVAKQSDFNGTKLLDGSFSSQLFQVGANAGQAIAIDKVVDATTANLGTSSFKSAKLTAAAVVAEKTQVGGTISVKAADGSVNTVDLGKIDLAAGATAAEQNKAVVSAINGKLGETGILAELNEAGTEITVTQVKNGGDLAAGAVTTAAGTVALTKKTWDGTANSGAGDWGTAAPAYTTLAVASETKHVKDLDVSTVTGAQKALSLVDEALNSINSTRADLGAIQNRFTSVVANLQTSTENLSASRSRIKDTDFAKETAELTRTQI

SEQ ID NO: 4773 - protein, 381 aa, Unknown
  Kingdom: Bacteria, Phylum: Proteobacteria
MAQVINTNTMSLNAQRNLSTSGSSLATTIQRLSSGSRINSAKDDAAGLAISERFGTQIRGTDVAIRNANDGISLAQVAEGSLSEIGNNLQRVRELAVQSSNATNSASDRKALQAEVTQLVNEIDRVAKQSEFNGTKLLDGSFSSQLFQVGANAGQAIAIDKVVNAKADSIGQSSFASDGKLEMGAAAALVSGEIKGLTIGSVALSDISFEQGTSAVTADAEKQTVQNALNATVTAINAKLGETGVYAAQAVDASGVAIAGEITLTSIKSDLDSDGVAALAVTGGGASVTVDADIGEGDDGAQQLKNVDITNVIGAQRALEIVDNALGAINNTRADLGAIQNRFTSVVANLQTSTENLSASRSRIKDTDFAKETAELTRTQI

SEQ ID NO: 4774 - protein, 410 aa, Unknown; identical to SEQ ID NO: 4711
  Kingdom: Bacteria, Phylum: Proteobacteria

SEQ ID NO: 4775 - protein, 1001 aa, Unknown; identical to SEQ ID NO: 4713
  Kingdom: Bacteria, Phylum: Proteobacteria

SEQ ID NO: 4776 - protein, 594 aa, Unknown; identical to SEQ ID NO: 4712
  Kingdom: Bacteria, Phylum: Proteobacteria

SEQ ID NO: 4777 - protein, 889 aa, Unknown; identical to SEQ ID NO: 4714
  Kingdom: Bacteria, Phylum: Proteobacteria

SEQ ID NO: 4778 - protein, 478 aa, Unknown; identical to SEQ ID NO: 4717
  Kingdom: Bacteria, Phylum: Proteobacteria

SEQ ID NO: 4779 - protein, 171 aa, Unknown; identical to SEQ ID NO: 4733
  Kingdom: Bacteria, Phylum: Proteobacteria

SEQ ID NO: 4780 - protein, 315 aa, Unknown; identical to SEQ ID NO: 4721
  Kingdom: Bacteria, Phylum: Proteobacteria

SEQ ID NO: 4781 - protein, 520 aa, Unknown
  Kingdom: Bacteria, Phylum: Proteobacteria
MTTIRSIHAREILDSRGNPTLEAEVILEDGSFGRAAVPSGASTGTKEAVELRDGDKTRYLGKGVRNAVSNVNTTIATALKGFDAADQEGLDRRLIDLDGTENKGRLGANALLGVSLANAHAVAASKKQALWQHLANGRDVTLPVPMMNIINGGAHADNNVDFQEFMVLPVGFTSFSESLRAGTEIFHSLKSVLKGHGLSTAVGDEGGFAPDFRSNVEALDTILEAIGKAGYTAGEDVLLGLDVASSEFYENGKYNLVGENKRLTSEQFVDFLADWAAQYPIVTIEDGLAENDWAGWKLLTDRIGNKVQLVGDDLFVTNPKIFKEGIESGTANAILIKVNQIGTLTETLEAIAMAHAANYASIVSHRSGETEDTTIADIAVATTATQIKTGSLCRSDRVAKYNQLLRIEEALGAGARYAGRDAFYRFWFGPGNSGEVMMLEAQVENQKRDNAGLQQRNDALAAEVKDLKEGEAAIEERARSELGMIKPGEKFYRVVEDAPVPPPRAPTAVTDPDAPHQDVP

SEQ ID NO: 4782 - protein, 95 aa, Unknown
  Kingdom: Bacteria, Phylum: Proteobacteria
MSIKPLHDRVVVKPIEADEISSGGIVIPDSAKEKSTKGEVVAVGPGKPLDNGSVRAPSLKVGDKVIYGQYAGSSYKSEGVEFKVLREDDILAIVG

SEQ ID NO: 4783 - protein, 366 aa, Unknown; identical to SEQ ID NO: 4726
  Kingdom: Bacteria, Phylum: Proteobacteria

SEQ ID NO: 4784 - protein, 328 aa, Unknown; identical to SEQ ID NO: 4723
  Kingdom: Bacteria, Phylum: Proteobacteria

SEQ ID NO: 4785 - protein, 179 aa, Unknown; identical to SEQ ID NO: 4718
  Kingdom: Bacteria, Phylum: Proteobacteria

SEQ ID NO: 4786 - protein, 702 aa, Unknown; identical to SEQ ID NO: 4716
  Kingdom: Bacteria, Phylum: Proteobacteria

SEQ ID NO: 4787 - protein, 363 aa, Unknown; identical to SEQ ID NO: 4730
  Kingdom: Bacteria, Phylum: Proteobacteria

SEQ ID NO: 4788 - protein, 407 aa, Unknown
  Kingdom: Bacteria, Phylum: Proteobacteria
MGFNVSLSGINAANADLNVTANNIANVNTTGFKQSRAEFADLFSATSYGLSKNAVGSGVRLTNVAQQFSQGNNEQTGRSLDMAISGEGFFTLTMNGARVYSRAGNFQTDQAGYVTNPQGARLQVFAPNADGTNFDAGRLTDLQLLTTDSPPKQTSKVDVSFTLPANAKEPTVQTFDPTDSNSYNHSTGGITVYDSLGVSHTQTSYFVKTENPNEWQVYNYVDGKAAGTPTLLKFSDSGALTEPANGQIVMDPFTPTTGAGMLSMSLNLSGSTQYGEKFALRNTQQDGYAAGKLNEITVSEEGIVYARYSNGDDKPLGQVALTTFNNAQGLEAKGNNLWVESFASGTPRTGSPDSSNLGKIQAGSLEASTVDLTEQLVNMITAQRNFQANSQMVSTQDQITQTIINLR

SEQ ID NO: 4789 - protein, 775 aa, Unknown
  Kingdom: Bacteria, Phylum: Proteobacteria
MDVFTACPAGPHPPRASQQPTAAVAVAVAIAAAVTAPFRNAPAVTCLTGEFPLTTRLALAVAVTLGLALPAYSATAATPAATTAQQANPFFADSPLPLHFPQFDKIKDSDFAPAFDAGMAQQLKEVEAIANNKAKPTFDNTLIALEKSGDTLDRATTVFFSLVGADTNDARKKLQADYSARFAAHSDAIALNGKLFARIQTLYDTRAQLGLDAEGVRLVEKYYESYVRAGAKLSEADKTKLKEMNAELANLGTKFSQNVLAEVNASAITVDDVKELAGLSQEQISAAAEAAKARGQDGKYVITLLNTTGQPPLTNLANRALRQKIYEASVTRGSRGGEYDNTALVSRIMQLRADKAKLMGFANFAAYNLTNQTAKTPEAVNAMLGQLAPAAVANAKREAADLQAMIDKEQKAAGKPTFKLEAWDWAFYSEKVRQAKYNFDESQLKPYFEMKNVLENGVFHAAQLEFGLTFKQRTDLPVYHEDVTVYDVFDADGSQLAIFIFDPYARASKRGGAWMNSYVSQSELTGFKPVVANHLNIPKPPAGKPTLLTWDEVTTTFHEFGHALHGMFSNVKYPYFSGTSVPRDFVEFPSQVNEMWADDPVILKNYAKHYQNGTAMPQALLDKVVAAAKFNQGFATTEYLGAAMLDQRWHQIGPDQVPAAKDVMKFEAEALAKDGIFYAPVPPRYKTPYFSHIMGGYSAGYYAYIWSEVLDANTQKWFRENGGLSRKNGDHFRQTLLSKGGSVDAMELFQNFAGHEPQIEPLLEKRGLTSGGSKK

SEQ ID NO: 4790 - protein, 85 aa, Unknown
  Kingdom: Bacteria, Phylum: Proteobacteria
IEALAGCDRLTISPDLLEKLDADHGELPRRLVAGAAQSVQVTPIDGARFAADLAADPMATEKLASGIDAFAKDLEALRQTIRERL

SEQ ID NO: 4791 - protein, 473 aa, Unknown
  Kingdom: Bacteria, Phylum: Proteobacteria
MRRRVLAIASSLALLAAPAFAATGITTLPPKSLATAAELREQALKDDTGWKVVESLTTEIGPRIAGSEADARAVAWAVAKFKSLGFDKVWTEPVTFPKWERRSEHAEVIGKHAQPLAITALGGSPGGTVEAEVVRFADLAALQAAPEGSLKGKIAFVDYQMTAYRDGRDYGNGGAVRSKGPSEAIRKGAIGFVMRSAGTDSHRVPHTGITRFDDGLTPVPAAALSVPDANQLARLVALGSTTLKLSLDCGWDGKATSYNVIGEITGRSLPKEVVVIGGHLDSWDLGTGAVDDGAGVGITMAAGHLIGQLKQAPKRTIRVVAFANEEQGLYGGKAYAEAHAKDVVLHQLAAESDFGAGRIYAFNTGSPNPANSREATRQIAEVLKPLGIEYAADKGGPGPDVGPLAAKGGAWAWLAQDGSDYFHLHHTADDTLDKIDPAALAQNVAAYTVFAYLAAEADGSFGSEAKPTTPPSE

SEQ ID NO: 4792 - protein, 439 aa, Unknown; identical to SEQ ID NO: 4715
  Kingdom: Bacteria, Phylum: Proteobacteria

SEQ ID NO: 4793 - protein, 272 aa, Unknown; identical to SEQ ID NO: 4727
  Kingdom: Bacteria, Phylum: Proteobacteria

SEQ ID NO: 4794 - protein, 363 aa, Unknown; identical to SEQ ID NO: 4728
  Kingdom: Bacteria, Phylum: Proteobacteria

SEQ ID NO: 4795 - protein, 448 aa, Unknown
  Kingdom: Bacteria, Phylum: Proteobacteria
MSSTLIVNARLVNEGTVTQGDLRIEDGRIAQIGPGLDARPGETVVDAAGRWLLPGMIDDQVHFREPGLTHKGDIATESAAAVAGGLTSFMDMPNTNPPTLNAEILQAKYDAAAGRARANYGFYMGASNDNLAHIQSLDPKTAPGIKVFMGASTGNMLVDNPETLDAIFRDAPTPIITHCEDTPMIDAKAKEYAEKYGDALSAEQHPDIRSREACLKSSELAVSLAKKHGTRLHVLHISTADELALFERGPLIRADGSRKQITAETCIHFLRFDRSDYARLGNLIKCNPAIKEASDREALTRAVADDVIDVLATDHAPHTWEEKQKPYAQAPSGLPLVQYALVAALELVHEGKLEITQVVQKFAHAPAQLFDVSQRGYLREGYFADLVLVEDVPFTVKREDVLSKCGWSPFEGTTFRSRIASTWVNGQLAWDGEKLVGSPNGQRMSFDR

SEQ ID NO: 4796 - protein, 132 aa, Unknown
  Kingdom: Bacteria, Phylum: Proteobacteria
EAIKRLKPVDCTTNPTLVKKALDLPVYADLIESALAWGREQAGERETIVHAVADRLTVGVGTLLSTLVPGRVSTEVDADQAHDTAATVAKARQFIAMYDAAGVPRSKVLIKIAATWEGVEAARQLQAEGIDC

SEQ ID NO: 4797 - protein, 1438 aa, Unknown
  Kingdom: Fungi, Phylum: Ascomycota
MGRHFGTCASLRHAIETRKGRSGPTAVVVFAVIKQPRQWPNHALLPTQLLDRSAHKVLTNNSVAFPALEYGPDHGDGRLRKHLASWLTTFFKPQDPITDDRIAISGGASQNLAVLLNVFTDPSYTRKVFFVAPAYHLSFRVVQDAGFHDKFGAIPEDEEGIDIEYFKEKIKRAEEEAMRQGISQPKHKPTYRPWAKVYKYVIYAVPTFSNPSSKTMSLRRRKELLQVAREYDALIITDDVYDFLQWPAKVASESETASVKEAHLPRIVDLDRYEDGGAEREGADGFGNAVSNMSFSKISSPGLRCGWCEGTPKFVSGVAEVGSTHSGGNPSQFSSNILAEAMENGELQRRVYEELQPAYGRRYRSMVKAINNLLVPLGVRLPQTDREIVGGYFIWLTLPDGMEGGALVERAREDENVVVAQGELFEIPGDSDGPCTSFKNDIRVCFAWEDEDALIEGIERLATVIKTMQHEQNTTGSYKIRLQVEQEAKNFWRGLACPVVAAGESTPVALRHRIANFSNFALTDWPTTACCFTRGRIPSFASEAPYGQGMRLANMATGPPHHEMADSDEEALESETAQEYDEEATAKRWYHAAEDGIKWALSAGQYESSTAERGSRPVYSKLETRSSAELDWRDLNVTIPSRSFRSFKLPKNKTHLAIMVAFSAGALLLALRVLITAAPSTAAPVAAPAPQASAPAAGASGYWLADIQRQGVAPYNPNKDAYKIFRNVKDYGAKGDGSTDDTEAINKAVADGDRCGEGCDSSTTTPAIVYFPAGTYAVSKPIIQYYYTQFVGDINNLPTLKATANFEGMAVVDADPYIPGGDGANWYTNQNNFYRQVRNFVIDISAAKATAGIHWQVSQATSLQNIRFEMAKGDAGKDQKGIFQDNGSGGFMTDLVFNGGGIGAFLGSQQFTSRNMTFNNCGTAIYMNWNWLWTMKSIFINDCKVGLDMANSPSNQTVGSVLMLDSKLTNTPIGVNTSFTSDSIPTTGGTLILENVDFTGSESAVVGASGNVLVKGGSKVEAWAQGNAMAAGSEQGRVQGDINNGPTKPAVLQGENGWFERSKPQYGDVDVSKFVSLKSKGAKGDGNTDDTAAIQSAIDGLQDGEILYVDHGAYLIKKTIVIPAEKNVKIQGEVYPMFFITGEFFSDMNDPKPGFQVGAKSGDKGTFEMNDAIIGTQGPAPGGILMEWNINAEAGKAGLWDVHFRVGGYEGTKLQSSNCAKNPNATHDANPDCIGSFMQLHVTKSSSGYFENVWLWTADHELDQADHGQIDIYNGRGMIVESQGPVWLVGTASEHSQMSQYHFQGAKDIWYGAIQTETPYYQPNPKADVPFTKNDKYFDPDFSEGLTSAWAVRVIDSSSIWNYGAGTYSFFSNYDQKCVPGQNCQEHINEITNSTNVNWFGLSSKASVNMITSNGKGLVKDEDNRSNFCATLAIFAQA

SEQ ID NO: 4798 - protein, 179 aa, Unknown
  Kingdom: Fungi, Phylum: Ascomycota
MKAILSFGVLALPCLVAAYPVDPPSTAAADTVGDCTYWHVAAETETCSDVAEYWGFTEGQLAAYNPSLADSCDLVTGNSYCVERNYGIPVPTPISSTAASTSASTPTPTPSTDLEICEAEAGGYKRYCERCLSRCATSAYKAQCFYSTFFAINGNDSNCWQHGGNDCANKAADIVCPRK

SEQ ID NO: 4799 - protein, 780 aa, Unknown
  Kingdom: Fungi, Phylum: Ascomycota
MVAFSAGALLLALRVLTTAAPSTAAPIAAPAPQASAPAAASGYWFADIQRQGVAPYNPDKANYKIFRNVKDYGAVGDGTTDDTEAINKAVADGNRCGEGCDSSTTTPAIVYFPAGTYAVSAPVIQYYYTQFVGDINNLPTLKATAAFEGMAVIDADPYIPGGDGANWYTNQNNFYRQIRNLVIDITAAKATAGIHWQVSQATSLQNIRFEMAQGEAGKDQKGIFQDNGSGGFMTDLVFNGGGVGAFLGSQQFTTRNMTFNNCGTAIYMNWNWLWTMKSIFINDCKVGLDMANSPSNQTVGSVLMLDSKFVNTPIGVNSSFTQDSIPTTGGTLVLENVDFTGSESAVVGAGGNVIVKGGSKVENWAQGNAMAAGSAQGRVQGDINNAPVKPASLQGENGWFERSKPQYGEYDVSKFVSLKSKGAKGDGSTDDTAAIQAAIDGLQDGEILYVDHGAYLITKTIVVPAEKNVKIQGEVYPMFFITGEFFSNMDDPKPGFQIGAASGDKGTFEMNDAIIGTQGPAPGGILMEWNINAEAGKAGLWDVHFRVGGYEGTKLQSSNCAKNPNATHDANPECIGSFMQLHITKSSSGYFENVWLWTADHELDQPDHGQIDIYNGRGMIVESQGPVWLVGTASEHSQMSQYHFQGAKDIWYGAIQTETPYYQPNPKAEVPFTKNDKYFDPDFAATGLTSAWAVRVIDSSSIWSYGAGTYSFFSNYDQKCVPGQNCQEHINEITNSSNVNWFGLSTKASVNMITSNGQGLLKDADNRSNFCATLAIFAQP

SEQ ID NO: 4800 - protein, 574 aa, Unknown
  Kingdom: Fungi, Phylum: Ascomycota
MLTTRFLLPALAAFLGLASAQVVTDCNPMERDDCKPDPAFGTSRNFNFNQTQNGALWETVVGGINYDDPEKGAAFVLDKQGDSPTIRTKFYFFGGRTDVIMKTAPGKGIVSSMMWLSDNLDEVDWEFIGVNETHASTNYFGKGVEDFQHAGWHEMSPPQNDYHNYSTVWTKEKLEWYIDSKLVRTLLPKDANNTEAYPQTPMRLSLGIWAGGDPSLPEGTRQWAGGDADYDNGPYTMYVKEVYVEDFTTGAKEYVFGDRSGSWDSIEVVKGNSTAFEAIHKKPEESKSMSEKWEDDVPETAKIAVYAGGAAVGALMLGGLIFYCIRQRRRGAAENKAAHEREQAELVEDALFKKNGINPDGFTEQASEYNAKDMHKGGNATFETYNISPGQEKDWSAAGMGAGAGVGAAAAAAAAAGGMRSPMPLLRDGAQSPRIGSPGPGSMGPYHDSPRSPGSPGPGMNGAMGPHRTQSPGMPRSHSPAIRTQSPAMPPQGALPPVPHQSRASPGPQRMHSPAPMSPNRSFSDNHAAYGANRMQTATPMGQGQNRSYSNGQPPYRGPPPQNRDYWNGGGGQY

SEQ ID NO: 4801 - protein, 516 aa, Unknown
  Kingdom: Fungi, Phylum: Ascomycota
MGESLLSGFNWFNGKDLSNGFVSYQNRSDAEALGLYSLDETTQVVRLGVDANNTVPLDHGRPSIRLESKEAYDHGLFIADFLHMPPSQCGLWPAFWMYGSDWPYGGELDIIEGANTAHRNIISAHTADGCFQDETSLFTGEQRNTDCAVGTKNIGCGYNPPADDASSYGDAFNAAGGGVYAVQWDSERLKVWHFPRGAIPADIEAKNPQPAGWGLPQAVFGGQRCDVDSFFKNMSIVININFCGDYGDATWASSDTCSSFAPTCAEYVADNPEAFVNAHWDIKYIDAYQLSASSVTPLPATAVPTPINPSVFPPAPVNPQNIDSFSYLGCFSSGNNFSTFVAGENTQEMTLERCVKSCSNAGHTYAGIFGSQCYCADDLDAGSTRAIENESSCSTPCPGNSTQLCGGGGNSTSSRLFTVYAGVANEEKPLAVPMAGIPSTIKVVICPTATAMPASAVETKIVLPVPVATSQANQTFLKPVSPPTSTPVAAAGVVSLPDWRLGALSSVVVIGFLVLI

SEQ ID NO: 4802 - protein, 636 aa, Unknown
  Kingdom: Fungi, Phylum: Ascomycota
MLLDRLKFSVASCALLAICLLSTVCEAKTVEYHFNVSWVNANPDGLFERKVVGINGQWPLPVIEVDKGDQLVVHMQNSLEDKAASIHFHGMFQNGTNEMDGPAMVTQCPVLPGQSFTYNFTVNQNGTYWYHCHTDGCYPDGYRQALIVHDKDAYFAPEVEEEFTLTLSDWYHDMIEDLLEGFMSVYNPTGAEPIPNSFLLNDTQHTSLPVKPNTTYMLRLINIGAFVGQYFYIEDHSFKIVEVDGVYTEPTEASMIYISAAQRYSILVTTKNQTAQNFAMVTVADSSLLDTIPSSLQLNNTNWLEYNRSAPHDEAVVTATDSTALTPFDDLGLVPYDNMPLLPEPDHEIVVTVKMQNLDTGDNYAFLNDITYTRPKVPTLYTVLSSGNESNNADIYGQNTHSVVLQHNQVVQLVLNNADTGSHPFHLHGHNFQVITRAPAYGPDFFSYLNGDPVPYNSTNHTAFPHSPMRRDTAVLPPQGYYVIRFVADNPGVWFFHCHIDWHLSSGLGMLMIEAPTQMQERMTIPQDHYDACKAAGIPYEGNAAGHTGERILDLSGAPRQPGWIPAGFTARGIVAMVFSVVSAFLGIGFIIAYGLSGVQSQQNAATAAEKVAPVNGVTSEMITELVVTPADRDKS

SEQ ID NO: 4803 - protein, 651 aa, Unknown
  Kingdom: Fungi, Phylum: Ascomycota
MTVLKTAHLVSLLGAFAYLQPIVGKPLFDSILNPFKDLLSTLGTGAGFIEASLGSLKGTLGIQQSFDYVVVGGGTAGNAIGYRLAETGFSVAIIEAGAFSEAAKPVLGSTPAGDLFGVGKNPLDTIPTTDWGYKTQPQAGLDGRVSHYAQGKCVGGSSVLNFMLHHRPTEGTLDAWADAVGDDDYRLENMLPHYKNSVTFSPANPGMRFENASSPYNPTAFAAAGQGGPVQVTYPNYVSPFATWLEKALLNLGLERTVDFANGKLLGYHYAQATIRSTDQTRSSSASYIHTAKASSGAVNKNLKVFTKTLARQVLFDGSKKASGVKVSLLGALPTYTLQAKREVIVSAGAFRSPQLLMVSGVGPKATLDSFGIPVVSQLEGVGQNMWDHIMFGPSYSVNLPTLDTVVRRPDVLLQALLDYSVASKGILTSNVVELLAWEKMPQKYRDTWSAASLEALAQFPADWPEIEHLAANGYVGDFAWPVLDPPFNGKWHGTDFGALVAPLSRGNVTIASRDTSVNPLINPNWLTHPADVELAVSLFRRLREVFDQPALRPVRRDLNEEAYPGFQYQSDEQILDMIKKSLTTVWHPACTNKMGKAGDKTAVVDSKARVFGVQGLRVVDASAFPILPPGHPQATVYALAEKIAADIIRG

SEQ ID NO: 4804 - protein, 392 aa, Unknown
  Kingdom: Fungi, Phylum: Ascomycota
MRAATLLALLPVAMAAPQAKRASPAPLIVPRGVELIEGKYIVKMKDDVVSAAVSSAVSKISSDADYTYSRKFNGFASSLSDKELADLRNDPNVEFVEQDAKVVMYASQQNAPWGLARISSSSPGGTTYTYDESAGEGTCAYVVDTGIDVDHPDFDGRATFLANYADSTDEDGQGHGTHVAGTIGSTTYGVAKKTKLFAVKVLDSNGEGTNSGVIAGMDFVVDDAPKQDCPKGVVVNMSLGGGFSSAVNTAAAAITKAGHFLAVAAGNEGADAKGSSPASEASACTVGATEKDDSLASYSNVGSVVDVLAPGSAILSTWPGGRTNTISGTSMASPHVAGLAAYLLGLGQSANGLCAYIASTALEGVISGVPSDTVDLLINNGASGGNATARRH

SEQ ID NO: 4805 - protein, 617 aa, Unknown
  Kingdom: Fungi, Phylum: Ascomycota
MVTIRLASLVALAGAVDAASSLGEVKHVVMMMLENRSFQHYFGTMAGVRGFADPNVQINPDGRSVWYQNVTGLTDKADWMLPYWFNYLGGEESWNMSQCLCAGANNWIPTQQALNGGLNNMWAQIDKPQSWGYFKRQDLPYHFALADAYTVGDHYFSGSINVPGGKQAPDEGGIILDNNQVNGCTGPNLNCLPIEWPAFAQYLDEAGVDWRAFQNSKDWATTNGLFYFKAFQDAARNSSMYQRGLVFDGDNGLEAFQKSAAEGTLPEVSWIFAPGTLQEHPPRSPVDGSWYINQVVNATIHGKNYNDTIFIINYDEAGGWGDAVMPVVSPEGTAGEWFEDPYETKLDVVDETVGVRVPLIIISPYTRGGHVFTERADHSSALLFLEHYLKAKGYEGIVADQISDWRREHMSDLLSAFDFKNPDYSIPDLPIPRDPIRDSKGDILGLYSGYCSLVYQGHCSSDSYVYSIPFGEQTEEEALYFEDGFKGIRGYLTEGHYLVFESNGRALTNLGNDEQLTTTKVTKGHEDPHQRWVLHGLSPEGSTFNIASALDGKWMSRHSSLSTSRNKAQKYNVRRLPDGTYAMQKENGRYLNIAKTGELSFDKDPIGYKVYSVTYHK

SEQ ID NO: 4806 - protein, 466 aa, Unknown; identical to SEQ ID NO: 633
  Kingdom: Fungi, Phylum: Ascomycota

SEQ ID NO: 4807 - protein, 545 aa, Unknown
  Kingdom: Fungi, Phylum: Ascomycota
MQLITSLLAIGGLATSVAARNPAKSVGKKFDLPKPKLPARNVQHVKRQYTVNETQPIITAPGAKKFAVNGTAGAIPDVNFDIGESYAGLLPISDKANETSELYFWFFPSNNPDACEEVTIWLNGGPGCSSLEGFLQENGPISWQYGSGPQAVYNPWNWANLTNMIWVEQPVGTGFTQGTPTATSQEESAAQFLGFWKNFMETFGLVGKKVYIAGESYAGRYVPYIADAMLKENNTDYYDVKAAMIYDPSIAEDVLLEDIPAVPFVDRWSGLFNFNESFTKDIHDRADKCGYTEYMEKYLTFPPPGKFPTPEKNASDPECSLWNDIINAVMLTNPCFDVYQVATTCPLLWDVLGFPGSFDYSPPGAGEVYFNRTAVQKAINAPIQEWNECSNGVLDTDTSPQSSFEVIPRITEQLDRFIIVHGELDFILLYNGSLMAIQNMTWGGMQGFQEEPKDPFFVPYHDDLSLTSLSAKGVMGVTHTERKLTWVSQALSGHMVPQYQPSSAYRQAEFLLGRIPSLTSTEPFTTLNGNFTPNAKRDLGAMRGY

SEQ ID NO: 4808 - protein, 261 aa, Unknown
  Kingdom: Fungi, Phylum: Ascomycota
MRMPSLVLVALASIGFVNAQGSLESWNPARPGESRGPCPMLNTLANHGFLPREGRNFTLPVVKHALSTGLNIGDDISELLYNFALTTNPGPNATTWGLDTLGNHNILEHDASLSRSDKFFTGDAVTFNATIYNQTRAYWTGDLIDIQMAANARLARMIDSVKYNPKFALSELAADFSAGEGAGYMLVFGNKTQKTARRDLVEYFFVNERLPTELGWTAPEEVITLDDLLGFSQDIYTATSYDALETKAAMMRRNGMVGKVF

SEQ ID NO: 4809 - protein, 602 aa, Unknown
  Kingdom: Fungi, Phylum: Ascomycota
MSNSEAAAPYSVPPSQQFDGNDGSWSTFEISVGIPGQDFRVLPSTKSGVSYVLAPEGCDQPTDPSNCANLRGAEIFDSTQNTGFQVTKSTDWSAIGQYDVDLEGALNMTAQGLFGYDHVALGSAQDSNAISMDHQVIAAVADMDYFMGILPLGIVQSSFSSLSEPQESLMWNLRNSSRIPSLSYGYTAGAKYRMKSVFGSLILGGYDSTRFTPNANDFSFTFSTDPSKLLTVGVESIMATNTLQGTYSLSSGSHFSVIDSTVAQLWLPTDICTQFEQAFGLTYDPYTELYLVNDTIHANLTTLNPTITIKLVNSLGDAATKYTNIELPYAAFDLEASYPYYNNATRYFPIRRAANDSQYVLGRTLLQEAYLIVDYERANFTVAPATWPDPLPAANLITIKSPSASEKNNTSSSLSAGAIAGIVIGIVLLLALLGGLAFFLWRKRSHKTQKYELAATEKDTGSDTHVGGSHNGASMKAALPLPPQEMAGTPLTELASPAVMAFPTSHKRAVSLNREPVELSGESAVPYSPPPPPPSAGARWEEVKLPRPEGYTDHDRDGESSGIPTENMSWAPSDDATMINSPRSAGHGSGVSPLTPTFGRKL

SEQ ID NO: 4810 - protein, 696 aa, Unknown
  Kingdom: Fungi, Phylum: Ascomycota
MLVPGRQYRSTRLHYARDDTRAVLLTTLRLMRKLVMLSSRLCRNSLDAKSEGQEQNHKLRVNKDHTRDPAAAQDNDLNKVTRQAFGGVLKYAKEACRPSSRATSSSIVAMFTKSVTSIALASLALQANAVSKKQWSKRADHLYLPKETSDYRTAYAPSNVTVRYKNPGICETTPGVDSYSGYVDLTPDVHVFYWFFESRNKPESDPFTLWLNGGPGSDSLIGLFEENGPCMLTENLTTVYNPYSWNNVSNMLYISQPVGTGFSYQKQGVGSFNPWSEDFHYNSTEWPATGRYPLLVPLNEGMIDTTDLAAAAAFHVLQALLNTIPKFDTKIGTPKEFNLFTESYGGHYGPAFFNYFYDQNLRIQNGSMQGYPLNFNSLGIINGIIDESVQAGYYPEFAVNNTYGIKAYNDTVYNYAKFANYMNNGCLDQIKICRAAAGGNASYYYADAPITNAQLTPGVMQICNEAADMCRDNVESPYYYYSGRGVYDIRHPYDDPTPPSYYPDYLNLPEVQQALGVTLNYSSNNGIYYAFQNTGDFIYPNFRLDLEHLLDQDVRVSLAYGDADYICNWFGGQAISLSVDYTHSKEFRAAGYEAMMVDGAEYGEVRQYGNFSFARIYESGHEVPYYQPEAALAYFNRTLYHYDIATGEKKVTADYDTTGPANATHTNSFVPLTTSYVPDFPSPIYPTTMATATSGY

SEQ ID NO: 4811 - protein, 676 aa, Unknown
  Kingdom: Fungi, Phylum: Ascomycota
MKYCTVAALFVSVVASRYIDGAAHTPRYGANVKRAENATTDITLEDYEYVVVGSGPGGAPVAARLAIAGHKVLLLEAGGDETNSTEYNVPALHAIASEYEPMRWDFFVKHFDDDEEITKDTKVTYELADGTRYTGANSPAGATPLGILYPRVGSLGGCSSHNALITIYPYKSDWQHIQDITGDATWAPGNMRKYYERLEKSRYLPSSVAGHGFSGWLETSLTDLTLIAQDFKVLSLVLAAATGMGKGLLGGLLNTVAGLTQVLLRDINHPGANRDSEEGLWQVPLAMKVPEYKRAGTVDLLNQVVNAKNADGSRKYHLDIQLNTLVTSVQFTQVDGAAPKAAGVNFLTGKSLYGADPRRQSGAATGKGTKGSVTATREVILSAGAFNTPQLLKLSGIGPKDELEKFGIHVVKDLPGVGTNLQDRYEVPVIGEAPTKLSLLKDCTFLEGHDPCLEKWETGLLGIGKGSYATNGVALAITKKASNSPNGNADLFVAGWPAYFNGYYPSYFHNATAGGNAWTWLTLKAESRNNAGTVTLRSADPQDVPDIRKRNFAVGGDEDLDALVEGMKYGRQAFADLVPLDGRFTEVWPGKQVKTDAQLREFAKYEAWGHHASCTAPIGADDDVNAVLDSNFKVRGVDGLRVVDASSFPKIPGTYLALPIYMISEKAADVILAAAN

SEQ ID NO: 4812 - protein, 583 aa, Unknown
  Kingdom: Fungi, Phylum: Ascomycota
MLKLSAALPLLVASLAAGQFVPAPTDLTTKEGYAGINVRYKQVPEGICELDPNVKSYSGYADVGKDQHVFWWFFESRNQDPSEAPLTVWINGGPGSSSMIGLFQELGPCGVGPDLKPFNNPYSWSNASNMLFIDEPTQVGFSYSIPIPGYKDDNGYIIQLPNTTCPDYAEAYGTCGTYSKPDLTLTANTTQGAAPNMWKTLQGFMGAFPHYARNGFNFATESYGGHYGPVFNEYFLEQNAKNITGAHKIDLENVLIGNGWFDPLIQYQAYYNFSVYPGNTYDYDPYNASVKAQWYNNLYGTGNCVDMTKQCYATGENAVCSRADNFCASEVENLYDIYSGRDEYDMRELTPDPFPYDFFAQYLNTPAVQKAIGAYQNFSTSSGTVSSAFGNTGDDDRESGTIEACRKLLAAGVQVMLYYGDADYNCNWLGGQGVAEEIAAPGYDTAGFVNISTSDNIVHGQVKQSGLFSFVRIYESGHEVPFYQPLASLEIFERALKQVDIASGQCKVDAGYKTVGTPTSTYREGNATIQFEVLPANATYNTMLNAPDPEPTWTVQAGAKSKAKRSRGKEGRPSMALLRRRLN

SEQ ID NO: 4813 - protein, 367 aa, Unknown
  Kingdom: Fungi, Phylum: Ascomycota
MVATTSFIAACGIFALSFAAPVNNAAARAIVARDTYIMFGGDGSTSVGWPSRSQWLSWDKAWKANLDTIQNSCQVEGWGVNNSDAETQAIKNSIISESKSSGIPKEFILAIMMQESKGCVRAPTTRWSHDNPGLMQSAQGTGSCNPDGNPVSPCSSSEIRQMIHDGTNGDGLETTLTQCVADAGTTDDSKWYKAARLYNAGRITDNNLGIGPTPCYASDIANRLTSPFNWSPCDNNVIGSLSSAQGTVASANTNDTPDAPAPTTTTAAEPASRTTVTVTYLTSTTATITANPTPTPGVFAETPATTAAKPDLIISGAATGCTDYYTPQSGDTCASAPIDLATLRSLNTQLNADCTNLWAGYGYCIAT

SEQ ID NO: 4814 - protein, 397 aa, Unknown
  Kingdom: Fungi, Phylum: Ascomycota
MQLTLLLSLLPALAAALPAPVLEPRAGTPIPGKYIVKLQNQNLQNLLETALKVLKKDPAHVYQFGNFGGFAAEMSDDIVKILQNLPGVDYIEQDAVIKANLGEIEDTLEKKAYTTQSSATWGLGRISHTNPGTTSYTYDTSAGSGTCVYVIDTGISTSHPEFEGRATFLANYAGDGSNTDGNGHGTHCAGTVGSKTYGVAKKAKLFAVKVLGADGSGTNSGVIAGINFVANDSKTRSGCSAGVVGSMSLGGSKSTAVNSAVANAVSAGVFMAVAAGNEAQNAANVSPASETTACTVAASDSSDKFASFSNYGSVVDIIAPGVSILSTWLNGGTNTISGTSMATPHVAGLAAYLLALEGKRTPAALISRIQSLSTKNKVTGVPSGTPNYLAFNGNPSG

SEQ ID NO: 4815 - protein, 528 aa, Unknown
  Kingdom: Fungi, Phylum: Ascomycota
MLLKSALLAAASLSSSALAAFGVTKSGSNFVVDAGSSNALVFTVNGANCDITSIKYRGEEFQYASKGSHISSGLGSATVSSAIIGSVARITCTTSTLTHYYVVKSGDSTIYMATYTTAEPDIGELRYIARLNPKTLPSEYPFGVVSTTAGSSSTVEGSDVFVVNGQTRSKFYSSERFIDDSRQCVYRGEEVHVCMLLNSQSYEASSGGPFFRDINSNNAGDSTNLYFYMNSGHVQTEKFRMGLHGPYAMAFSRSGISQGGSSLDTSFFKDLSITGYVADSGRGKVSGTATGVASGLQTVLHWFNDAAQYWAYADSAGKFTSPAMKPGTYTQVLYQGEFKVKAASVTVKAGSTTTANIAADTETKTSVWRIGDWDGQPKGFRNAANQLRMHPSDSRMESWGPLTYTVGSSSLGNVPMAIVKGTNQLTIKFNGATGSTLRIGTTLAFAGCRPGVVVNSWTAATPAAPTKIDSRGLTRGAYRGFGEVYNFAIPSGTLTSGTNTITITCVSGSTGESFLAPSVILDAIELFK

SEQ ID NO: 4816 - protein, 550 aa, Unknown
  Kingdom: Fungi, Phylum: Ascomycota
MHGLLELSLQLLNFRGSSDGQKPMLGEYAALKPTPTTKSSKVPDYFVTDDGHFAGPTQTGDAPYLAQTNIAPFVGVSYIPNAPLETQVPIANAEGRNIFQSLANISPYFPNPRGFGVDEYAIPPGSNVTWLNMVHRHGSRYPEFSGDAAEITLGRKLTAAAGKFTGHGALEFLNYWRWQLGGEILVPMGKQELFNSGTLHYYQYGHLYPNNGSKVVVRSTTQRRMYESAEYFMAGFFGLGWAQNATLELAIESPGYNNTLAGYKQCNHSSWVMARDALMEWVNVYLVDAHKRFTDNITGDLDWTIEDTYNAQALCAYETVGLGFSHWCSLFTYEEWEGYEYALDIAFTAGTAFASPVGRAIGVGYVQEVLARMQHHVIVDQSAQINITLDNNTATFPVDQTLNLDFSHDANIISILVAFGLTQFAEHLPTDHIKKDREFILSYIEPFAGRLDIEVIKAPAPVNPDRHSKDIYLDGEPTSYVHFILNQRTIPLGKSLKACGDREDGWCDMETFLKVQKEQIDLADYDYACFGDYENPKYGDVTDGRPPKRQ

SEQ ID NO: 4817 - protein, 202 aa, Unknown
  Kingdom: Fungi, Phylum: Ascomycota
MHFSAIFAATALAGSAFAVDHKVAVGTKTGELKFMPDSITAAEGDTVTFRFWPKNHSIAQAAFNSPCSPMNNGFWSGFVPTSDTNNVANWTFTYEVKNASAPVWFYCTQGKHCQAGMVGVINPPASGPRTLDAFKNASKEVDSNVSPTVKAGTGGNLTESSASSSSPSGTSSGTPSSTGAASHMTGSVAFAGLAGAFAYLLM

SEQ ID NO: 4818 - protein, 518 aa, Unknown
  Kingdom: Fungi, Phylum: Ascomycota
MLQGSTRLTDVRLYKTWSLCSTDPTNHLTVSFVRRSLRLNHAVGHEDAALCDDRPRNNPVQFNRPPHPPRILVGFKMLFTKVLSVLAGAVTLVQGQYNTGNSVRPNPSNGHWVDAWASMPQLTEPANLPPAPFNQSGAVFVNSTIRQTLYMTTEASQIRIKISNVFGGSNLPITAVTVALPINQTAGIHQIQASTLQKVTFSGKSSISIPNGALAVSDPINFSIKAQQIITVTAFLATGQTTNSITSHPGSRTTSWFQFGNAVDAAQLAITDPTTQSAAHWYFLSSIEAWAPKSTGSLLIVGDSITDGRGSTTNANNRWPDLLLARLQKSGATKHISIGNLAAGGNRILADGLGPNAFGRIDRDVLAHPGVKYAMIFEGVNDIGTAAATTDAQNAVYENLVQAYQQMVSLIHAHGIPVFGATITPFSAPSNFTGQPYSSPVREATRQKINDFIRNSGTFDAVADFDKFLADPSIPSQLAPQYDSGDYLHPNPVGYQHLADEFPVEIFGKFKDGVSGWP

SEQ ID NO: 4819 - protein, 552 aa, Unknown
  Kingdom: Fungi, Phylum: Ascomycota
MKFASTFAGLGAVAATLLGSVSAASYDDIPDIEVYGQHFFYTNNGSQFYLKGVAYQQNYSPNGSTSSNTSYTDPLADGDACRRDIPYLKQIYTNIIRVYAIDPTKNHDDCMSQLASADIYVVADLSEPGTSIESNNPEWDVTLYNRYTGVVDALQKYKNVLGFFAGNENISANNQTAAAAFVKAAVRDVKGYISSQNYRRTLGVGYATADVPSRNELAHYFACEPGNSGNSTQIDFWGYNVYSWCGDSNYAASSYGERVDFFSDYPVPVFFAEYGCIEGVEGGATHRPFTEVQVLYGNMTGVFSGGIVYEWFMGANDYGLVELTSNDASVSPYSDFTSLQSELASVSPTITQRSAYTPSNSAPACPTVDASWAAEASPLPPSPNSQLCSCMAASLQCNIKSTNEDDYADVFNYICGANEDFCTGISRNATTGTYGGYSGCDPKDQLAWVANQYYLGNGKSSSACGFSGMATVQTAATASTCSSLLAAVGTAGTGTAASPTGKATAGSTGAAGSSSKGAAAGYNGPKAVEHGGLIMGIWSVIAAGSLLGMLVL

SEQ ID NO: 4820 - protein, 531 aa, Unknown
  Kingdom: Fungi, Phylum: Ascomycota
MRGLIAATALLAGVQAAVDPIVIKGSKFFYKNNGTQFFMKGVAYQQEVNSNTTSTDSDEINITDPLADSSACKRDIEYLKKLKTNTIRVYAIDPKKDHKDCMTQLADAGIYVVADLSEPGLSINRDDAEWTTTLYDRYTSVIDELMQYDNTLGFFAGNEVSNQPNNTLASAFVKAAVRDSKAYIKSKNYRSVGVGYATNDDADIRENLANYFDCGNAEDAIDFWGYNIYSWCGDSSFKESGFDVRTKEFEKYNVPVFFAEYGCNTPRPRLFTEVGALYGEEMTGVWSGGIVYMYFEEANEFGLATVSNGKVTTNKDFDNLSKEIAKATPSGVKMADYNPTNTAAAACPTVKSGKWEAESDPLPPVANAQLCSCMMDTLSCTVADKATEDDYGDMFGYICGQKDGKYCAGINRNVTAGAYGSYGMCSAKEQLAFALNAYVKDVPNGCSFKGKATSKQATATPTASGCSNLLKEAGAAGTGSVTSAPTASGSGSSGSSNSTGAASGLTVPALGMGLSAYVFGAVASGMAMILL

SEQ ID NO: 4821 - protein, 455 aa, Unknown
  Kingdom: Fungi, Phylum: Ascomycota
MAASTFALLVTAIFLNTNGVVSSASPSKGSCDSVETGYRCNTQISHSWGQYSPWFAVPSEIDLAPPKDCEVTFASVLSRHGGRDPTQSKTTTYRALVTSIQQSATAFPGDYKFLQHYNYTLGADDLTDFGRQEMINSGKHFVGRYNKLVRKHTPFVRSAGQDRVVESAQKWLTGVAQSLNTQTKAIDVIILEATTSNNTLSHDTCPAFESGPFSDLGSAAQKSWSTKFVPPIQKRINSALGTNLTASSIINLMDLCPYDTISTVNTTRSPFCQLFTEKEWHSYDYYQSLSKFYGYNAGNPLGATQGAGYVNELLARLTESPVVDHTNTNTTLDADPATFPLHNKVYADFSHDNDMSNIFAALGLYNNTKLSNSTVDSAEKTGFSAAWTVPFAARIYVEKLQCKHEKEEFVRIVVNDRVHPLDFCGGDEHGRCTLSRFVQSQGFARSGGNWQRCYI

SEQ ID NO: 4822 - protein, 432 aa, Unknown
  Kingdom: Fungi, Phylum: Ascomycota
MNSLLTLVLAATAVAAPTSRSHPTGNSGHPGHTSKDDTYLVSLGPRPYYIINNMTDGPLKQKLQSCENKPVAIQQFSIGHRGGGTLQFPEETVRSEDAGARMGAGVLECDVSFTGDRGLVCRHSLCDLHTTTDILLRPELAKKCTIPFTPANATSPANALCCTSDITIAEYSTLCGKQDGFNASALTPQAYQHGTPTWRTELYDTCGKVLTLNEYIDLVNDYPGYRNFTPELKTPPPQVPMPFKGYTQQQYAQDMVDAFRNKSIDYSRIWPQSFTYDDIVFWLQYDHEFGKQAIYLVEYITPEDIAAGISNLTIAKAAGVNIIGPSLPMLLTIGENKTIVPSAYANAVKAAGLDIIAWTFERSGPLATVKSRGEYYFESIANVTYYDGQYFEVLDVLANQIGIKGLFSDWSATVTYFANCFGLKGPVGGSYK

SEQ ID NO: 4823 - protein, 583 aa, Unknown
  Kingdom: Fungi, Phylum: Ascomycota
MHSATPTLPLTISQIVAGGGTAGLVVATRLSQELPDHCVLVIEAGPDGRNESRIYIPGLRGSTFGSAYDWSLATTPQAAANNRSVTHNRGKVLGGSSALNLLIWNRASSPEYDLWEKLGSKGWNWESMFPAMLRAENFQRQDGVAQYGEEGVAYGGPVETALLENPPPHIQACIPTLESLGLAQNLESLNGDSLGTMYQPATHRLSNHTRSYSVDYLPTAGRNLVILHNTTVSKVQLSQNGSTVTGVVLSCGQKIEAKKEVILSAGSLLSPKILELSGIGRKDILSEAGIEQKIELDGVGENLQDHLRIQTTYELQPNITGLDILRYNQTRAAIELDLWRQGQTSLYQYSGSCYGFLKWQTAAGNNSRLLQLAQSVANTTNTIDRMKLSLLADPTSRAPDLQVVFGDGYIGTRGYPANTTSGYGKKYATLLAGVMHPFARGSVHINSANTSAAPIIDPRYIGNAFDLEATKEAAKYLRKMGTTSPFKELWVKEYDPGFDTQTDEQWEAYVRENVSTFYHPLGTCAMLPKEDGGVVDPALRVYGVRNLRVVDASVIPIMISANIQTAVYGIAERAAEIIAAEYR

SEQ ID NO: 4824 - protein, 623 aa, Unknown
  Kingdom: Fungi, Phylum: Ascomycota
MLATAKCSLVTWTVFLSASSALAHPHFNGRLVTRTDELLEEYDYVVVGGGASGLTVANRLSEQPATTVLVIEAGEFDQNEDFVTVPGLAGGAVGTKYDWNTTYAASEYLGGRATAVAQGKIVGGSTKLNRMVFDRGAKSDYDGWEALGEEGWNWDSLLPYFKKNEIFTPPVDEIREEYNITWDESAHGFKGYMHSTYSPFIWPTTKNLIEAARSLTIPVPQDQANGNAIGGYFTPHNMDPTEYERSSAEEAYYDSVAKRQNYHLLAGHQATRILTCTERTVKATGVEFAASANATVQSVKAKREVILAAGSLHTPQLLQVSGIGDPALLSKIGVPTVVDLPAVGQSLHDHIGVVVVNVLNTTLPQTSLLTSNATFAAEARVEYDTEHRGPYTSPTGDFLLFLPVSMYAANASAAIHAAALAANASLSLPTGAPAEVAAGYAASYESLNSKLLADDAAFLEVIWADGAMFLALQHPYSRGSVKAPSKSIFDAPIADSGFLRNPLDTILLREAVRFSRRLIAQPSIAEMQPFEAVPGANVTSDADIDAFIKSTASTVWHPAGSCRLAKREKGGVVDGELKVYGIEGLRIVDASVFPMLPAAHTMTTVYAIAERAADLIKGIDKGY

SEQ ID NO: 4825 - protein, 540 aa, Unknown
  Kingdom: Fungi, Phylum: Ascomycota
MKLLNFFSGLLCASTAVAFKKPTLPRTVVERSVGNQFSHPEIQKRASRFLTDKTKAFAVNGTGIPEVNFDIGESYAGLLPISDSPDETRKLFFWFFPSTAEQTPEEITIWLNGGPGCSSLSGLLTENGPFTWEAGTLAPTQNPYSWTNLTNMLWIEQPVGVGYSQGTPNITDEVELATEFRGFYKSFVDTFQTKNWKTYITGESYGGYYVPYIADGFISANDDEYFNLAGISINDPIIGDGTIQQQVVILPYVEFWENLIYLNQSFLEAARERQDACNYSSYMDTYFKFPPPEGPFPVLTDPYSTETGACDQFDNFYSAILEVNPCFNIYHISETCPHPYSQLGIVNQGDYSPPGAQIYFNRTDVKKALHAPLDSNWMQCTDVNVFGNGNDSSNAQDASAPPATNGVLQRVIEHTNNTIIGSGDLDMLLSTNGTLFAIQNMTWNGGQGFSEYPCTDVYVPYHPEYNGGALAGAGYQGVWTSERGLTFYTARLAGHELPGYAPGVAYRMLEILLGKVDNFSNTEDFTTQSGNYTGNSTLYK

SEQ ID NO: 4826 - protein, 583 aa, Unknown
  Kingdom: Fungi, Phylum: Ascomycota
MFAQSATWVAIASLALQADALSQKQWHKRSEHVYLPKETSDYKTASAPNNVTVRYKNPGICETTPGVDSYSGYVDLAPNVHVFYWFFESRNKPSEDPFTLWLNGGPGSDSLIGLFEENGPCMLTENLTTSYNPYSWNNVSNMLYISQPVGTGFSYQKQGVGSVNPWSSDFHYNSTEWPATGRYPLLDPLNTGSIDTTDLAAVATWHVLQALLNTIPKFDTKIGTPREFNLFTESYGGHYGPAFFNYFYNQNLKIQNGSMPGYPLSFNSLGIINGIIDEAVQAEHYPEFAVNNTYGIKAYNDTVYSYAKFANNMYNGCLDQIKICRAAAEGNASYYDADAPITNVELTPGVLQICNEAADMCRDNVESPYYYYSGRGVYDIRHGYNDPTPPSYYPDYLNLPEVQEALGVTLNYSSANGIYYAFQNSGDFIYPNFRLDLEHLLNQDVRVSLAYGDADYICNWFGGEAISLAVDYTHSKEFRAAGYEAMVVDGTEYGEVRQYGNFSFARVYEAGHEIPYYQPEAALAYFNRTLFHYDIATGEDKVSANLTSFGSANATHTNSFVPLTSSYVPEFPSPIYPATTTAY

SEQ ID NO: 4827 - protein, 545 aa, Unknown
  Kingdom: Fungi, Phylum: Ascomycota
MKLLNLFSGLLCASTALAFKKPVKPTLPRSFVERSVPNQPFSHPEIQKRASRFLTEKSKPFAVNGTGIPEVPFDIGESYAGLLPISDSPDETRKLFFWFFPSTAEQLPEEITIWLNGGPGCSSLSGLLTENGPFTWMAGTLAPVQNPYSWTNLTSMLWVEQPVGVGYSQGTPNITDEVELANQFRGFYKSFVDTFQTHNWKTYITGESYAGYYVPYIADSFISANDQEYFNLAGISINDPIIGDETIQQQVVLVPYIDFWQNLLYLNETFLQQIHDRQDSCNYSSYLDTYFKFPPPQEPFPVLTSPYDTEDGACANFETIYAAILEVNPCFNIYHITETCPHPYSQLGIINTGDYSPPGAVIYFNRTDVKEALHADINTNWLQCSEINVFGNGNATSTASDASPPPASNGVLQRVIEFTNNTIVGSGDLDMLLSTNGTLFAIQNMTWNGAQGLSEYPTTPLYAPYHPEYNLGAVAGAGYQGVWTAERGLTFYTARLAGHELPGYTPGVAYRMLEILLGKVKDFSSTENFTTQKSGNYTGNGTIYK

SEQ ID NO: 4828 - protein, 264 aa, Unknown
  Kingdom: Fungi, Phylum: Ascomycota
MTRILLSLTAFAALASLVSAGIKFTSPAAGDKLKAGTAIEVEWEEGGTGPKISDLLTYTLTLVGGGQEDAEQQVVYTLPVTGNFALGGNKASALVPTDAQGASTPANAYFIKMVAVGKTGGELTTYSDRFSYSGLTGSWGVNVKKALDALDTTSGPATKDTTSDAAAGADGANGDYDVAYTMQTGTIRYAPMQPVPPKKITATNTKPLYPTSSVKIATTALPIPSIQKTITQSQTLTFQSVENTVAAAPHPTDDMQKFLNRWKD

SEQ ID NO: 4829 - protein, 566 aa, Unknown
  Kingdom: Fungi, Phylum: Ascomycota
MSTQVPSYANSLHKGLMYDITSAPDANIGGQTKPVYVGNVVGGGSVINGMAFDRAAAADYDAWERLGNSGWNWNSLLPYFKKSTTFTPPLSSLASSFGITWDASYYGTNGPIQASFPNFEYADMTSIWAAYKAQGVPMPKEHASGDAVGSYWIPTALRPSTQTRSDARNGYYDPVKGRSNLVLVTGKTVNEVLFDWGLLTGYKAKGVQYVQKSDNSVKQVYASKEVIMAAGAVFTPQLLQLSGLGPRSVLNAAGVSVKKDMPAVGANMQDHPNANMQFDLKDLAIPNPLSGLDPALNATSWAQYNTNRTGPITQAHGSSLAFLSLQTITDKYSSIVSSIRGQNARSYLPSVYADSKLLAGFTKQREIIADLHSRSDAAVAEFPMVAFGLAIGALQRPLSRGTITLNPSNKYAAPIVQFNTFQNPIDRQIIAEMVRWLRQHWARPELAKFSPVEIVPGTGETDEEIIEALIATKALEASFAHMSGSCAMMPEALGGVVGADLLVYGVKQLSIVDGSVIPLVPATHLQATMYAVAEKAADLIKARHPTVSSVPSVFNILNPKNWFRLW

SEQ ID NO: 4830 - protein, 274 aa, Unknown
  Kingdom: Fungi, Phylum: Ascomycota
MVTSTSLVLSLAASAVAAPTCTWSSWKNVKNLFIFVILTYNLAYGGATVDSTLVTPYAPTVLSLANQIEQQFVPRYGSHPTDAPWTASDSLFAFFIGINDVGNSWWLGNATLYDAIFARYDGLLEQVYATGARNFLFLNVPPVQLAPLTLSKDDGGYAVETEGRVIADWNKRVVSLTKAFKKRHAKANLFVHDTYKVFNDVIKNPRSYPQTSGLRNVTGFCAAYANGTPSWTTKDPTCAYAVNEYLWLNDLHPTYPVHNATAASIAQFLKKQKC

SEQ ID NO: 4831 - protein, 524 aa, Unknown
  Kingdom: Fungi, Phylum: Ascomycota
MVLAQTHLEHSPPAGTTVTYNFDITNVTRPHLDGTPGERPFQLINGQYPGPIIRAKWGDTIVVNVKNSLRDNGTGIHWHGIRQLNSCQHDGVPGITECPIAPGKTRQYRFKATQFGTTWYHSHWSAQYGDGVLGTMIIDGPATANYDEDLGVLPITDYYHTPAFTLNEVAQHSQRGPPLPDNILVNGTHINASGGGKYAKMTVTKGKKYRIRIINTSVDSTFSVSLDGHPFTVMTADFVPIKTYITDQLTLAIGQRYDVMIEANQTVNNYWFRVGYGTACGGNNILNTGIQLGAILSYTGAPSGNPTTTGVALRTACVDEDRFKLVPFVPNTVPASAVGTAGKLDLKLQTGNVVRWLIDGSPMIVDWANPTLETTLAGSSNFYPNNNIRELTTSNWYIWYIESNDAFQLPHPIHLHGHDFYVVGEGPGKWDGSAGSLNLDNPLRRDTTTMPVNGYLVLAFPADNPGAWVMHCHIAWHASQGLAMQFLERKGEIQSLIGSTADFTKGCDEWDTVRLPYNMTDSGI

SEQ ID NO: 4832 - protein, 432 aa, Unknown
  Kingdom: Fungi, Phylum: Ascomycota
MNSLLTLVLAAAACAAPTSRSYPTSNTGHHGHTNKNDSYLVSLGPRPYYIMNNMTDGPLKQKLQSCENKPVSISQFSIGHRGGGTLQIPEETEQSEDAGARMGAGVLECDVSFTGDRGLVCRHSLCDLHTTTDILLRPELAKKCTTPFTPANATSPANALCCTSDITIAEYSSLCGKQDGFNASARTPQDYQHGTPTWRTELYDTCGKVLTLNEYIDLVNEYPGYRNFTPELKTPPTEVPMPFKGYTQQQYAQDMVDAFRNKSIDYSRIWPQSFTYDDIVFWLKYDHDFGKQAVYLVEYDTAEDIAAGTSNLTIAKAAGVNIIGPSLPMLLTAGENNTIVPSAYANAIKAAGLDIIAWTYERSGPLATVKSREEYYFESIANVTYYDGQYYEVLDVLANQIGIKGLFSDWSATVTYFANCFDLKGPVGGSYT

SEQ ID NO: 4833 - protein, 716 aa, Unknown
  Kingdom: Fungi, Phylum: Ascomycota
MAQQQQQSALGNVPRVVIRPTWDNMIAVWYLPKGVFFFIAHPYLYPMLKTRLLPAFLLSTFVLFNLFFWTYLPQVAFLSIFHKGGSAWVNGTFLVLGEGAAVVAILFEAFLVDETQVDIFDAVMIHKGYEDLIRQHRPVLEDNLNDPIAEFIILLPLNFVPYVGVPLFLFLTGYRAGPFQHWRYFQLLGFDRKQRREFVGKRRWQYTWYGTVYLFLQLVPPFSMLFLLTAAVSSALWAADLETARRRAEESSVAPQYTDEPDAAIYTHNITCDGVWIEVTHVQVACDDTSIAPGAKAAPASQAAMTVHPQPSLTHSTCIVQTAILLAASALASPAVAGVHKMKLQKVPLSEQLKYANIQEHAKALGQKYMGIKPETHAEQVFKAPYVADGTHPVPVSNFLNAQYFSEISLGTPPQDFKVVLDTGSSNLWVPSSECGSIACYLHSKYDSSASSTYKKNGTSFEIRYGSGELSGFVSNDVFQIGDLKVKHQDFAEATSEPGLAFAFGRFDGIMGLGYDTISVNKIVPPFYNMLDQGLLDEPVFAFYLGDTNEGQESVATFGGIDESHYSGKLTKIPLRRKAYWEVDLDAITFGKETAEMDNTGVILDTGTSLIALPSTIAELLNKEIGAKKSYNGQYTVECNKRDSLPDLTFTLTGHNFTIGAYDYILEVQGSCISAFFGMDFPEPVGPLAILGDAFLRRWYSVYDVGNSAVGLAKAK

SEQ ID NO: 4834 - protein, 381 aa, Unknown
  Kingdom: Fungi, Phylum: Ascomycota
MRFSILLSLLPALALAAPAPILQPRSGTPIPNRYIIKLQNQGVQTILEGLLKLLKKEPTYIYKFGNFGGLAVELSDDVVKLVSKYPGSEKIEKRAYTTQTSTTWGLGRISHPNTGFTSYTYDRTAGANTCVYVIDTGIHTAHPEFEGRATFLANYAGDGSNTDGNGHGTHCAGTVGSKTYGVAKKAKIFAVKVLNASGSGTNSGVIAGINFVAIDAKTRAGCTSGTVGSLSLGGSKSAAVNSAVANAVTAGIFMAVAAGNEAQNATNVSPASEPTAFTVGASDSSDRFASFSNYGSSVDIIAPGVSILSTWNNGGTNTISGTSMATPHVAGLAAYILGFEGKKTPAVLATRLRTLALKNKITGIPGSGTPNYLAFNGNPSR

SEQ ID NO: 4835 - protein, 561 aa, Unknown
  Kingdom: Fungi, Phylum: Ascomycota
MLTIFVLSSLLVLTAQHAFALDRRLTAGVEGNMPKGNNVTTELNSQVTNNVLSLEVEDSLDTTMTPSSEYLASLRRHAIRKVKRQKDGVADVAEELITLGGRVYITRVTLGSHVYPLVIDTGSSDTWVGQTGLTCKSAYGTTVPESACRFGPLYNASASRSYKAYSPREAFGVNYTSGTGFAPRQIINQTIGIVQQGYWNGDSVSSGLMGLAYSRLASQSSSVGYEAVMFSLFDQAYYPPVFSLALDRTSPLPASSARAPGGVLAIGGIPSVAYDNTSWVETTIVPVSASIYTYYSIRISGFSITAPVDSTEPPQNYSASGQRIIVDSGTSLIYLPDRIAEYIASLFVPRATYYEQSGMYIVDCDAVAPRVGVTIAGQTFFISRDDLMNRGVGATNGPGTGAGPGQCVLAIQPALGGASVLGDSWLKNVLVVFDLELSHILSSTPTAEKLPLISTQQPRAPPSNPPIPTIMSHAPPPSFLPALRILFFGFPLTISIGLYDLVLTLALVALEHREMADVFILMLNVALVTGFLFTASISGAVIVEARRGEDRGEGGAKDSGA

SEQ ID NO: 4836 - protein, 364 aa, Unknown
  Kingdom: Fungi, Phylum: Ascomycota
MVKLGAIAFGLLTAVAQVSAQQTVKIMPFGASIVSKCWRANLQTKLRNDAGLTNFDFVGTQKSSCGGTDIDQDHEGHPGSQATDYAAHGNLTVWLNAVDTPDVILMLLGTNDVLLGKKPVGDILKAYDVLLQQMRDRNPKIRVLFSNLLPLDPKRWPAAGAEGIVQLNNAIRQYVPGKNTRDSPVVFVDNFAGFDAVTDTTDGEHPNESGNEKMATRFFEPTRDAILAMSGTAKAAKGQAEEQKPAPTPSPTSTEASTLPLSSTQPSTQAPSSTRAPSSIRAQSAIQTQSVSSVQSSATPSSLVSVTAQRQTTGVPTPNTKPTSSQGSQQTSAASSLKTPLSFGLWRSVRWALSMEGVRQAVLA

SEQ ID NO: 4837 - protein, 583 aa, Unknown
  Kingdom: Fungi, Phylum: Ascomycota
MLKLHTTVPLLAASLVAAQFVPEPTDLTTKEGYAGINVRYKQVPEGICELDPNVKSYSGYADVGKDQHVFWWFFEARNQDPSEAPLTVWINGGPGSSSMIGLFQELGPCGVGPDLKPFNNPYSWSNASNMLFIDEPTTVGFSYSIPIPGYKDDNGYIIQLPNATCPDYAESYGTCGTYSKVDLTLTANTTEGAAPNMWKTLQGFMGAFPEYSRNGFNFATESYGGHYGPVFNAYFLDQNEKNITGAHKIDLENVLIGNGWFDPLIQYQAYYNYSVYPGNTYDYDPYNASVKAEWYNNLYGAGNCYDQTKQCYATGENAVCARADNFCADKVESLYDIYSGRDEYDMRYLVPDPFPYSYYVEYLNTPAVQKAIGAYQNFSESSGTVSSAFGNTGDDDRESGTIEACQKLLAAGVQVMLYYGDADYNCNWLGGQVVADEIAAPGYDTAGFVNISTSDNIVHGQVKQSGLFSFIRVYESGHEVPFYQPLASLEIFERALKQVDIATGECAVDAGYKTVGSPTSTYREGNATIQFEVLPQNATYNTVLNGPDPEPTWTAEAVVKDRVKRSKASLGRPSMAQLRRRST

SEQ ID NO: 4838 - protein, 543 aa, Unknown
  Kingdom: Fungi, Phylum: Ascomycota
MQLVTSLLTLGGLAISVAARNPGQAIGKNLPRPQLPRSSHNVQHVKRQYTVNETKPIITAPTAKKFAVNGTAGAIPDVNFDIGESYAGLLPISDKANETSELYFWFFPSANPDAGEEVTIWLNGGPGCSSLEGFLQENGPISWQYGSGPRAVYNPWNWANLTNMVWIEQPVGTGFSQGTPTATSQEESAAQFLGFWKNFMDTFGLTGKKVYIAGESYAGRYVPYIADAMLNENNTDYYDVKAAMIYDPSIAEDVLLEDIPAVPFVDRWSGLFNFNATFTKDIHERADKCGYTDYMEKYLTFPPVGKFPTPSHNASEPECAIWSDIYNAVMLTNPCFDVYAVATTCPLLWDVLGFPGSFDYLPPGEDTVYFNRTAVQKAINAPIQEWNECSNGVLDTDTSPQSSWEVIPRITEKLDRFIIVHGELDYILLYNGSLMAIQNMTWGGYQGFQQAPTDEFFVPYHEDISLTSLSAKGVMGITHTERKLTWVSQALSGHMVPQYQPSSAYRQAEFLLGRIPSLTSTEPFTTLRGNSTAKRDLGIMGGY

SEQ ID NO: 4839 - protein, 229 aa, Unknown
  Kingdom: Fungi, Phylum: Ascomycota
MKSALVLLAAVASVSAHSTWQQLWVGTTDQAGKCVRTVKDNSPVESLTSADMFCGRGPAKSTGICEVAAGSTLTVEMHAQPGDRKCTNPAIGGAHYGPVLIYMAKVADATTATSGSFFKVAEDGYKGTTPTWGTEILNANCGKRAFTVPKNIAAGNYLVRAEAIALHAGAGSPQPYVSCFQVKVTGGGSANPAGVSFPGGYKISDALFTKAIYDSSFKYVSPGPAVYSG

SEQ ID NO: 4840 - protein, 643 aa, Unknown
  Kingdom: Fungi, Phylum: Ascomycota
MKFFYSLTAGLLSASLASAAVSTDGSCGGTNKYTCQDSTFGNCCSQYGWCGSSDAHCKAGCNSAFGTCAGGSSTTLKSSTKPASTSTRTSAAPSSTPTRNVSKDATCGSNNGGATCLGSSFGNCCSGSGWCGSTSDYCGSSCQAGYGNCGSNNPPGTSSTKPSSTASASATPSASAGVLQCLNGKNVPYKMTSDGDYAELVEPYNLALPYKPSVVVLPQTQQNVQDAVVCAAQNGIKVQAKSGGHSYASFSSGGKDGSMMISLQPFQKVELDASTGITKVGGGVRLGNLADGIYTQGQKALSHGTCPGVGIGGHFTHGGYGHTSRHWGLAMDQIVAADVVLADGSLIKASSTENSDVFWGVRGAADSLGIVTNFYLQTQAAPSSITYFAFPFSNMYNSKTTFTNAWLHLQDFAKNASVIDNKISFGVYIDNWGTFSLSGAYFGSVDEFNTKVKPELLRTMPTPGTPTVKAYSWYDYLVLVSGKDQIKEPLTGYDEHENFFAKSITVPESSGLTASALNAWFDYIKGTSTEYYTIVNLYGGPGSAINSKDLNFSAYNDRDSLWVFQNYGYTTSSKGFINGLNDAIIKAQPQTNFGAYLNYVDPSYDAATAHKLYYGDELYAKLLTLKKKVDPKNVFWNPQAIGA

SEQ ID NO: 4841 - protein, 735 aa, Unknown
  Kingdom: Fungi, Phylum: Ascomycota
MKAFSRSISWATALWPIAFAQNATINLTPAATGFDSDNAALIYASSPILLANDGSAADGGFRTFAAANSTNSTSFAERSHEKSGRTKIAIPIYNVGGRDVIFNIPSPNSIIRAYDVGNGKEILGSRKYQLGDWSVARSWRSQVSGENYVFLFGKKMVVQFLVRGDNDNVQVLEVQSFPIPIEGETAAVFPDGQIFFSGGEGETLYSFQASESTVVPDIRTVGEDLKIEGLGTYQANSSDYLLVAHDDVLDFYDASFNQKGSASLGGITDLSIGGDISVRQSASAQYPSGAIAFAFEGEDDTGIAIGSLESVLGSIGIQANTRYDPHTKPCGYCASPISDVCSKNGFSQGNSTCSCFAGFAGTDCSEITCQNDCSGQGSCDGPNVCTCEAGWAGPDCSFVAVKAKYETEANGGDGDDPAIWIHPTQPEQSRIITTTKSQGGEGFGVFDLKGKLLQHSPATEPNNVDVIYGLPAGNGTIDLAYAACRGDNTLCLVEITSDGSLKNVTGGSQALPEDYEPYGSCTYLSPKSKKQYLFVNNKDAEYLQYELTATTNGTLQTSLVRNFTGGSGGQVEGCVADEAAGYIFLGEEPLGIWRYEAEPDGSNEGFQFAKVGDDGLHADVEGLTLVTAKNGAGGYIMVSSQGISAYLVYDRAPPHKYIMTFTIVDNQEEGIDHVSNTDGLTAVPNKLNVDFPNGLVVTHDDANELAEGGTSAEASFKLLSLVDVFGEERVKALGY

SEQ ID NO: 4842 - protein, 411 aa, Unknown
  Kingdom: Fungi, Phylum: Ascomycota
MAPLTIQKAAAAIAVALPTVIATSQLPPGVIAVPLTRDEGLTAYLAELNVGTPPQKQLLKIDTGSPRYSFLDPRNPVCEREGDPCIKYGNFNNETSSTSEYEGFGFQDALGYVGRGDYLSDTVEIGGVSIEDMYFGMTSDYSFPDKLRGDIWTILGLSLECSLTGPECTDRFSAYLLPELKKASKISHIASSIYLGPDDVEASGAQMLLGGAYDRAKFTGDLITIPMADPFNVSLTGGQTNSVNVTAIEVTLGNGEGQSVNSTVEKYGKEGEGVSVLLDTGVASFYLTEKTLAPIYHALGDVDAPPFGQQYQVVDCKYSSPSRSDGHITIEFGPHGKISIPFHALVSKFPDGTCGIFLASRGDQLAIFGDPFLRGVYSIFDQENFTVSLGEVRHTDEEDIVPFPEGGFKTT

SEQ ID NO: 4843 - protein, 536 aa, Unknown
  Kingdom: Fungi, Phylum: Ascomycota
MKLSTSVLSLAWAGLATARIATKNDLYDYIVVGGGPSGIITASRLAEANKKVLLLERGQGPTVQTGAEPMIWNDTLTAVDVPALAPGIEGYFCDDTPGSAACVLGGGVSINYLVFVRPAAHDFQNWPTGWNWDDIAPAAERLYERNPGSTLPSADGERYDQGLYDTIQPVLEKSGWSAVDMLEQPNEKHEVYSYPAWNIKDSMRAGPLRTYLPEAQKKPGFTLRTGAKTTRVIRHKNRVTGVEFEIDGKKETAGLCNTGRVVLSAGAMGTPRILFNSGIGPQDQIEAAQKSGVKVPSKKDWIKLPVGQNLKDHPIFSIRVQTDGDFDLTNVAGAINGTDTENISIYEEAGSGVLSQGRHRIIFFTSRNGTDGITRYYQGSLAAAGPGLVGITSYMTHGLTSQGAFSIHPNGTGYFSEKVHLTTDADKEGAEAFVNNMVELFTSSETGFSLAEGTNATTILENFTSGNHFVGSAKMGADDGRKGGSSVVDLNTKVYGTDNLFVTDASMHPDLPTGNTQAIVMVAAEAAVAKILAYRG

SEQ ID NO: 4844 - protein, 581 aa, Unknown
  Kingdom: Fungi, Phylum: Ascomycota
MRAFCVTIAILASATRAVAKDCRCLPEDDCWPSKSTWDAFNSTVKGALVQVTPIGAVCHDPTYDEAACSELRASWDDVAIHYESTSSLMTAYFTNETCDPFTDRSEPCTIGNYNAYTVDATDYKQIIDALEFSKEQNIRFVIRNTAHDFWGRSIGYGGLAVRMSNLKDQEVLNWEDSYYTGPALKMGAGTMGFEAQETLEPHDLVMVAGYCPSVGPAGGFVQGAGHSPLSTNYGLAADQTLEYEVITADGELITVSRGENSDLFWALNGGGAGTWAVVVSMTARVYPMVPMAGASLFVDPSTISADNFWDMVDKGYSLLPHFTDNGAYVTYAFGPQHFGTFPFSAYNKTAAEAEEIMSPFIEYLNDNAIPHFISYTESKTYLEHVEKNFATSQPTKEWPSGGRMVPREVFEDPERRAQLVSVMRRIVGTGALTSSTAMRPIKRTDNPTSAHPAWRDMNALVIMTWPWENAKRDLMQEKVELFAEELSPLLLEVAPDGGSYSNEADTFMPQWRHEMYGPNWEKLLEVKEKWDPEGVFYSRNTPGADKWDLDMETGRMCSRRHCPPVHRRNVLQRSSPLDIEV

SEQ ID NO: 4845 - protein, 619 aa, Unknown
  Kingdom: Fungi, Phylum: Ascomycota
MVLTDYTYVFALGTCFALLEAYNNGANDVANAWATSVSSRSISYRWAMICCLVFEMTGALTVGARTSSTIKGGIIPVEAFDGNAGVQLLAFACAAAGASLWVMWCTRHSAHVSSTYSLISSIAGVGVATVGAGQVQWGWNKGSGLGAIFAGLFMAPACSAGFAAIIFMLIKFTVHMRSNPVPWAVWTSPFFFLIAGTICTLSVVYKGSPRLGLADKPAWYIASVTLGVGFGLFVLSALFFVPFVHCKVIKKDYTLKWYDIFKGPALFSRQAPADAEHAKVPDYAVMQHGGDEDSEESSISEPYDPKKTDGSEGTNEKGVTPATDAETTLRRRNIDPERNLPLSQNSQADYQVLLAKARERHHAELRKKRGPIGWAMRTLHNNPMGAGSIYELHNLKTLLRRLPAMPVVACLYGVNYDIHKAQVGVLGTPEGRRMDRVYSAATKYPNEVEHLYSFVQIITACTASFAHGANDVGNAVGVWSAMYECWSTGQAAEAKVPVKLWQIAVIALTICIGFITYGYNIMKVMGSKITYHSPSRGSSMEMGASITILIFSQYKLPVSTSMCITGATVGVGLCNGTLKAVNFQRVGLLVFSWIMTIPIAGLIGGCLMGLALNTPHFGS

SEQ ID NO: 4846 - protein, 399 aa, Unknown
  Kingdom: Fungi, Phylum: Ascomycota
MHFKILLLALLPTTLGAPASSKSSSRLAPLRTAPDKNDVVPNSYIVKFKDSDGAITALDDVLSTVNFKKGRRNRVLKNVFSGFTSTLDEAALKAIRENPAVEYVEQDSVVTASGWVTQKNAPWGLARISSRKAGKTGYVYGSSGGQGTCSYIIDTGVQADHPEFGGRAVQLASFVDGSTDDNGHGTHVAGIIGSKTYGVSKRTKLIGIKVLSATGAGSISSVLAGLDLVVSDSKTRYCPKGVYVNMSLGGGYSTAMNSGAKKLVAEHGIFVAVAAGNSGDDASNSSPASEPSVFTVGSIGSDDSRSDFSNYGSLVDIFAPGENIPSTWPGSSTKKLSGTSMATPHITGLAAFIGGRESYKVRSASAMTARIIQLATNNALSGLGTNDVNRLPFNANPKG

SEQ ID NO: 4847 - protein, 272 aa, Unknown
  Kingdom: Fungi, Phylum: Ascomycota
MTARALPTAAIQPRTIGLGHNDFSCQSQEGRNPVVILHGLGATFYEDINFLESWLQRQGLCTFSITYGAYPGFPFVGGLRPIEESSREVVDFIRQIQEKTGSGKVDLVGHSEGALQTLYTTKFGGISDSIERVVAIAPPTHGTSFANLYTIAETIGIDGLAKSVLSIVGCKACTELVNGGTVIQQLNDGPITQPGVQYTIITSKNDELVSPPDTSFIDETGVTNIYVQEYCPSDSVGHIGEGYDPNVWNLVLNALEGEIGREFECSIGIPFR

SEQ ID NO: 4848 - protein, 448 aa, Unknown
  Kingdom: Fungi, Phylum: Ascomycota
MWSFGLAAFLGAFVSSVAALNAVEVYGNKFFNKDGSQFFMKGMSQATCTVDLGIAYQLRPNDPLIDTEQCKRDVKLMEELGTNTLRVYHVDADANHDGCMSTFADAGIYLLIDLDTFDTYILPENLYWNQTQFKKYAEVIDTFHDYDNVLGFFVGNENIAAKEESIAAPYLKAAARDLKAYRDEKGYRKIPIGYSAADIKELRPMLQDYLTCGGNSSEIIDFFGLNSYSWCDPSTFNESSYNELQEYAKDFPVPIFFTETGCNVPGPRLWDDQDAIFGPEMVNDWSGSIVYEWIQEQNHYGIISYGQDGEGSPDFFDGWMRKGTPSPVSPDFNNLKTKWASINPTGVSKKDYNTDHVSTRKCPAPTGDGWWEVNGNVVLPTLGQTHQGTYSTQASATADPSDNAPQPTESSSENKDNGDDKDGAAGTQQMAAFGASLAIGIFVLALWL

SEQ ID NO: 4849 - protein, 465 aa, Unknown
  Kingdom: Fungi, Phylum: Ascomycota
MLRSLAIAGLLATTALAQKCTLENKCPEDAPCCGQFGDCGVGAFCLGGCDPRMSFNLESCMPHPVCKDRTTKFDNLDRVQDISKFLGDPKTADWVSQGEPVINDGTVLLTMPKGSVGTVISSTDYMWYGNVKARMKTSRGRGVVTAFILFSDVKDEIDYEWVGVDLETAQTNYYFQGITNYTNSENITDLSDSFKNWHDYEMRWTPDKIDWVVDGKTERTVERKYTFNATSNQYEFPQTPARVQLSLWPGGLASNAKGTIDWAGGEIDWNAADIQDPGFFYASVDSVEVECYSASSGAGTNKNKSYSYDNLAGTNDTVVDGDKDTVLGSLMASGLDPDVGKKKEKESKSKDSSTKTDSEEKPKNTAAQIPGGGSVGQDHSDEGDSSDDSGNDNGSGGSSGGDGGDSGSAPANTADCDVSSFHADCNGDKSSSSESSKDGDGEGSAPRAGASALAVIIAACALFWL

SEQ ID NO: 4850 - protein, 388 aa, Unknown
  Kingdom: Fungi, Phylum: Ascomycota
MRASILLALLPAVLGAPTRRSEPAPLHVPRDVDSLIKDTYIVKYKDITAFSAVDEGIKVLTGKPAHIFKGAFKGFAGKIDAEALEILRDDPSVDFIEQDAIVSLSAYTTQSNAPWGLARISHRARGPTGYTYDTSAGSGTCSYIVDTGIQASHPDFGGRATQLISYAGNNADGNGHGTHVAGTIGSNTYGVAKRTTLLGVKVLSDSGSGSISGIISGLNYVVSDSRSRSCPNGAFANMSLGGGYSASLNSAAKGLIDNNIFLAVAAGNENQNAANVSPASEPTVCTVGATTSTDAKASFSNFGALVDIFAPGQGILSTWIGSSTNSISGTSMASPHIAGLAAYLAGLEGYPGAQAACNRIIALATTGVITGLPSGTPNRLAFNGNPSG

SEQ ID NO: 4851 - protein, 444 aa, Unknown
  Kingdom: Fungi, Phylum: Ascomycota
MAVETSSTPRLGAKKAVSIDLDDYFSGPMDSAKHSNLPYWMRMHGSVLPKIILPLLFVSGWATAIVLISKFVYDLGIASTLLTVLGFVVGLALSFRSSTAYERYNEGRKYWAQLTLTARNLSRIFWIHAKERDGELGKEDLLAKITAVNLIQAFCVAMKHKLRYEPEYDYTDLKYLIENLDTFAKSAHEPNAPAAKSAPAIKTWAAYLGVPGAEDNPAKAIKKSDKHHGHLPLEILTYLSSYLESIIQNETFKTSCMQTAAINSLGIMGDTLTGCERILMTPLPAAYSIAISQITWLYVLVLPFQLYSTLDWIAIPGTIVAAYIILGIAAIGREIENPFGRDVNDLDLDRYCDALAMELDLLVSKRPQTLADFVRRDDNTPLWPVSMAGYNSWNQRDLTSIRTALKDKANAQKDKIEEIREDEAREVDQQNSTSPSKSGAASQV

SEQ ID NO: 4852 - protein, 2913 aa, Unknown
  Kingdom: Fungi, Phylum: Ascomycota
MHRFSQNDNGVLPKAALTKDTLLRAQVCEYASADSAFLLARARNATNAGDDGDVTGVANTTPSQWREEKPPKDLRRAAISHFRIHYACTLLNFLPPQQLVDDEAGDDLSLGLLLCIIVLTSRSLHYAGPEASSPRMLGDYYEEAARRELGSFDEEPSLVAIQCCLILCIYEIGEGAEHRAWLRLGHATKLAQLLQLHKQDANFGLMDWGKSAESNSAVINESKRRTFWCCFCLERLFANGRDRLVTFAVEDITTPLPQSEEDFIYGRLTATCKLSCPLPGNAEQCEHAMKAEPIATHTIRIVQILGHIITWNGRGGRHVDARAPWLPDMPFQELDSCLYRWVKSVPQHLTQTPQNTSAVIAIGQGRSWALMWMVYHQARAYLHREYLPFIPKIGYDPVQGPCDGPKLLVDDPAVATRFWRSSIAAMIESANAISDLYQIMRTRDLAASAYPTPGFGLLAAASIHIQLSIFSWESCKPFSMGKSSLDYLKQDMEGINHVGQNWSLPVHWIRQISLYYKLNLLIKRSWSEHSPSTVPTPPMDIQRIKDGIMNYVRQIGPGDRDARDANLKPDFDFEGWLSALQSSAGEGSRGSLEEPDHQAGDEAFSADNAATFPVAPTMGPADWHQYDQAFFDSLTVRAFPVLASSAAATFFLQVDLSPRSRDLLVVVRANGDLLFGIVASMPAVTVATDGTGDYTAIGSAISYAQANSVPTVTVLAGTYTETLAVATAAVTIVGETSSSSTKRQSTDSSSENKVVITNGGGNSRPLTIPAKAKGIVWKNINFVNSNSASSVGIVSLQGSANAFYGCSFVAAGSYAFTGALASGLIANSYIEAYDKPFSSYSSLYIFGSTVTVTNNNALLVYTLGYTVNGILYNSTTILDNCQVIQKTGTATKNVYLAAANGPGSIALFRSTYLPAFIAASGAHPSVASVSGVQYLEYDTSGPGSYAQNAASRAGYVTLVSNSNDLSAYGISKFYGTVYPSVAVANTDWIDSSVLSAIGASNSANAHTGSSSSSSSSSSSSSSSSASSSSVSSSISSDVSTISSTSTSTSTSTSSSQDSSSSSSSSSSSASTSSTVSTTSLAAAVASTCLPSSMPSTALIVGPSTNSCAQYNTITDAIAALPADSTTQYIYVLAGTYTEQPSITRVGSVILRGETDDTSSSSANKVTIQNSNGRLSSSGGSSTTATFSANKYETKLMAFYNINFVNAFSAQTNYIALAVYAKGQKVAFYGCNIVSSQGALYLDYGNVYFSSGRIEGTTDFVWGQGAGYIYNSVIVTDGTITGQTIAAQKYQSSYGGSQLVFSLCAIVPGSKDLPQQGTYLGRDYSTNANVAFVDSYMDAHIASVGWLVSSASTFTGSFVEANNTGPGAGTSSRTSSAKIITDSSAYTVKNILGDDSWLDSLAIAGFSGWPDSVYSVTTTSSVWSTSATTTASTSASSSTSSSTSVGATITVAPTPTDGQYGSVASAIAALPADGKDYTIYILAGTYTEQFSITRRGKVTLRGESSFANDFTGNQVLIEFSDGVSTNAGQNEQTPIINWKNTNGDGLALYNINFTNTFPQTTNYAALAADFYGTNMAAYGCAFKGFQDSLLVNQGVQVFSNSYIEGSVDFIWGYSKAYFYQCYVASNTAGACITAQNRPSSSWAGGFVFDKSLITYTDAYGSSTGTTYLGRPWSQYAVAVYMNSYLDQHIASAGWNTWQPSDTRTSNVLFGEFNNTGPGNWSTSRASFATSLTESQASAYSLSSFIGSTSWLDMAAYNLDPSYSLARDSSDTTTPSAGATWAHPTSGIEHPAGAVLVSVDGTISGSYSSLTSALASLPSDSSTQIIFMYPGTYNEQVPAISRNGPVMIIGYTEDDPGKTYSTNQVIITQARGLSVSPVPVGHSNAETATIQTASTKIAMYNINMINSENLDGSQSSYVTLAASIYGNKIGFYGCSFIGWQDTLLTGATAGYQYYESSYIEGAIDFIWGYSKAYFKGCTIGAKRKSSAMTAQSRASASAVGGYIFDQCLFTAAPSATVDLTGGVYLGRPYSQYALVVIKNSYLDDTIQPAGWKVWSATDPRTSAVTFAEYNNKGPGNWENNAAARQGFGYATLLTSDSYSLSSVMDSTNWIDMTYWDQIETPQGSGTITPGATTYDGTTPPDGSFIVSKDAIDGKTTYSTIQSALDALPLSSKTTAIVFIYPGTYDEQLIISKPGTTIFLGYSTAPSDYTKNQVIITHNIGVDTQADASNSDSATVYATGNYFQAVNINFANTYGTAANYATLGFGVKSSKYASLYGCQVYGNQDALLINGFFFASNSYIEGNIDMIWGSGAGYFLNSTIATNKDGIDVTANKRSTSTTAAGFVFDQCTITAANGASYSSVSLGRPWNQYARVAYIKSYLGSMIKASGWDQWTKTDPRTAGVLFGEAGNSGPGATTTNRASFATKLCPSDAVQFELGTFFAATAWINSTFVYATPFVAASLPSDCTPISTATSTSSTTTSSIPLSTVTVYTTKVSTLKETIYTTTTAAPQSTTIKSTSTVDIGTTITPDPVTVTTTMKSTTTMIQTIQEADVLVTKTATQFVNIGKTITPAFVTETSWQTVPSTTILTTHVVGKDSTIKTTVSQTVYATSSPKPTTSTATVSSTVFRTQTFSPKAVTVMSTTTVTQGTGGLTTVTAKATTSYVTLYTTSTKVSKKTTTVTCTSTKNKRGLTEFPVPTATAGYDIVARQAAAAKTVTVTVSSIFTTAVKTSVSTVPGAIETVEQLATKTIGKPTTLKAVTTTSTTVSMATKYQTTTLPGATSTTTVTQVTSTGKTTTLKASTTVVTSHTTSVQTVKSTITDPGQTVVSTQTAVRIITTVLPQVTATVTNSQIVTSTKTVTLPAGTVTSWATVKTTLKPSSTVTQQATVIKTTTIKVAATTSTWVTKTSKSAKTCPTS

SEQ ID NO: 4853 - protein, 1257 aa, Unknown
  Kingdom: Fungi, Phylum: Ascomycota
MTLKSPLRKGLSLLIPIAVSLLPLTEAQVVQWDIYRRNDGPQVHRRAERTYEETIVNERGRGGYFATARLGTPGQNVTLQLDTASSDIWVPYSGAGICRTKSLSGRSGCYLGSFDPDKSKTFYDFAPDSFDISYIDQSYSKGDYFNDTFEITGATVSNLTMGLGLQTDLAYGLLGVGYAINEASISSAGFMYPNLPIAMQKSGHIRTIAYSLWLNDLDASTGNILFGGVDTGKYLGDMMRISILKDKKVNNYTHFAIPMTSLEATSPTGTDVLSTKWPIEVILDSGTTLSYLPFGLAQLVWDEVGATYNSKLEMAVLPCSHGAHPGYFSFGFAGPNGPRINITMDELVIDLTDGNPPEFTSGEYKGERVCQFGIQRSYASPWTLGDTFLRSAYVVYDLENNEIGMASTDFNSTKTNVLPFKSKGAKIPSATLVTNEMQKSGSPAPAGTNLIAANGFQDKDENGDDLDENQDSKNGTKDGDDDDDAAKCLNYSIGYLSVAAGPPSSTTQGRRGFSQSARRCNSAAQEALRKAQDDAESLTPEYVAANMAPEEAKRLSSVRNIGIAAHIDSGKTTATERVLFYTGRIKAIHEVRGKDSVGAKMDSMDLEREKGITIQSAATFCDWKKTTDGKEQTYHFNLIDTPGHIDFTIEVERALRVLDGAVMILCAVSGVQSQTITVDRQMKRYDVPRISFINKMDRMGSNPFKAVDQINQKLKMPAAAVQVPIGAEDEFEGVVDLINMQAMYFEGPRGTKVRITDTIPVNLQSLAEERRQMLIEKLADVDDEMAEIFLEELEPTKEQIKAAIRRATIARKFSPVFMGSALADKGVQPMLDGVCDYLPNPGEIRNMALDKKQSEKPVQLIPYNSLPFVGLAFKLEENNYGQLTYIRVYQGTLTKGSYLFNSRTDKKVRIPRIVRMHSNEMEDVNEVGAGEICAVFGVDCASGDTFTDGGLPYTMSTMFVPEAVMSLSISPKRSGDADNFSKAMNRFTREDPTFRVHVDPESEETIISGMGELHLEVYVERLKREYKCECVTGQPRVAYRETISRHADFDFLLKRQSGGPGDFARVMGYIEPNDNPDENFYESQVVGGNIPDKFLTACSKGFDLACDKGPLLGHKVIGSKMIINDGQTHMTDSSDYAFSLATQMAFAKAFKDAGGQVLEPLMKTTITAPNEFQGNILMLMNKRNATINDTDIGSEDFTLTCDCSLNAMFGFSSQLRAATQGKGEFSMEFSHYAAAPPHLQKELVAKYQAELDAKRTK

SEQ ID NO: 4854 - protein, 316 aa, Unknown
  Kingdom: Fungi, Phylum: Ascomycota
MVDRPNKPSALATTPTMPPQAQVNISHGNSRVTAVLPTGESIEILLYGATVISWKNAAGDEKLWLSEAAKLDGSKPVRGGIPLVFPVFGSAPDHEATSKLPQHGFARNSRWEFLGKSTSEGSSSSSVKLDFGLSSENLEDAVKGQWPYSFGLLYSVTLDRDSLNTTLVVTNDGDTPFECQTLLHTYFKIKDISSIQIKGLEDSSYIDKVDGMTTKTQSSTVAITGETDRIYSPTKGPKHPIIVSDGSGNTLYRIVRDNLDDVVVWNPWVDKSAGMADFEPKDGWKNMICVEAGSVKGWQKLDKGDALEGAQTIYLE

SEQ ID NO: 4855 - protein, 669 aa, Unknown
  Kingdom: Fungi, Phylum: Ascomycota
MLANKLNTALAVLASLSVASAQTYRRLGTCPTLGCVLPPDQSEFLPGQLFDLRVEVHAPVNGSEAAHNGKPDEKFTVTIAKDGEKAQDFAKAFELKEPKLETWTFSWFEDLFAEDAGTPSVVNVASKAYRKLALYEPGTYTVTLKYYDEETVAEWTVRDVKRERKAKNVIFFIGDGMTTSMITAARLLGHKSINGKYQSMMKMDEFPVLGHQMTHSIDTYITDSANSASALYTGHKSTVNALGVYADSSKDPFDDPKVETIVELFRRVHGGAWGAVTTAYLADATPAALTGHSRLRSQYGALIDQTLNGMTNYSWTKQDGPDVFFGTGAQYFLPKSVAGSASYQGKDYFEEFAKKGYTVSMNKTALEKVDTSKKALGVFATGDLPTWLDRNVYTENLEDFKNDPSGSGKPALDLPGLKDMTTKAVEILAKRGGDDGFFLMSEGASIDKQMHAMDYDRALADLLELDDTIAATIKKLEDLGILDETLIVVSADHGHAFDVWGSADTKYIQEKDDDREKRNAIGTYEKSGLSQYTVRKEGVNYGTPESFPMNWEPRYAIAAGVGAAPDRIENYKVHKDGSRKATRELNGEYVANEADSPGGFLINGTLPTSEAVGVHSLTDVAVYAWGPCQATFGGTYSNIDIFYKMAECLGLATEDGEGNGGCKPKPKNN

SEQ ID NO: 4856 - protein, 636 aa, Unknown
  Kingdom: Fungi, Phylum: Ascomycota
MLLKRIKSGIASCAFFGIFLSARLCEAKTVTYNFNVSWVNANPDGLYERKVVGINGQWPLPVIEVDKGDQLVVHMQNSLDDKSASIHFHGMFQNGTNEMDGPSMVTQCPVLPGQSFTYNFTVNQNGTYWYHCHTDGCYPDGYRQALTVHDKDAYFTKEVDEEFTLTLSDWYHDMIEDLMGSFMSVYNPTGAEPIPNSFLMNDTQHTSIHVKPNTTYMIRLVNIAAFVGQYFYIEDHSFKIVEVDGVYTEPTEASLIYLAAAQRYSILVTTKNQTAKNFAMVTVADSSLLDTIPSSLQLNNTNWLEYNHSAPHHEAHIAVDQSSDLDPFDDVNLVPHDHMPLLPEPDLEIVVTVQMQNLITGDNYAFLNDITYTKPKVPTLYTVLSSGNESNNAAIYGRDTHPFVLQHNQVVQIVLQSNDTGSHPFHLHGHNFQVITREPSYGPDFLSLKSGDPLPYDASNHTAFHHSPMRRDVAVLPPNGYYVIRFVADNPGVWFFHCHIDWHLSSGLAMLMIEAPTQMQERMTIPQEHFDVCKAAGIPYEGNAAGRAGEHLLDLSGVPNQPGWIPGGFTARGIVAMSFSVLSAFLGIGFIIAYGLSGVQREKSSEKEAMKSAPLNGVTSDMITELVVSPTDRDKS

SEQ ID NO: 4857 - protein, 521 aa, Unknown
  Kingdom: Fungi, Phylum: Ascomycota
MARLTTSTLPSRIVGLALLAAAATAPQLVSAQDVIEPSLDGVKAACTALNDKFPDQTFYSAVDEEEYTFEAKTQYWSALNYKSPACVFVPESAQQVSFAVKTFTETKSRFAVRGGGHMPIIGSNSIDSDGILLSLSGLDTLKLSEDTKIVSVGPGNRWRDVYGFLEPHSLAAVGGRVGGVGVPGLLLGGGISFHSSQYGFASDNVALYEVVLASGEVVEATRDNEHSDLYWALRGGGNSFAIVTRFDLRTIKSPGVWVGISQYNAADSESYLDAVYNFGQYGSMDKKAAIIPTILSLPSFGVTAYAASRFYDSTTEPATAFENFTAPVLTPVEEAYGPQSLAAYVRGVDALQPTGLRQDFRVLSMLVDRDAVSYVHNTFLSATASELSAIPDLTTSITFQPIPEGFIKRSACRGGGPNPQGVDRSSAPYFWIVQNLSWQSEEYDDVLVAFAKKVSKEIQDGLAAKGVAGEYLYMNDAGEGQKVFESYPKENLKRLKDIREEYDPKRVYTNLLVGGWKVLDA

SEQ ID NO: 4858 - protein, 398 aa, Unknown
  Kingdom: Fungi, Phylum: Ascomycota
MKFSRSALLATCLPVATARFVEKHEADAEADNVVLYPDNAAEFLIETAPGKTQWVTEEDKWDLRRAGKNFMDITDTPSLGSLRARTAAKVHFPEKCVRQDDVYPLIGNLTTTEMKTNLEKLTSFHTRYFKSETGKESSDWVLAKVNEIIEEAGAEKHVSAKPFPHTWQQSSVIATIPGQSDETVVIGAHQDSINLWLPSILAAPGADDDGSGTVTIMEVFRALLQSEDVRKGKAKNTIEFHWYSAEEGGLLGSQAIFQAYEKKGRDVKAMLQQDMTGFVQKTLDAGKPEAVGVITDFVDAGLTTFIKTVIEEYCNIDWVETKCGYACSDHASASKAGYPSAFVIESEFSDSDPHIHSTDDSISYLSFEHMLEHARMTLGLVYELGFNDFSSKKQVGEL

SEQ ID NO: 4859 - protein, 104 aa, Unknown
  Kingdom: Fungi, Phylum: Ascomycota
MSAPQSEAFKTAVADSKKLTSKPGNDDLLDLYGLYKVAIGEDIAKAPAPGMFDLKGKAKKNAWQKFVDEGNTPDQAQEKYIAKVEALKESCGYDANKEPEAVGA

SEQ ID NO: 4860 - protein, 747 aa, Unknown
  Kingdom: Fungi, Phylum: Ascomycota
MAESKCPVARQMNVGGGGTRNRDWWPEQLRLNILRQHNPASDPLGKDFNYAEAFKSLDYDALKKDIAAVMTDSQDWWPADFGHYGGLFIRMAWHSAGTYRVTDGRGGGGQGQQRFAPLNSWPDNVSLDKARRLLWPVKQKYGNKISWADLLLLTGNVALEDMGFKTFGFAGGRSDTWEADESTYWGGENTWLGNDVRYADGNPGSSGPGVVDGDQQVDHKDIHTRKLEEPLGAAHMGLIYVNPEGPDGNPDPVAAAKDIRTTFGRMAMNDEETVALIAGGHTFGKTHGAAPSDNVGPEPEGAPMENQGFGWVNSYGSGKGPDTITSGLEVTWTRTPTKWSNQYFEYLFKYEWEHQKSPAGANQWVAKNAEEVIPHAFDANKKQLPTMLTTDLSLRFDPEYEKISRRFLENPDQFADAFGRAWFKLLHRDLGPKSRYLGPEIPKEDLIWQDPLPAVDHALINESDITALKQAVLQAVPDVSKLVATAWASASTFRGSDKRGGANGARIRLSPQKDWKANNPQQLAQVLGALENVQKQFNSQGNGKKVSLADLIVLAGSAAVEKSAQDAGHNVSVPFTPGRTDATQEQTDVGSVNHLEPHVDGFRNYGQSNHRVKVESYLVDKANLLTLTAPEMTVLVGGLRALNANWDGSSHGVFTTRPGVLTNDFFVNLLDMSTQWKSAGSEDVFEGVDRKTGAKKWTATRADLVFGSQAELRALSEVYASADGAEKFVNDFAAAWTKVMNLDRFDL

SEQ ID NO: 4861 - protein, 519 aa, Unknown
  Kingdom: Fungi, Phylum: Ascomycota
MRSATALALLANEASAQFARAVAGDGFLAVPVGTVENPKKDLSKVKRDDNFLETVLDNKDFWYSTDLGFGNPPQNVTVLVDTGSSHLWINPDCLESFTTQQARECQSYGEYDPDDSDTPPVGPFGRELLRYGDASDTATLTEARLQYFADDVWFGGVRLRNQTFGVATSSSGISQGLFGLGPDLRAGFEGTEPHSLVLHSMADQGLISSRVFALDLRHAESQTGAIIYGGIDRNKFIGTLEARPIITGLDGAVRLTISMDSIGITLDGETESWELSDDETNVLLDSGSTLTRLHFDVALPILQALGAEDSGEGYFLTPCSARDTPGSVNFEFGTKTVRVPFSDFIIDLGDPRYCYVGVALTTEQQILGDTVLRAGYFVFDWDNEQVHVGQAANCGDSDIVAVGSGRDAVPDVTGNCDESDAIFTGTGRVTRTGGANALPTEPVTTTYTVTSCPPLEQGCETGVVVTETLNAVRPTVTVTSGAGGNASEDDDDEDAGVRPDAMTALLVVGGLMAMGWNLL

SEQ ID NO: 4862 - protein, 1241 aa, Unknown
  Kingdom: Fungi, Phylum: Ascomycota
MKQYNSCSAFLTAFTLILSLFTFTAAQTLPNLRIQSLGDSITKGSGSSDGNGYRKRLRNKLTLHGFAVDMIGSLRNGDMPDNDHEGHSGKYLADIAQYWKRSIRARPNIVLIHAGTNNMDKEVDLAIAPALIESIIDDIFSAAPDATILVAPVIWANSARMQANTDVFNNQLERTIVRKQQGGKHILAVRTNIGLSDLSDMKHPNNAGYEKMASAWYSAIIEAQGRGWLSKPVTVNPSDLPGMGLGARDSDLSGTSNCAGGNWEKSGSIFDGPRVWEEVGVIRAPVEGASRERLILADLNNDGIADYIMPSKDGNVSAWINGGKPDQWTSLGRINPSWSKVTGDMVRMADVDGDGRADMIVLYEDGAAKVWRNMDNGKRFESLDSKWATGLESRDQIRIEDVDGDGYADYVILSSEGTVKWARNTRNNGKDPSKRNWELAETIAPGPSGIPKNRVRLYDLDGDKRTDYVIVYDGGAVKALRNTGNLNKNANSRNWEDLGTIAPGVQGVTGDMIRFADMDGDGLADFLAVGSDGSIRMWKNLGIVGSKGASIKFADLTGDGRADIISVDGSGRARAWLNSGTPGKWIDAGIIAPGPKEDLSSSRIEFADVNGDKLADYLIIYGGGAVKAFLNNGNILDVGKGRIWSEGIVIAPGVGEPGRKVQFADLDGDGFADYLVVYDGGAVQYYRNNKNIPPQGGGRIWQNGYTVATGVGEPGEKVRFADITGDGRAEYLVQYDGGATISYRNSGNIPKISDKRNWLQMGIIAAGVSPQGPVQYADINGDGKDDYLVVFDDGRVNAYINTCDWIPKSPPPSSDDGGGNGGGDGEDDADSGNEDPDELEETLEDRPPCAAKYYKLSEVESYARKIPSYCMSLYLANVQIARLESSLNEYDRKISKGYDRKFSVYERAMRQQVPGQLHAYMASDRVNKYFRCHEERIVKCCKDCGGGWGDCTSTCDKSSGCKSGKRWLRMDKCPSVISSWVPGSIGNKPVYATKFELVDSDGFYKDIADSRGVLKSWITLGERLIYVNPGCGGDPVGCQSQNKYWEGYPMPGKIEIPDPKELVSKSYKDTRKLTGRLKIEAMLAKYAVADSSDLVDAVSLPALMVESVVKSMAEIVETANDIIEQERKLMVSLWVTSILMLVPFAGQAAGAGGMLALRAALIFAGDAAAIGWSIYEIVDDPDSAVFAVLGILLGGLPSRQPIREAADARRSMSSNEIKAMGPDVKKDMDKITSLKTSCFIR

SEQ ID NO: 4863 - protein, 473 aa, Unknown
  Kingdom: Fungi, Phylum: Ascomycota
MGNGQSSPLQTCLDAICSGRSDCVAYAGDPFYQLSWVKPYNLDVPVTPVAVIRPDNAQEVAAAVKCAGKNNVPVQAKSGGHSYANFGLGGDNGALTIDLVNLKSFSMDNTTWHASVGAGHKLGEMDKKMHAAGKRAMAHGTCPGVGIGGHATIGGLGPMSRMWGTALDHVVEVEVVTADGKVQRASQNENADLFFALRGAGASFGIITEFVVKTHPEPGSVVEYTYHFSFGRQKEMADVYRAWQALTGDPDMDKRFSSLFIAQPLGAVVTGTFYGTEEEFQETGIPDKLPTGGKIEANITDWLGSLAHEAEVSALALSDLPSSFYSKSLAFRKEDILDDTSIDALFDYMDKSKSGTLLWFIIWDSTGGVINEVNPNSTAYPHRDKVFMYQSYAVGIPDLSDTTKKFLEGVHEHIQKGAPNAVTTYAGYVDPVYDRADAEKLYWGDKLPVLSSLKKKWDSSNIFRNPQSVTPAK

SEQ ID NO: 4864 - protein, 580 aa, Unknown
  Kingdom: Fungi, Phylum: Ascomycota
MKFSAITVSLSSAAALLASSAAALKIDDAFLGARSSSSCKCFPGDACWPATAAWSSLNSTVGGRLIKTVPLGSPCHDPTFDGDRCAYLQDEWKSPSIHMNSSSSVMAPFFANQSCDPFQPESRPCLLGNYVRYAVNATSAKHVQAAIKFAKANNIRFVIRNTGHDYNGRSTGAGALSVWTHYMKDIQVVDWKSASYTGKALKLGAGVQGFEAMEVADENGLAIVSGECPTVSVGGGYTQGGGHSALSTSFGLGVDNVLEWEVVTADAKVVKASRTQNADLFWALNGGGGGNWGVATSVTVRAHPDATVSGASVVFLSSNNEASAFWQAIDAFHEELADMVDAGTMVVYYFSASFFQIAPINAYNMTEAQVRNTLAPFQARLNDLDINYTATFTEFPSYKEHFNKYFGPLPIGAIQVGIAQYGGRLIPRESITNITSFSRTIGDHDGAIFIGVGTDVSSFAPSGQKNEQASAQPVWRDTLVHATITTPWSFQAPWSEMIANQDLMTNVLMPAIEAVTPNGGAYQNEADFRQPNWQEAFFGSNYYALQCIKEKWDPQGFFYALNGVGSEQWKVAVDGRMCRA

SEQ ID NO: 4865 - protein, 617 aa, Unknown
  Kingdom: Fungi, Phylum: Ascomycota
MALYEFPVSALCVLAVMFAPLAAATRPSGSSFGIPGLNATYDYIVVGGGTAGLTLATRLAEQQTGSVAVVEAGTFYETGNGNRSQVPFFDHYYISKAKDDFQPLVDWGYITSAQKNAYDVELHYARGKCLGGSSARNYMIYQRANKDAYQRWAEAVGDESYSFENLLPFFNKGICFTPPNDQLRFANSTPSYDASVMGNCSGPLSITYSNYAHSFASWATRGLEAMGLKIFPGFASGSLVSGQSYVMSAISAKDQIRDSSETSFMRKALRLPNYTAYILTQAKKITFSPDKKANGVWVDTLGSRYHLTATKEVIVSAGTFASPQLLMVSGVGPVETLNRLEIPVVVDRPGVGQGMQDHLYFGPSYRVKGLTTSSLLDSNAFAEATRAFQVNSTGMLTNPSNDIIAWEKFPKHLRSGFSNRTLKALASYPADWPEIELLAISSYLGYQNTSGSDPNDGHQYATMGAALCMPQSRGSVTINSTDNAVSPIIDPNFFADPADVEVAVAAYKRVREFWKTPVVQAFREDDVEAFPGLHVQTDAQIEDIVKQSFQTIFHAASTCSMGNSSNKMAVVDNKARVYGVHGLRVVDASIFPFLPPGHPMSTVYALAEKIAADITGA

SEQ ID NO: 4866 - protein, 470 aa, Unknown
  Kingdom: Fungi, Phylum: Ascomycota
MVARLLLALSLTGSVSASSLASTYSFNPLRHLAGIAPYFEPHDPPASPDAPQGCTADRAAYLVRHAAIYASNFDFKEYLKPFFEKLENKSSSVDWKKVPYLNFLDDWSPPVSDDDLFSLTRLGRLQATKLGVDLDFRYPGIKAPKKVWASSVERTVKSAQSFVRGLQPDDGDVEVISIDESTESGANSLTPHKACPAYSKSAGSEEATVYQEIYAKPIAARLNDLVPDFNFTISDVFSMQQLCGYETVIRGKSPFCSTELFTPDDWLGWEYSEDIRYHYNAGYGFPAAGYIGVPWLNATASLLLDNHNDGDDLLVSFTHRELIPMVMVAMGVFNNSQFSGANNINDTLPLDRINYRREWKSSHFVSFLSNVAIERFNCTNSYGYDDGEYYRVLVNSAPQALPSCTDGPGTTCSRNAFEEYVQRRVEMLSGFSDKCGVEYGNSTDTLSIYTNSSVGTKVKEDKRYIANFGS

SEQ ID NO: 4867 - protein, 358 aa, Unknown
  Kingdom: Fungi, Phylum: Ascomycota
MRAFNVPSVIATVAAFVANSHGAPSSGCTPLRHWPKEAAESLNAMIRANAHTGAYAVFDMDNTSYRYDLEESLIPYLEARGILTRESIDPWLKLIPFKDTETHKETLFSYYYRLCDIDDAVCFAWAAQVFSGFTLRTLKGYVDELMAYNGTIKTTYYDGDDIVDLEVSRPVVFRGQQELFNRLMEHGIQVYIMTAALEELVRMVASDPKYGYNVPPENVIGVTMLLANDSSPSTPTSARKQIQDGDYDEQANLDLRLTSYLWAPATWQAGKDAAIMTYIDQWRKPVLVGGDSPTNDAHMLFHDVDVAKGGVRVWVDRGEKYLKSINEQIKTNSEAQEKLGLEVTADKNWVMVKPTDIL

SEQ ID NO: 4868 - protein, 505 aa, Unknown
  Kingdom: Fungi, Phylum: Ascomycota
MGLRIAALTALAGTASLVLADGAGTLLDPVQPILTPNGRLSQNPLGHLGANGPWQIGPNVNNISPDVPEGCVVDQAAYVSRHGSRYPDSGAYAGWVAMADKFKENTYNATGPLAFIHDWTPPLSNPAIEIAQESKTGYKELFGLGYTLRLRYPDLYQEGDPFFIWANNYTRVIQTAQLFAHGYLGTNASLATVVSVTSKGFPSHLGDSLAPSDMCPTFVDDSDSQTQAWQKKWMPAYIARLSQYVVSGHLNLTDDEFNSFPYICGYESQITGYLSPFCDTFNDEELAAYEYQQDLRYYYGVGPGTKVASKMMVPFLDGLVQRLVDGPDAEGKDFSGGTFKVPKLLMTFLNDGQLVELATATGVFDKQKPLPVDHIAQDRLWHSSRITPMRGTIAFERLTCNVQSSSKSHDSYGSKRSDKPHKNKVESFIRIRLNDAVYPLASCKDGPGGSCGLQKYAKYISDKNKNIGSFAKLCNATAPGTPTGTVKGASFFTDLAQPNLQAVKP

SEQ ID NO: 4869 - protein, 680 aa, Unknown
  Kingdom: Fungi, Phylum: Ascomycota
MLANKLNAALAVLASLSVASAQTFRRLGTCPTLGCVLPPDQSEFLPGQLFDLRVEVHAPVNGSEAAHDGKPDEAFTVTIAKGAEKPQDFAKAFDLKEPKLETWTFKWFEDLFAEDAGTPSVVNVTSKAYRKLALYEPGTYTVTLKYYNGEETTAKWTVRDIKPKRKAKNVIFFIGDGMTTSMITAARLLGHKSINGKYQSMMKMDEFPVLGHQMTHSIDTYITDSANSASALYTGHKSTVNALGVYADSSKDPFDDPKVETIVEIFRRVHGGAWGAVTTAYLADATPTALTGHSRFRSQYGPLIDQALNGMTNYSWTKQDGPDVYFGTGAQYFLPKDVAGSASYQGKNYYDEFAKKGYTVSLNKTSLLSADPSKKALGVFATGDLPTWLDRNVYKNNLEAFKNDPSGSGKPALDLPGLKEMTTKAVEILNKRGGDDGFFLMSEAASVDKQMHAMDYDRALGDLLELDDTVAATIKKLEELGILDETLIVVSADHGHAFDVWGSADTKYIQEKDDDREKRNAIGTYEKSGLSQYTVRKEGVNYGTPETFPMNWEPRYAIAAGVGAAPDHIENYKVHKNGSRKVTRELNGEYYANEADSPGGFLINGTLPTSESVGVHSLTDVAVYAWGPCQEAFGGTYSNIDIFYKMAECLGLATKDGEGEGGCKAKGQGEPKPKPTPGQH

SEQ ID NO: 4870 - protein, 341 aa, Unknown
  Kingdom: Fungi, Phylum: Ascomycota
MGQTNNMGETEKINTNIVTLTRFLTEEQAKHKEATGDFTLLCHALQFSFKSIAYYIRRATLVNLTGLAGSSNVTGDDQKKLDVISNDLFIEAMRSSGRCALLVSEEEEEVIFFKDASGARYAVACDPIDGSSNLDAGVSVGTIFGIHKLPEGSTGTKEDILKPGTELLAAGFTMYGASTQLVLTMRGSTVNGFTLDNGVGEFILTHPDMRLPKSRAIYSVNEGNSLYWEKPTQDYFNSLKEAQADGKPYSARYIGSMVADAYRTLLYGGIFAYPADKKSPKGKLRILYECAPMAMVFENAGGQAVDSHMKRMLEVAPQSIHDRSGIFMGSYDEVEKVKKFF

SEQ ID NO: 4871 - protein, 963 aa, Unknown
  Kingdom: Fungi, Phylum: Ascomycota
MSVVHEQTVYVLAHYDHAAGAATICGVFAELQDANAECLQLARRAGITLTNESSTTGPDGMHLSPVEPLRWDAPEGVSCWVEAHALEEEAYFYECSVPELWGLITSVAAGGLGSPESCNNNRSKEASGAVPALVGSPPVVEAPPAQGTYPSDASDARCPGGIPPMRYKRQFHDGPGHPYGFPLLHIHTRSHPAPRARPRPHPPRRPLNAPDRSLSVMAEVDAAPTFGAELKDGFKPANAWVAHGISWLDDIQQFYRERSAIEKEYSAKLSALAKKYFEKKNKRSSPLSVGDTPAMTPGSLESASLTTWATQLTTLESRAAEHDRYGNNLISQVAEPLKYYGTRFEDLRKRHAEYADKLAAERDSSYADLRKVKAKYDATCQEVEAKRKKSESHYDKAKAQSAYQQQLFEMNNAKNSYLIAINVTNRQKEKYYHDYVPELMDSLQDLNEFRVMKLNGLWIVAARLEDDMLQQSHAMMEQLGHEVRRNEPHLDSMMYMRHNMGTFQEPPDKEFEASPVWHDDAAMVVDETAKIYLRNVLGKSKSQLSELRREVDKKRREVDNVKRLKQRVRDGQEKKDEVEVVRTLFAMQEDLHSVDRRRLTAEVETSAITSVVGDVTLGAKNHNFKSQTFKIPTNCDLCGERIWGLSAKGFDCRDCGYTCHSKCEMKVPADCPGEQTKEERKKLKAERQENTNKLLSPTGGPPPHVAELPGLTRSNTMNSLSSHSARRSVSGSLSGQRTPAEEAGAAAPEPAAPRPSVSSSTTGTTAVRKNRVIAPPPAAYISELPGSNVPNGGSKDEKKGKMLYTFEASGDGELTIQEGRDVVLMEPDDGSGWVKVRAGYKEGLVPATYVDFTSTPAPAASGPRPSSTYSNSTTSSTAQSGSAGAGAGAGAKKKGPAVAPKRGAKKLRYVEALYEYAAQSEAEHSMVEGERFVLVKDDPGDGWVEVEKAGVTASVPASYVQVV

SEQ ID NO: 4872 - protein, 574 aa, Unknown
  Kingdom: Fungi, Phylum: Ascomycota
MLTTRTLLPALAALLGFASAQVTTECNPMERDDCNPDPAFGTSKNFVFNSTQNGALWETVVGGINYDPENGAAFVLAKQGDSPTLRTNFYFFGGRTDVIMKAATGKGIVSSMMWLSDDLDEVDWEFIGINTTHASTNWFGKGVEDFHHAGWHPMSAPQEAFHNYSTVWSKDKLEWYIDGNLVRTLLPKDANNTRAYPQTPMRLSLGIWAGGDPRLPEGTREWAGGDTDYNNGPYTMYVKEVYVEDFSTGSKEYMFGDRSGSWDSIKVVEGNSSAYEVMNKQPEKTVAEKWDQDVPETAKIAVYAGGAGVGALLLGGLIFYCIRQRRRGASEAKAAEERALADKAEEARFRSQGIDPDGFKEQGYEYNAIEMRNGGNATADSYSVSTANEKDWATGGFGAAAAAGAGAGAGAAAAAATAAGGMRSPVPLLRDGSQSPRVGSPGPMSPYHDGPRSPSSPGASMNGGMGGPYRTQSPGMSRSQSPAIRTQSPALPPQGALPPIPQQYRASPGPQRMHSPAPMSPVRSFSDNQPIYGANRMQTASPMNPNRSFSSGQAPYRGPPPQNRDYWNGGGGQY

SEQ ID NO: 4873 - protein, 2280 aa, Unknown
  Kingdom: Fungi, Phylum: Ascomycota
MVKLSSWLALSLYGWSTAVAQKAVVTVAPDGSGDYTAIGSAISYAQANAIPTVTVLAGTYTETLAVATAAVTIVGQTSSSSSKRQNSDVSSANQVVITNGGNTVRPLTIPAGAKGITWKNLNFINSNTGSAGIVSLQGSGNAFYGCSFVGAGSIGFTGSLASGIIANSYIEAYDKPFASYSSLYVFGSTISVTNNNALLVYTKGYTVNGILYNSTTVLDNCQVVQKTGTTTQNVYLGYPNAPGAVALYRSTYLPSFINAGGAYPGSNSVNSVQYLEYGTSGPGSYGKNAAARAGLVTLVTNSNDLAAYDISKFFSTVYPSVSVANTNWIDSDRLLVLILVIVGFFVRVFVRVFIGVDLCGDLGVDLGVHFSVFLSVLLSVLLSVLLSVYFGHFLLSSFDLFDRLVKLRFVVFIRLVHLDQLFCGQHKLFCGQHKLFCAASVASNCLPSSVPSTAMIVGPSSNSCAQYNTISAAIAALPGGYSKQYIYILAGTYNEQPTVARVGPVIFLGQTDDATSSAANKVTIQNSSGRLSSSGSSSSTATFSASQYETQLTAFYNINFVNTFTAQTNYNALGVYAKGQKVAFYGCNIIGSQGTLYLDYGNIYFSGGRIEGTTDFIWGQGAGYFYNSVIVTDGTITGQSIAAQSYQAQYGKSQLVFDTCAVVPQSSSLPQKGTYLGRDYSANAQVAYVNSYMDAHIASAGWLLNNAGTFTGSFVEANNTGPGSSTSSRVSAAKILADSSAYTVKNILGDDSWLDAAAIAPFSGWPGSVYSVSTASTTTSSAATGTTSGTTSATSTSSAVGATLTVAPTPTAGQYGTIASAVAALPADGEDYTIYILAGTYEEQFSITRRGMVTLRGETSFENDFTGNKVLVQFSDGVSTSAGQNEQTPTINWKNTNGDGLALYNINFTNTFPQTFNYAALAADFFGTNMAAYGCAFKGFQDSLLVNQGVQVFSNSYIEGSVDFIWGYSKAYFHQCYVASNTAGACITAQNRPNSAWAGGFVFDKSLITYTSSYGSSTGTTYLGRPWSQYAVAVYMNSYLDQHIAPEGWDNWQDSDPRTSNVMFGEFNNTGPGNWSTARASFATSLTEAQASAYTLASFIGSTSWLDMTAYNLVPSYSLTGSSSGNPGTPGTGATWAHPTSGTEPPAGAVLVSVDGSIANSFTSLTSALASLPSDGSTQIIFMYPGTYNEQVPVINRNGPVMIIGYTQSDPGQSYSGNEVIITQSRGLSVSPLPVGHSNAETATIQTASNKIAMYNINIINSANLDGSQPSYVTLAASIYGNKIGFYGCSFIGWQDTLLTGATAGYQYYESSYIEGAIDFIWGYSKAYFKGCTIAAKRKSSAMTAHSRASSTAIGGYIFDQCLFTAAASATVDLTGGVYLGRPYSQYALVVVKNSYLDKVIQPAGWKVWSATDPRTSGVTFAEYNNVGPGNWENNAAARQAIGFATLLTSDSYPLSSVMAGTDWIDMTYWDNIETPQPSGGTPVTPGAGNYDGTKPPAGAYIVSKDAIEGQTTYSTIQAALNALPVVGKTTAIVFIYPGSYDEQLIISRPGTTIFLGYSSASHDYTQNQVTITHNVGVDTQAAASNSDSATVYATGNFFQAVNINFANTYGTAANYATLGFGVKSSKYASLYGCQVYGNQDALLISGYLFASNSYIEGNIDMIWGSGAGYFLNSTIATNRDGIDITASKRGTATTAAGFVFDQCTITAANGASYSSVSLGRPWNQYARVAYIKSYLGSMIKATGWDQWTKTDPRTDGVLFGEAANTGPGASTANRAPFATQLCPDQAAQFQLGTFFANTAWINTTFVYASPFVAASLPGTCSLTTSSTVSTASATSTTSTTSSSVPLPTVTVYTTKVSTLKETFLTTITAAPQTITVKSTATVDIATTITPDPVTVVSTQKSTTTVVQTIQDPNVLVTKTSTQTVDVGKTITPAPVTETSWQTIPSTTTQITNVAGKDTTTTTTESRTSYVTSTPKAVTSTTTIGSTVSVTKTSTPKVVTIKSTTTVTLGNGGVTTVTAKATTSFVTQFTTSTKVSKKTTTVTCTKGKKRGLPRMPAPTAPPSHDLEARQAPAVTAITVTVTVSSVLTATVKTSIITIPGTTETTELLATKTVGKISTLKAVTTTSTVLSMATKYQTTNLPGATSTSTVVELKTTGKTTTLKPSTVVVTSQTTSVKTVKSTVTVPGNTVVSTVTAVRTITNVLPQVTAFVTKSVDVTSIKTITLPANTVTNWATVKTTLKPSSTVTIQATVVKTTTVKMAAASSTWVTKTAKGARACPTE

SEQ ID NO: 4874 - protein, 515 aa, Unknown
  Kingdom: Fungi, Phylum: Ascomycota
MALLRAASLLLLAGSALGADLPSIQMKGSKFFFPNGTQFFFKGVAYQQDTGAAGTTSKNASIVDPLADETRCKQDVPLLAQLNTNIIRTYAIDPTADHSACMKLLNDAGIYVISDLGQPNLSINRDSPQWTVDLFTRYQQVVDALAKYPNVVGFFAGNEVSNSHNNTAASAYVKAAVRDTKQYIKNKKYRWMGVGYAANDDLAIRDDIASYFNCGPTDESIDYFGYNIYSWCGDSDFQKSGYDRLIDFFKDYSVPTFFAEYGCNLPNGGAGRVFDETTALYSANMSQVLSGGIVYEFFQDTNDYGLVKVGSDGSPSKQKDFSALQTKIRGAQPKGVSMSDYNPSNKAMSCPTVNSSWQASDTLPPTPDANVCSCMVKTCECVPADGLAATSYSDIFDFICGKDASLCSGIQGNATTGKYGVYSMCDSKDQLAYALNAYYNDQKKAKDACSFKGQAKTQTATKNSNCSALASSPGSNSTGSSGSKDNGAAGTRGGALTLGGLCSTVALVSAGMLLL

SEQ ID NO: 4875 - protein, 433 aa, Unknown
  Kingdom: Fungi, Phylum: Ascomycota
MHKLSLSAALAGLLGLANAFPNLPFTTDGPNIVDSNGKVVKVAGTNWPGHNDAMIPEGLQYKSVKDVVDDIKSLGMNVIRLTYAIEMIDQIYEGGGRDVTIETALSDALGETLGAQVLAEILERNPQFTSQTTRLEASCGFQPQCARAITCFLFVFDAVVDELNAQEIYVNLDNHISRGEWCCGGTDGNTWWGDQYFNADNWVRGLGYMAKHGTKWNNLMSMSLRNELRQPQNNSTLLATYNWQNWYPNMQRGARAVHDANPRPLVVLSGLNYDTTMQPIVRGYALDPGSQTFVPEEFAPGYADKLVIELHNYQNSISSCADLQGSLYNGGAQAMNPDDSSTKNVFPVLVTEFGFDQTDYQSVYSTCLASWLPGNTAGWMSWVIVGSYYMRQGTADYDETWGLYNHNWSAWRSEAYVKELLIPSIEQTLAGNS

SEQ ID NO: 4876 - protein, 477 aa, Unknown
  Kingdom: Fungi, Phylum: Ascomycota
MAILSIRGLLVGLQLLSVAASAAIDLTTRSIASDLQGLVGHSSVKIQVRERWNLVDAPEVLVAVSPVCESDIKAVIKYVVAKKLPLVPQNGGNGWAFFSQNGPAVLLNLAGLNQVSVSADKQTAVIGGGALVSDVVAAADAAGVLIMTANCNCLGALGAGLGGGFGNLVGEYGMAVDNIISLRVITPKGEAIDVSRTSNPDLFWAMRGAAANFGIVTYAKVKAVPTTDRTSWIFSMTFDGSRITEVAQAIQNMPLAPNQVVFFILANSGDANNTPTVLLTGFLRQGNETSGRKAFAPLFDLGPNTNSSAVTPYTGWNKANDFFCARGDRKPAYHTSLHSMTSPDWDAVWDLYADFQQKPTAQNTAVLVEVYNYEKAKSVGRGATAVSDELRFNSFAQAVVIPWYTDASLDDTAFAFASKVRDIWAYPYNAKTNNAYINFAHGDEELTAIYGSSLPRLQALKKKYDPGNLLVHWFSLA

SEQ ID NO: 4877 - protein, 464 aa, Unknown
  Kingdom: Fungi, Phylum: Ascomycota
MHIRGSSIYFTVVGLTSTTAVLAAVQPYGQCGGQGYTGETACADGWGCKQWNDYYSQCIEGVSDSAPSVAPVPSSNASVPEQTSAAPIATSAAAIPTSAAPVPSGNATSAIAVPTTFETLISSSSVAAVPDAVSSSVIVVSSTVAGPTASPTAGAGNSTGTFANGEDCSLDAVFKAKGKKYIGVATDQGRLTTGDNAAIIKADFGQVTPENSMKWDATEKSEGVWSLSGADYLVDWASTNDKLVRGHTTVWHSQLPTWVSSITDKTKLEEVMKAHINKLIGGYAGKVYAWDVVNEILAEDGTFRSSVFYNVLGEDFVRIAFETARAADPAAKLYINDYNLDSASYAKTRAMVSKVTEWVAAGIPIDGIGSQSHLANNWPIADFPGALKALCAVVDECAITELDIKGASAGDYETAVGACADVENCVGVTVWGVRDQDSWRPDGTPLLFDQGFQAKEAYNGLCGL

SEQ ID NO: 4878 - protein, 265 aa, Unknown
  Kingdom: Fungi, Phylum: Ascomycota
MGYEDSVYLAKLAEQAERYEEMVENMKAVASADQELSVEERNLLSVAYKNVIGARRASWRIVTSIEQKEESKGNETQVALIKEYRQKIEAELAKICEDILECLDGHLIPSAESGESKVFYHKMKGDYHRYLAEFAVGDKRKTSADKSLEAYKAATEVAAQNLAPTHPIRLGLALNFSVFYYEILNSPDQACQLAKQAFDDAIAELDTLSEESYKDSTLIMQLLRDNLTLWTSSEAEAPADAPAAEPASEAPKAEASAEAPAETKA

SEQ ID NO: 4879 - protein, 263 aa, Unknown
  Kingdom: Fungi, Phylum: Ascomycota
MATTQSAISKRRKFVADGVFYAELNEFFQRELAEEGYSGVEVRVTPTVTDIIIRATHTQEVLGEQGRRIRELTSLIQKRFKFPENSVSLYAAKVQNRGLSAVAQCESLRYKLLNGLAVRRACYGVLRFIMESGAKGCEVVVSGKLRAARAKSMKFTDGFMIHSGQPAKDFIDEATRHVLLRQGVLGIKVKIMRGSDPEGKAGPSKTLPDSVTVIEPKEEQPVVQPMSQDYGAKAIAAQQAADAARQAEQQQGEGEAAPAAEEQ

SEQ ID NO: 4880 - protein, 352 aa, Unknown
  Kingdom: Fungi, Phylum: Ascomycota
MKFQLSVAALAAIASAASVDVNKRDTPLSIKLESVGNSEVKIAVTNNGEKVLNLLSKGTFLDEVAPVEKVQVYSAAGSTKVPFEGIKLRLLTTGLAAEDFVALKAGETKEVTVEAASLHSLNDGGDFEVFASGLIPYAEENSTELSGTLPYDSEKLTITVDGAQAAQVTKAIDLSKRSSVRSSCTGSKLTAIRAALSNCNKLANSAASAASAGTKLSTYFKSTTASTKNSVSARLTAVARDCGSTTATTTTNCDDQYSGCSSNVLAYTVPSTSYITYCPIFFSDLPALSSTCHAQDQATTVLHEETHANSVYSPGTDDLGYGYSAASRLTTAQALNNADSYALYANAVYVNC

SEQ ID NO: 4881 - protein, 251 aa, Unknown
  Kingdom: Fungi, Phylum: Ascomycota
MKVQTILPFTALLGAAISAPTSVARQEGVSFPVTDVIDTGLSIEAYAQELEAGNVPEKTASAVSKRQFSGDTYNQLTDGTACRPVTVIYARGTTQEGNVGSPDSEGPTFFNALASRLGGAGRLAIQGVTYPANIFGFLAGGDANGATLMFDLINRCPSTKIVVSGYSQGAQLVHTATQRLSAAAAARVSAVVTFGDADRDESFGSVAASKTLIICHEGDNICENGIIITPQHRNYEIDAPAAAAFVASKVA

SEQ ID NO: 4882 - protein, 261 aa, Unknown
  Kingdom: Fungi, Phylum: Ascomycota
MIYLRQCLVAMASASTALATSSYSTLEVRNAGVPAGQLKNISGIEIYHSYPPNSNTSDKAIIHLTDIFGVPLLQNKLLADSIASNGYLVLVPDLFAGDPVGVEEQEAGLNLTEWRALHPQSAIEAVINNTIQYARNELGIEKLGGVGYCFGGKYVGRWLKGDDSGLDVGFVAHPSNLLETEIQAIAGPLSIAAGTLDASFNATAKSRAESILNANNITFQTNLYSQAPHGFAVRPNLTVPQQAYAKQASFVQAVTWFDAWL

SEQ ID NO: 4883 - protein, 628 aa, Unknown
  Kingdom: Fungi, Phylum: Ascomycota
MRGAPVHSREGFVQSPNVQAKPRTKFHEEPRPLRDFLRLKPGDCGSTLNGSLAAVPLPAPSGTWVAVPQTNKSNNAGQQRRDYRRVQTWHAQVSTVIMLAVLFSLSLFLLSIPVTAASTFEKRCLAFEPEKFVPGATRNVLEYVAANTTLTFPDINSTCNRGSQAVAANLCRIALSIETSRRSNITFEAWLPETWSGRFLATGNGGIDGCIKYEDLAYTSSNGFAAVGSNNGKNGTDGLPFFNNPETLIDFGWRSLHTSADAGKSLAKRFYGKSHSKSYYLGCSLGGRQGINSAEKFPSDFDGIVAGAPGLDFNNLVSWRASFFTVTGAVGSQNFIPATAWKTWIHDEVLRQCDTIDKAKDGIIEDPSLCKFDPSALLCTGNSTTKCLTDPQVQQLKTIFSDYKYPNGQLIYPAMQPGSEVLAADRLYAGAPFAYSADWFKYVVYNDPSWDPSQFDFDDARAAEKLNPGDIRTYPTSLRAFERRGGKLLTYHGQQDNQITTFNTIRWYNELQGRKSASAMDSWIRFFRVSGMNHCNSGPGAWVLGQGGNAAAAGVPFERQKNVLKAVVDWVERGVAPTYIEGTKFVNDTVSLGVDFTRRHCKYPLRNTFVGNDFKDPESWKCTEVAQS

SEQ ID NO: 4884 - protein, 562 aa, Unknown
  Kingdom: Fungi, Phylum: Ascomycota
MKLFQIAKLIWAMLLAKLIGAQGPNNKCHVLPGDAAWPSNEAWSTLNETVNGKLIKTVPIGSVCHDPTYDESACNALKAKWNDPLTHHSIMQAYFATQACDPFTDRSIPCTLGNYVAYSVKATEAWDVVAALEFAKISNVRVLARNTGHDFLGRSTGAGALAVWTQGLKNITFGQWSDKYYTGPSATVGAGVIGYELVEAANKQGLTVMSGECATVGLAGFTQGGGHSILSTEFGLAADQTLSYEVVTADGEVVVASATENSDLYWALSGGGPGTYGIVTSITVKAHGSKTVGGAAMQLLASSTTAENYALLTAKFIELLPAMIDAGAMVIFLISTQYIVIKPLTIWDSTQAKAKEVLKPFSDYLVSLGITPPIVYSELAYRDHYDRYLGPLPRGSFEVNRYQFGGRLIPRSVFEDNTAELNKVLSELTKDGVLLAGSSADYSKRANTPDNSVLPAWRDAITQLQLITNWNSTAPWTDMEAAQRKMTDVLMPKIEAVTPGSGAYMNEADFQQKNWQSTFYGSNYNKLKQIKKKYDPENIFYNLKSVGSEAWTVAKDGRMCRA

SEQ ID NO: 4885 - protein, 602 aa, Unknown
  Kingdom: Fungi, Phylum: Ascomycota
MMFNPFSLLSVAQLVLAECDPATTFDYVIVGGGTAGLVLANRLSANPRTTVAVIEAGDSAFNNPNVTYVPKSIAEFGLGLGTSVEWGYTTVPQRYSANGNVTLPYWAGKGVGGTSLVNGMTYVRAEKRQIDAWEDLGNEGWNWESLAKYYVAQEKFTKPSRQQENDGATFEDNVHGYDGELDVGFTPYLTGQGAFEILRDTNQVKGYAWNKDVNTGNMPGFDVWPLTMDASTTTREDAARAFYWPIAEKRPNLQIFLNTTASRIHWQDSAGESEKTASGVGVVRFDGTIRTLQATKEVIVSAGSIRSPAILELSGIGNPSVLSPLGIDTVVALPSVGSNLQDQPANTIIYSSPTNWTGYPTFASFLTASDLFGAALPSITSSIRSNISSYAQTILSDYAPNSTNLKAQEQLLQHQLDLVFFPNSTIPLAEILWFPTGPAIAAQFWNLLPFSRGEIHINSTNPLSQPSINPNFLQLPIDTIVQAAIAVRIREVFATPQLSDYVLAEQMPGFTAVPQNATFVDEAWATWIRGSFNGNSHPVTTCGMLAKELGGVVDIEGRVYGTRNVRVVDASIFPTQISGHLSASVYALAGKIADAMTGNDGE

SEQ ID NO: 4886 - protein, 522 aa, Unknown
  Kingdom: Fungi, Phylum: Ascomycota
MKASTPSVGGFLRLYITLVHVIRVSATPKDTCCKALERAGCAQVLYPDSELYRNRTSSYWSVSAQLSPSCIVQPISTEEVSKTVKALGADPGCEQKQFAIRSGGHTTWAGSNNIDGGVTIDLGLMNATSLDAQTKIASIQPGSRWNQVYATLDPLALTVAGGRAGSVGVAGFLTGGGNSFYTAQEGFACDNVKNFEVVLASGDVIDANADANSDLFQVLKGGSASNFGIVTKFDVQAFEAGDLWGGTMAYPKSVGQQHIEAYHAWTENVNNYPEGSSIIFWSYLPAMGDIVILAAYEDTAGNVAPPGFDQFMAIPDATASTMRIASHKELTDELEQPAGYRDVWFTMTFKNDVRIYQKIVELHEEFVNEWRSESPDPDFITQCMFQSIATSFSKHSVAKGGNVLGLEKETDSSVMLLYNIAVKTPELEVLAREKLRASGEAMKAYATSLDGLVSWTYLNYADGYQDPLSSYGTENVAKIRAAAAEYDPKEFFQTRVPGGFKISGVREAAVSLGPHHMTALQA

SEQ ID NO: 4887 - protein, 640 aa, Unknown
  Kingdom: Fungi, Phylum: Ascomycota
MLAMAKRSLVPWTIVLSATSALAHPLFNGRLVSRTDDLLSEYDYVIVGAGASGLTVANRLSEQPEVSVLVIEAGELDQNEDFVTIPGLAGGAVGTKYDWNTTYSASEYLGGRNISVAQGKVVGGSTKLNRMVFDRGAKSDYDGWEALGNEGWNWESLLPYFKKNEIFSPPVEDIREEYNITWDDDAHGFEGYMHSTYSPFFWPTTKNLVEATRSLNIPIPEDQASGNAIGGYFTPHNMDPTEYRRSSADEAYYDTAATRENFHLITGHQATRILTCGNGTLRATGIEFAASSNATVQSVKAKREVIAAAGSLHTPQLLQVSGIGDPALLSSIDVPTVVDLPAVGQSLHDHVYVMVVNACKRSTPSADDGRKLTKAQVNTTLTQSSELTSNTTFAAEARAQYDTEKRGPLTSPTGDFLLFLPLSTYSNASASIHAAALSSNASLSLPSDAPAEVAAGYSASYASLNAKLRASDAASLEVIWADGVMFLGLQHPYSRGSVKAASSSIFDAPIADAGFLRNPLDTVLLREAIRFSRRLVAQPSIAALNPFEAVPGANVTSDADLDQYIKNSASTLWHPAGSCKLGKREEGGVVDAELKVYGIEGLRVVDASVFPILPATHTMTTVYAVAEKAADLIKAVDGRY

SEQ ID NO: 4888 - protein, 504 aa, Unknown
  Kingdom: Fungi, Phylum: Ascomycota
MPTISKLSAPRALSFSSVFLAFVAGAAAQDATVLRTCLTEKNLQLTVPEDPTWETVTAPWSLRYNPEPAAVVVPNTSEDIAAALACAVESESRVAALNGGHSYGAYGLGGTYNGALIINMVNFDQTSYDEGTQLLTYGGGSRVGPTVTWLWENHARHFPHVRANSVGLAGSSIGGAFGTTSRLLGTPMDYLVSVEYMLYNGTTVTASREENPDLFWVAQGAGSSYGILLSLTTKTWKPEHERVTNFTLSLPADTTINTGVEALLAIQGYAQTDAPDTLALRWELATPWAGSGYFYGNPDEFNSTIAPLVERLPNITVRSSTFDFWTMENLITPSLNTTVGTFPPRNMYLQALVLRADQPFTYESAHALYEHTTFAFNRTDMTKFGFIDLWGGSAARAIRDTDTSYEHADSQWLIRWEGRLAPGLSQWPADGIEYMQNGFQPFKDQLAKEGVPLRGFVNYRDTALVEEEWSQRLYGANYERMKQIKTDVDPRNVFSTNDQSISSS

SEQ ID NO: 4889 - protein, 658 aa, Unknown
  Kingdom: Fungi, Phylum: Ascomycota
MKSTASIGAAAALFAGAVSAQSFRRLGACPTLGCVFPPDQADFLAGQYFDIRLEVHQPTNGSEAIGLPLDDKFTFTITKDGETAPVTEYFKLEEPKLEKWNFTWYEDFFARDAKNASFVNVASKAYRRVALYEPGEYTATLNYNNGSKTEATWLVRDLAEERKTKNIILFIGDGMTTNMITAARLIGHKSINGKYQTTMAMDKFPVLGHQMTHSIDSFITDSANSAAALNTGHKSTVNCLNVYADSSKNVFDDPKVETIAEMFHRLTGGHIGIVSTAYIADATPAALVSHTRDRGQYGAIVDTYLNGVQNYTWTNVPIDVIFGGGAEQFYPSALGGKTYQDKDYYEEFAKKDYQIIQNRTALLSANNNDKALGIFTTSNMAKWLDRNVYRQNLNQSLSPTGDKSAALDQPGLKEMTLKAIDILQARSGDEGWLLMSEAASIDKMMHALDYDRALGELLELDDTIKATIAKLNSTDCLKDTLILVTADHGHGFDVMGSVDTHYLAAQNTDRKRRSAIGVYEQSGLSQYANTGNLTYTDSNFPSTWDPRYTLFQGLMADPDRREDWQVRKSGPRSPAKEIEEDSDDNYVNSKEPSGITLNGTLPIENDQGVHSLTDVPVFAMGPCQELFGGVYNSIDIFYGMAECFGLAKGSPSANSTKY

SEQ ID NO: 4890 - protein, 430 aa, Unknown
  Kingdom: Fungi, Phylum: Ascomycota
MLSSALFTLAAANVANAAYSFDPLNHLAGIAPYFEDPQSDPAPPQGCNVTRAAYLVRHAAIWANDFDYEEYIEPFTDKLENTSANWKSAGALSFLRNWQTPISEEELEDLTTVGRLESYKLGTEVHLRYPGLKKPNKVWTSTAERTELSTKSFIEGLVTQSNETEQVSVSEDQSEGADSLTPYKGCPKYSSSFGSDQSTQFQEVYTAPIIERFRDLAPNFNWTANDITAMQQLCGYETVIRGSSPFCSLELFSADEWLQFEYMNDIQYFYNAGYGNEISGVIGFPWLNATAQQLLAGNSTQDLYVSFTHRELPPTVAVALGIFNNTEYAGSANVNASMPLTKQNYQRVWKSSRILPFLTNIAIERMECDSYGFPAGTYMRVLVNQDPQQLECAVGPGDSCSEGSFTEFVQQRGEMFGGYTEKYQWIGMIP

SEQ ID NO: 4891 - protein, 457 aa, Unknown
  Kingdom: Fungi, Phylum: Ascomycota
MLRSLAFVGLLAASAVAQKCSATQKCPQEAPCCGQYGDCGVGAFCLGGCDPRMSFSLDACMPHPVCQDRTTKFDNLDRVQDISKFLGDPKTADWVAQGEPVINDGSLLLTMPKGSVGTVISTTDYMWYGNVKARMKTSRGRGVVTAFILFSDVKDEIDYEWVGVDLNTAQTNFYFQGITNYTNSANVTDLTDTFQNWHDYEIQWTPDQIDWIVDGKTERTVQRKYTFNSTSNQFEFPQTPSRVQLSLWPGGLASNAKGTIDWAGGEIDWDATDIKNNGFFYASIDSVEVQCYQTKTPPGTNSGKSYSYDGMAGTNDTVVDGDKDTVLASFLASGLDPDAGKQSSDKSSSSKTGDAQAPKNTAAQIPGGGNGAAGQDHSDESGSSNGGGSGSGGDNGGGNAPAATGSCDVSSFHSNCDGDGSSSDSQNSKDGGGEGSASRSGASALAVIIAACALFWL

SEQ ID NO: 4892 - protein, 404 aa, Unknown
  Kingdom: Fungi, Phylum: Ascomycota
MRVSAALSIAATLGSTAAQGTILGFNSGASDDQGNAKNQQDFEREFRTAKNLNGAPGEFNTIRLYSNIQWNTPSTPIAAFPAAIATNTSLLLGIWASGTDNIDNELNALTAALEEHGSQLADLVVGISVGSEDLYRVSEPGLRNNAGVGQDADTIVRFIKDAKTRLANTALKDKPFTHVDTWTAWVNGSNKAVIDEIDFLAVNAFPFYEAERDNQISGAGALLNSAITATEGVANGKDVWITETGWAYTGPSFGAAEATVDNAGEYWQDVGCKLFGKRNVFWYTLRDANPDNEVKFAVTDNLSTTPRYNLTCPAESEDELPTPAPITNNSTTSTGNGTGSSNSTNSNPSGSPSGSSSGSATGSPSPSGTGITESTGAGSMTSISLVNSMAMALSVVFAAAAWAL

SEQ ID NO: 4893 - protein, 334 aa, Unknown
  Kingdom: Fungi, Phylum: Ascomycota
MTDAPPLTPPACPSNTALSSHTYTHDFITSGLDTSSWNITSGNVTATSSGLAFTITQSGDAPTIRSNWYIFFGRVSFLLRAAPGTGIVSSAILQSDDLDEIDWEWLGGASYVNKAQSNYFGKGNTTSYDRAVWTDVSGTQSTTHNYTIVWTAAATTWYIDGVAVRTLHFADAVGGKNYPQTPMDIRIGIWAGGDAANEQGTIEWAGGETDYSTGPFTMFLESVEVVNENPGGNYKYGDRTGDWTSIEVNGAEEGGNGGSSSSSSESSSAVESGAATGAPSASTTQTTSSNSSPSPSTEYAQAVWGGASSVYLTIWQSGIICMIFLVHMIHEIMT

SEQ ID NO: 4894 - protein, 469 aa, Unknown
  Kingdom: Fungi, Phylum: Ascomycota
MKYSAFLVAHAVSSAAALQLAPRANPRVVGLDIQRRNVPDPIAHDQLRRRQNTVQQTLDNLETLYFANATLGTPEQSFRLHIDTGSSDLWVNSANSRLCTEQGNQCGDSGIYNANDSSTYQFVNNAFNISYVDGSGASGDYATDTFRFGGKTITDMQFGIGYTSTSPEGILGIGYTINEVQVNRFGLDEYPNLPQKLKDDGTINANAYSLWLNDLDASTGSILFGGVDTSKFSGTLATLPIIPEQGVYAEFIIALTDMGINGNKTSVFSDSNVAVLLDSGSSLMYLPNEVASALYSQFDARYDSRQGAAFVDCNLANQQGSLEFGFSGITISVPYNELVITAAVSRGVPICILGIGPAGNGVSVLGDTFLRSAYVVYDLENNQISLAQTNFNATDSSVQEITSGSDGVPGASVVPNAVSTAAVGTGGPRVNGPTITGTLTSTAGAYAMATAAPWLAAAGAGVLMGFNGF

SEQ ID NO: 4895 - protein, 225 aa, Unknown
  Kingdom: Fungi, Phylum: Ascomycota
MKFLSIVTLAASIVSAAPAVDVETRSIEARQSSSRTDLERGSSSNCPSVILIFARASGESGNMGGSAGPNVASGLDSRFRNDLWVQGVGGPYDASLSANFLPAGTSREAIDEAKRMFQMANDKCPNARVVAGGYSQGTAVMSNAISEVSSTIQNQIKGVVLFGYTKNQQNNGGIPNFPAAKTQVYCNTGDAVCRGSLYIAPSHFAYTTDSRVNAPRWLADKINSS

SEQ ID NO: 4896 - protein, 180 aa, Unknown
  Kingdom: Fungi, Phylum: Ascomycota
MKASTFAPLLSLLLPTNAQEHGLPTLDFLYTVNATLGTRWPIGDMGFGTRVVIPITGGTFKGPKLSGTVQDLGADWGVTDTKGVFFPDTRYNLRTDDGADIYIQTSGPTQEDGRTLLRGKFETGDERYYWLNYVMAMGVLSRPTGENTGNYVTIDMWQMLLPEAQPPKCKRDAGEAAEEH

SEQ ID NO: 4897 - protein, 946 aa, Unknown
  Kingdom: Fungi, Phylum: Ascomycota
MKFQLSVAALAAVASAASVDVNKRVTPLSIKLESVGNSEVKIAVTNNGEKALNLLSKGTFLDEVAPVEKVQVYSAAGSTKVPFEGIKLRLLTSGLAAEDFVALKAGETKEVTVEAAALHSLNEGGDFEVFASGLIPYAEENSTELSGTLPYDSEKLTITVDGAQAAQVTKALDLSKRTSVRSSCTGSKLSAVRTALSNCNRLATSAASAASAGTKLSTYFKSTASSTKNTVSARLTAVARDCGSTSSTTTTNCDDQYSGCSSNVLAYTVPSTSYITYCPIFFSELPALASTCHAQDQATTVLHEETHANSVYSPGTDDLGYGYSAASRLTTQQALNNADSWSWAYRRFKLMELMVVIIKMMAIPVDTFSSDEYMLDDFPDQMCTCMQDTSVGQASRANESLKWLLRLAWLQHNDDLWTPDAASDINARTHQSMHCDAEMSTRKDNYTAGIALLDLNTNCNSSTTARELQSHTSLKAKLQGFPWRVFLITLLLPLSLAPIIILSAIAEMASQNYIRGRSCYPNGLWKEAAGATWRIMDSTYFFTPNLSFGNMTFTQVKVIDIAWDLLVGRGGQMGLAWVNWVVFNEWLVFHLERWGTSYKMYATVALQTTSWTMLGVVAKEFLCFGEKSWARFFRWLAMFSMLVSTLYVLAFPTLMAAMTGYITTYEPYVEDRDQDLKEWSKVDEIVRTISSGGLGLGFEQGALYVTAKDEELVRTVDDFISKYASANKTLTYTWTGTQAIEYIGDDGSGIKQKIYYIDSGVNWEFENAIWTTNETVIIEVPEFTSKPLRDLVAPQEQYYSIGGRYGDQYNSSWIRSHSSCKPSETYQWGFSYIFLFMVAIFNFLWSFIMIAMWLDTRRGSRMYRSGRRPGLLRSVLDLAAAVREELGSDAEILGEVELRERLTASGSMLEVPKGELRIRRVETEDMDRWRTGQRSWTGNLTRGSTF

SEQ ID NO: 4898 - protein, 518 aa, Unknown
  Kingdom: Fungi, Phylum: Ascomycota
MGSNKEEINVDVLVIGAGPTGLGAAKRLNQIDGPSWMIVDSNPIPGGLASTDTTPEGFLYDVGGHVIFSHYKYFDDVIDEALPKEDDWFTHQRISYVRCKQQWVPYPFQNNLSMLNKDDQAKCVDGLIDAALEARVANTKPKDFDEWILRQMGVGIADLFMRPYNYKVWAVPTTKMQCAWLGERVAAPNVKGVINNIIHNKTAGNWGPNATFKFPARDGTGGIWIAVANTLPKEKTSYGENSTVTKVDADGKKVTLKDGRTIKYEKLINTMAVDQLVDAMGDKELQTLSKDLFYSSTHVIGVGLRGERPERIGDKCWLYFPEDDCPFYRATIFSNYSPYNQPQKDVKLATQQLANGSKPKSTEPQEGPYWSIMLEVSESSMKPVDQENMLKNCIQGLINTEMIKPEDEIVSTYHRRFDHGYPTPSLEREGVLTKLLPALQDKGIYSRGRFGSWRYEVGNQDHSFMLGVEAVDAIVNGAVELTLNYPDFVNGRKNEERRLQDGAQIFKKVGQNYLNKQE

SEQ ID NO: 4899 - protein, 195 aa, Unknown
  Kingdom: Fungi, Phylum: Ascomycota
MKFTTAAIAASAAALVTASPCASATSAEIKTGDVFRIMTIRSGSDIQYGQLQAANGAFYVNTPSQNASCTPEANYASFRLTDAGELFLNTENPPQQAYVDRSGMGQGVFQYTTGVQGAGRNSERTGFTLDENSNLIFKDQTSQEIGFQACPNALQGGYSVWLDITKNPGGNSDCVGFVARALKEDKPVSCMYTSN

SEQ ID NO: 4900 - protein, 197 aa, Unknown
  Kingdom: Fungi, Phylum: Ascomycota
MADQHDDLHAEQTEGFKVGEKKTLDEYQNLDKDDEALNKWKASLGLGQGKDISDPNDPRKCIIYSLGLEVDGRPDIIIDLKSPGALEALEKKPFTIKEGATFRMKAQFKVQHEILAGLKYLQKVTRMGVSNKMQEMMGSYGPSTEEKPFYEKKFEPETAPSGMLGRGHYTAVSKFVDDDNQTHLQFTWSFDIKKDWA

SEQ ID NO: 4901 - protein, 343 aa, Unknown
  Kingdom: Fungi, Phylum: Ascomycota
MSFIRQTLAIGALSALAAAQTTAPKLDATCADVVIFMARGNDAPYNDGRTSPLRDTTCAKLTAQGKTCDYIEIQYDVTLGADYCTQVAEGARNGISQITAFNQKCPCSHIVVNGYSEGAHVVGDVLGGPGGCTKVSSGIDNTSSAGKAIAAALLWGNVMHTANQPYNVLDGADKQANPRSAADLALLNRYAPVLRDYCAAGDPVCAGGSVVADHLNYFELYTDEASSWIVSKIDGTAPLCAAPSSSSSSAVVPATSSTAAPSSATPSASKEATPSASSTGSPSVVYPTGGHPTAVYPTGSAPTTMVTYTATYPTSAATPSPFPEPSQYEEACVVVYDVEYIYA

SEQ ID NO: 4902 - protein, 434 aa, Unknown
  Kingdom: Fungi, Phylum: Ascomycota
MHIRGSSIYFTVVGLTSTTGVLAAVQPWGQCGGMGFTGETACAQGWGCKEFNPYYSQCIEGAGNAAPSAPAQTPVPTSAAPVPSLNATTAIAAIPTTLATKIASSAKVQDASSVVVVSTSAAAPTAAADLTHGESCSLNAVFKAKGKKYIGVAADQGTLSNANTAAIIKSDFGQVTPENSMKWDATESTQGKFTFTGSDYLVNFASTNGKLIRGHTTVWHSQLPTWVSSITDKTKLTSVMKAHINGVIGHYKGKIYAWDVVNEIFSEDGNFRSSVFYNVLGEDFVRIAFETARAADPAAKLYINDYNLDSASYAKTKGMVSHVSKWVAAGIPIDGIGSQSHLSNNWPISDYPGALKSLCGVVSECAITELDIKGAAASDYQTAIGACADIKNCVGVTVWGVSDKDSWIQGSNPLLFDGSFKAKAAYNGLCKALA

SEQ ID NO: 4903 - protein, 229 aa, Unknown
  Kingdom: Fungi, Phylum: Ascomycota
MKTSLVLLAAVASVSAHSTWQQLWVGSTDQAGKCVRTVKDNSPIDSLSSADMFCGRGPAKSSGVCEVAAGSSLTVEMHAQPGDRSCSNPAIGGAHYGPVLVYMAKVSDATTATTGSFFKVAEDGYKGTTPTWGTEILNANCGKRAFTVPKSLAAGQYLVRAEVLALHAGAGQPQPYVSCFQVKVTGGGSANPTGVSFPGAYKLSDPIFSKAIYDSSFQYVSPGPAVYSG

SEQ ID NO: 4904 - protein, 451 aa, Unknown
  Kingdom: Fungi, Phylum: Ascomycota
MASFQRLTVGRNSVYKANGTKSYLHAMRKYGFHPTKPGPYFQAKVFRPQGKFGRVGGRMRAHYVLQKRTPASGDYGAQSKAAAPDDGTTAGEVPAEDIQNDSLYLCEVSIGTPAQKLYLDFDTGSSDLWVWSTELPKSILSKANAANQQVAFDPNKSSTFNKLSGETWKISYGDGSAASGDVGTDVLDLGGLKVENQAVELAKTLSQQFEEGNGSGLLGLAFSSINTVTPDQQKTPVDNIIAQKSAKEQLFTAYLGSWRDADEADKGESFYTFGFIDQDILTTTGASEPNYADVDNSQGFWQIQSASASINGQNITRSGNTSIMDTGTTLCLVDDSLVEAVYNAIPGSQYDQNSQGYVFPSSTAADDLPDVQLAIGDSMVAFQKEDLGFADAGNGMVYGSIQSRGSMDMDIYGDAVLKAMYAIFDMNNGTPRFGWVQRTESNQNTAAPPSQ

SEQ ID NO: 4905 - protein, 325 aa, Unknown
  Kingdom: Fungi, Phylum: Ascomycota
MVKPVTFVLSLAVPALAAPTCTWTSWKAVKNMFIFGDSYTQTGFDINSTQPHPANPFGNPPFPGYTSSNGPNWIDFLATTYNASFIRAYNLAYGGATVDSALVTPYAPTVLSLVDQVQGEFLPRYGSHPADAPWTGKDSLFAFFIGINDVGNSWWLNNSTLYDAIFARYAGLLDQVYGAGARNFLFLAVPPVNLAPLTLGKDDGGYSVQAEGKVILDWNSRLTALTKAFKKSHGDVQVFVHDTYKVFDEVIKNPKAYPQTSGYKNVTGYCAAYENGTPTWYTKDPSCQYAVNEYLWLNSLHPTFPMHNATAASVAQFLGKQKCSK

SEQ ID NO: 4906 - protein, 615 aa, Unknown
  Kingdom: Fungi, Phylum: Ascomycota
MAPSLKSLVTFAATLPLVVAVPAVRRDDVSSIKDKTYDYVIVGGGLTGLVVANRLSEDKSRSVLVLETGSITEDINTIIPTLGNNINHAKQYSVDSAPDKELENMSFGVLVGKVVGGGSVINGMAFDRASAADYNAWEQLGNPGWGFNGLLPYFKKSTTFTPPTLTGPEFNITYDASYYGTNGPLQASFPNFEFPDVKTIWEAYRSEGYTSPREHAAGEAVGMLWVPTSLNPETQTRSDARRTYYDSVKSRGNLKLITGVSATEVLFDNLTAKGVSFTNLADNTASKVYAKCEVIMAAGSVFTPHILQLSGVGPADVLKAAGIKVKKDLAAVGANLQDHPNANMMFSTSNLSIPNPLFATDPEQNATAWAEYYANRTGPVCQSHGSSLAFLPLQNITSNWRSIVSTIKGQKTSDYLPAAYKNNANLLRGFEAAKQITAELLSSTKAAAAEFPMNAFGLAIAAIQRPLSRGSVTLDPKNPNGNPVVRFNTFQNPADRTMLLEAVKWTRRHWQSPVLQRFSPVEVTPGAAAQTDDEIIHELLAQDALTGTFAHQSGTCSMLPEKYGGCVSSDLRVYGTNKLSIVDASIIPLIPATHLQATMYAVAEKAADLIKGRNK

SEQ ID NO: 4907 - protein, 576 aa, Unknown
  Kingdom: Fungi, Phylum: Ascomycota
MLAKLTTALLLAKLIAAQPGPPSPPGQPSPRGANDNCHVLPGDAAWPKNDAWAKLNSTVSGKLVKTVPIGSPCHDPTYDETACNALKAQWTNPLTHTPSGHSIMQAYFATQECDPFGDRAKPCKLGNYVAYSVKATDAGDVVAALEFAKAKNIRVLARNTGHDFLGRSTGAGALAVWTQGLKNISFGQWSDNYYTGPSATVGAGVIGYELVQAAAKEGMTVMSGECATVGLAGGFTQGGGHSILSSAFGLAADQVLSYEVVTAAGKVLTASPTKNSDLYWALSGGGGGTYGIVTSITVKAHQSKTVGGAAMQLLASSTTPENYAALTAKFMELLPAMIDAGAMVVFLISTQYIVIKPLTLWDSTEAKAREVLKPWSDYLVSLGITPPIAYSELPYYDHYDRYLGPLPKGSFEVNRYQFGGRLIPRDVVENNTAELNKVFAELAKEGVLLAGSSADYSKRANTPDNSVLPAWRGAITQLQLITNWNSTAPWVDMEAAQKKMTEVLMPKIEAVTPGSGSYMNEADFQQPNWQDTFYGSNYAKLKSIKDKYDPDHVFYNLKSVGSDAWTVGPDGRMCRA

SEQ ID NO: 4908 - protein, 606 aa, Unknown
  Kingdom: Fungi, Phylum: Ascomycota
MLNMHVALPALLLAPAASAVSQRVGNSWTHSPRYDYIVVGGGTSGLVVANRLSEDYNVSVAVIEAGGVELYDKNITETSKYMASFGTAVDWQYESVPQTYAGNATQVLRAGKALGGTSDINGTSTDFIQVMHKAAQIDAWGQIGNSGWSWESLMPYYKKSEYIQEPSESQLLRGASLDPETHGTSGPLAVGWTDDMMSEKVFSSINRTFEALGLPLNEEPNAGSMRGLTVFPKTIERADNVREDAGRAYYWPVSNRPNLDIHLESFVEKMIWHPESGKQNNGRAASGVVVVGRNGTRHTILANREIILSAGSLRSPLILEQSGVGNPSILKEHDIGVVVDLPFVGENLQDQTTTDMFFVNKNSTNFTGLGGYAAYFNVEDAFGDNLASFNASIANSIADYAEKTAKASGVIDRNVTERLFRMQYDLIFKNKIPVSEIIVSPAATGPITIEYWGLLPFSRGSVHINSSNASAPAAINPNYFMLDYDIHQQIATAKMARKVANTAPFSEALSGETTPGLNLLPANASDAEWEKWLKSTYRSNFHYISTAAMMPRELGGVVDSNLTVYGTSNVRVVDASVVPFQICGHLTSTLYGIAEKAADMIKARYE

SEQ ID NO: 4909 - protein, 493 aa, Unknown
  Kingdom: Fungi, Phylum: Ascomycota
MESDSLPTGSRRNGYGRYENFIKSWSGLAAGMSTFAIKAPTVARDLAALVSLSSSVSIELQPRWSDFNTPNPSVVVNVTSEKDVAAVIKYCTKANIPFLAQNGGVGWAKTFHLGSTSVLINLAGLNTVTVAADKKTAAIGGGASIGDTVAAADAAGALVLTGNCNCVGSLSAYLGGGYGNLLGEIGFGVDNIISMRVVTSSGSILTVNRSSNPDLFWALRGAGPNFGIVVSATVTALPATAQDRTAWINNLFFAPDKLPRIAQAIEDLPLAPEQRVYLVLTNSGPPENAPSVLVTGFLRKGTETSGRAAFKALYDLGPVSESSVIAPYANWNDANIGFCARGERKPAFSTTITGMQPDTWPQVWELYKKFQAKGPNSAVLVERYNLTKAQSLPGSHVSFNPALREGAFAQAIVIPWYSDAALDDEALQFGRSVRDIWSGDEDATQNPTYANFAHGDESLEAIYGDSLPRLRELKRKWDPEGIFGQWFAITEAR

SEQ ID NO: 4910 - protein, 609 aa, Unknown
  Kingdom: Fungi, Phylum: Ascomycota
MAPSSASAIAFAVCAVSLGAAAQSGVLNNTVVNATYDYVVIGGGTAGLTIASRLAAYASVGVIEAGGLYEQDNGNQSIVPYYGLVMPVLGTTEGYPKNSLVDWDLLSTPQASAGGRRIHYAQGKTLGGSSALNTMAYHRGTTGAYRRWADMVGDQSYTFDRLLPYFKRTATVTPPNLEKRKAPNATVLYDAGAFDNRFGGPLQVSWANWVDPTQSWLARALQAIGQQLSQSGLSSGIVNGGAWVPTTIDPKDATRSTSKSSYLKATIRDPRSRLTIHLHSQASKILFDSNKKATGVTIISGGKSLLVTARKEIILSAGVFHSPQLLQLSGIGPAAMLRSQSIAVVSDLAAVGQNLQDQIFFNVLRGITIPNTGTYIATPDQQAFAVQRYVSNAAGPYSSAGGYLSFEKLPAASRRTLSARTSGLLAGYPSDWPEIEYIASGFPGGFLNLTTVGAISGTLLTPTSRGNVSINSASVKSAPVINLNWLSDPADGETLVAAFKRVRQAWNSSAIAGIVTGPEITPGDAVATDEQILNFIRTAAQPIWHASSTCAMGKGGDKNAVVDAKARVFGVKGVRVVDASAIPFSLPGHPQSTVYALAEKIADDILRTR

SEQ ID NO: 4911 - protein, 600 aa, Unknown
  Kingdom: Fungi, Phylum: Ascomycota
MLLNPLAFLSTAQLALATCDPSVTFDYVIVGGGPAGLVLANRLSANSSVTVAVIEAGDSAFNNPNVTYVPKSISEYGLGLGTSVEWGYHTVPQKYATNGNLTLNYWAGKGVGGSTLINGMTYVRAEKSQIDAWEDLGNEGWNWESLKEYYVQQESFLRPSEEQAANGATYEESAHGYEGELDVAFTPYLTGQGAFEMLRDAHEAKGYIWNKDVNTGSMPGFDVWPMTLNASTVTREDAGRAFYYPIAASRPNLHVFLNTTASRILWTDDDDASDKTASGIQVVRSDGTIRSLSATREVILAAGSIRSPALLELSGIGNPSILSPLGIDTVVDLPSVGTLQDQPANGIVYSSPTNWTGYSTFATFMTASDLFGASLPTLHAEISRNLSTYAATILSDQPPNSSTLSAQEAVLQQHLDLVFTSTSTVPLAEILWVGLGNLLVAQYWNLLPFSTGSVHINSTHPLSAPRIDPAFLQLGIDARVLAATAVKIRELFSTPPLSQHVRAEVTPGFATVLRNATAGDAAWEAWIRGNFNGNSHPVSTCAMRAREFGGVVDSEGRVYGTCNVRVADASVFPTQVSGHLSASVYAVAEKIADAILKGEK

SEQ ID NO: 4912 - protein, 658 aa, Unknown
  Kingdom: Fungi, Phylum: Ascomycota
MKSTTTIGAAAALLAGTVSAQSFRRLGACPTLGCVFPPDQADFLAGQYFDIRLEVHQPTNGSEAIGLPLDEKFTFSITKNGKTAPVTDYFKIQEPKLEKWNFTWYEDLFARDANKPSFVNVASKAYRRVALYEPGEYTATLSYNNGSKTEATWLVRDLAEERKTKNIILFIGDGMTTNMITAARLIGHKSVNGKYQTTMAMDKFPVLGHQMTHSIDSFITDSANSAAALNTGHKSTVNCLNVYADSSKNAFDDPKVETIAEMFHRLTGGHIGIVSTAYIADATPAALVSHTRNRGEYGAIVDTYLNGVQNYTWTNVPVDVIFGGGAEQFYPPSLGGVTYQGKDYYQEFAKKDYQIIQNRTALLSAKNTEKALGIFTTSNMAKWLDRNVYRQNLNQSLSPTGDKKPALDQPGLKEMTLKAIDILEARSGDKGWFLMSEAASIDKMMHVLDYDRALGELLELDDTIKATLAKLNSTNCLKETLVLVTADHGHGFDVMGSVDTHYLAAQNTDRKRREAVGVYERSGLSQYANTGNLTYTDSNFPSTWDPRYTLFQGLMADPDRRENWSVRKSGPRVPATEQVKGDDDFYVNPKEPVGITLNGTLPVENDQGVHSLTDVPVFAMGPCQELFGGVYNSIDIFYGMAECFGLAKGSPSANSTKY

SEQ ID NO: 4913 - protein, 438 aa, Unknown
  Kingdom: Fungi, Phylum: Ascomycota
MRTSALLTVAAASAVNAKYTFDPLDHLAGIAPYFEDPQSDPAPPQGCNVTRAAYLVRHAAIYANDFDYEEYIEPFTDKLGNMSVNWKEAGPLDFLQKWQTPISDEELEDLTTVGRLESYKLGTEVHMRYPGFKAPKKVWTSTAERTELSSKSFIEGLVMQSNETERVTVSEDDSEGADSLTPYKGCPKYSSSFGSKQSGEFQKVYTAPIIERFRAYAPSFNWTANDITAMQQLCGYETVIRGSSPFCDLDLFSPDEWLQFEYMNDIQYFYNTGYGNEISGVLGFPWLNATAQQLLASNSSQDLYISFTHRELPPTVAVALGIFNNTQWAAGNINDTMPLNKINYQRAWRSSRILPFLTNIAIERLECDSYGYPEGTYVRVLVNQDPQQLECAVGPGDSCSEGSFAEFIQQRGEMFGGYTEKCAPTEYNNSTDVLTIYN

SEQ ID NO: 4914 - protein, 561 aa, Unknown
  Kingdom: Fungi, Phylum: Ascomycota
MKPCSKMLFRSAAHAAAVLAFTTLVEAAPTTTIQASSNAGSPASDVYPPSGTVVNSSLFPPESVVGFPGPTPTGVEPNAIQTAPSYPYNQDEAKSFPLIASQPRGNNEQSKFDITRYWGNLSPWYSLRSADYGLPDASPLVPGGCDVTQMLLLYRHGARYPTSGAAPGTFAQKVANATKAGGLAFLGELFFLSDWTYKLGAELLTPFGRSQNFMLGVEYRQLYGHLLNNFTASGKLPVFRTQSQDRMVKTAENFAAGFFGVPEYMSEVNIEILVENPGVNNSGAPYEVCLNSNVASKGSIGSTVAAKFAVNAFNSTIARLQSQAKGINFTSTDAIAMLQLCSYETHALGYSAFCDLFSEEDFLNYEYYYDLSFYYNNGPGSPVAAAQGKGYLDEYIGRFTGTYPAAQSALNETFDNSSTYFPLSQSIYADATHEVVVLDVLTAFNLTALFDGPPLSPTGNRHENSFVASRLVPFATHFTTQVLECPAKSPSKQLRFIVNDAVIPINGSHAGCPADKDGLCSFDNVVSVLKKRSAEIDYAYDCLGNYTASPGMNYNGRAPRS

SEQ ID NO: 4915 - protein, 494 aa, Unknown
  Kingdom: Fungi, Phylum: Ascomycota
MMARAWNRVRGNRSHEYTPLPLSEKESYPELKTRCQERSRCTVLGLVLCIAGCLFALYGLVSSLVAPTNKSCDTVNEGYRCSPKTTHFWGQYSLWYSVPSEISVEPPKGCHATFANVLSRHGGRDPTAGKSLAYALLIANIQNTSTAFPDEFAFLKHYEYKLGADELTDAGRQEMVNSGAHFFHRYHNLVKKHTPFVRAGGQHRVVESAEEWLSGIAQSLDEKAKKIDVIIPEGTEWNNTLSHDVCPAFTGSPGYEAQRKWASKFVPPIQERVNAKLGTDLSATYIVYLMDMCPFDTLAHPAAKVSPFCHLFTEKEWHEYDYFQTLGKYYGYGVGNPLGATQGAGYVNELLARLQNKPVEDSTNTNRTLDSDPATFPLDRKVYADFSHDNDISGVLAALGLYNQTKPLSKTAVESTEDTYGYSAAWTVPFASRLYVEKLQCSGAKEEFVRIIVNDRVQPLEFCSADKHGRCTLSKFVESQSFSRSGGLWSQCYE

SEQ ID NO: 4916 - protein, 496 aa, Unknown
  Kingdom: Fungi, Phylum: Ascomycota
MPSLIRSLALVPALLSSIAYAVNPVEVRGQDFVDTVTGKRLMIVGVDYQPGGQAGYKPAAKQDALTDADVCLRDAVVMQKLGVNTIRVYNVDPTLDHSECMSIFNAAGIYLILDVNSPLSGESINRAEPWTSYHKDYLTRIFGVVENFKAFPNTLAFFAANEVMNDLSTAEYNPMYIRAVQRDLKNYIKNHVDRSIPVGYSAADVREILHDTWAYMQCDHDDDQSSSDFFGLNSYSWCGEGDMQSSGYTDLVNMFQNSAIPVFYSEYGCNKVQPRIFTEVGALYGSQMTSLSGGLVYEYSQEEADYGLVVINENGTLSLREDFDNLQGQFNKLDLGLIQSTNASSTNIKAPECSMDLITAEEFSKNFTIPAVCPGCADIIKNGISNPQNGKLVDVTETKPKQAVYGTNGNEIQNLELTKLTEANTPGNSSLSSGNTGTSTGTAPTPSATKAGSASSDETSPAPTTTSTPKGDAPSRGLSESFALWSPLMALWLVGI

SEQ ID NO: 4917 - protein, 404 aa, Unknown
  Kingdom: Fungi, Phylum: Ascomycota
MVSAAFILALAPAVVLAQSPLWAQCGGAGYSGPTTCAAGSFCKYTNDWYSQCVPGTGNGGGSKPTTTAKPTTTAKPTTTRATASSGSQPTSGAGNGGTASSSLNGRFKAKGKEYFGTEMDYYHLSNNALTTIVKNSFGQVTCENSMKWDAIEPSRGSFNFANADKVVDFAIQNGKLIRGHTLLWHSQLPSWVSQINDRNTLTQVIQNHITTVVTHYKGKILQWDVVNEIFAEDGSLRDSVFSRVLGEDFVGIAFRAARAADPNAKLYINDYNLDIANYAKVTKGMVAHVNKWISQGIPIDGIGSQSHLAAAGGWNSAAGVPAALKALAASNVKEVAITELDIAGAAASDYVTVTNACLQVPKCVGITVWGVSDKDSWRSSDKPLLFDSNYQPKAAYTAVMNALA

SEQ ID NO: 4918 - protein, 234 aa, Unknown
  Kingdom: Fungi, Phylum: Ascomycota
MQFKITLLAAAAGLPYTALAASGSGVSTRYWDCCKPSCAWSGKAAVSKPVTTCDKNDSPLADADAQSGCNGGPAFACTNNSPFAVNDNLAYGFAATALGGGTESSWCCACYALKFTSGPVAGKTLVVQSTNTGGDLGSNHFDLMIPGGGVGLFDGCTPEFGGIPGAQYGGVSSRAECDQMPEKLKAGCYWRFDWFLNADNPNLTFEQVKCPAALTAISGCVRQDDGSFPAAPSA

SEQ ID NO: 4919 - protein, 407 aa, Unknown
  Kingdom: Fungi, Phylum: Ascomycota
MPSFTYLTAALALTSAVAATPVQKRDAFSVQQVKHNIHLKNGPGQIAKTLRKYGKVVPEHIQLAANARADTVTALSTTGSEPANPSDDYDSSYLSPVTIGTTTVNLDFDTGSADLWVFSSLQASTQLSGHDYYKVDASKVKSGYSWRISYGDGSGASGKVYADKVTVAGVTATSQAVEAATSVSAQFSQDRDTDGLLGLAFSTINTVSPTPQKTWFDTVKSSLAKPLFAVNLKYHAAGTYDFGFIDSSKYTGSITYVDVDDSQGFWGFSATGYSVGSAAAVRSSIDGIVDTGTTLIYIDPAIAKAYYSKVSGAKIDNTQGGYVFPCTASLPNFSITVGGVAQTVPGKFINYTPISSGSSTCFGGIQTNEAIGFNIFGDIFLKSKYVIHDVSTGSPRLGFAQQAGVAL

SEQ ID NO: 4920 - protein, 574 aa, Unknown
  Kingdom: Fungi, Phylum: Ascomycota
MKTVAIIAGMAALANAHATWQQLWKNGEDLESTCARLPPSNSPIEDYTSTALQCNVNPAAASGKCSYEAGDSVTIEMHQHNNRDCTTEGIGGAHWGPVLAYMSKVDDSATADGSSEFFKVYENTWKAAPGSTQGDNDYWGTKDLNYNCGKLSFSIPEDIAPGDYLLRAEAIALHAASSSGGAQHYVTCYQLTVTGSGTATPAGVKFPEAYSKTGTGLGFSIHAPLSEYPAPGPALYARGTKVEPQLLTFGEIADVPKPTGGAAAPAAPSSSAAAASSAAPTSAAAPASSAAAESSVASEPAATSAAPSSAVEAEPTEAATSAAATSAAASVVPAPAASSTAAPETGDDKYNVDSFAAFLEAQPGSDVEFTIEEFIAWLEKIESGSNTAEPSASEVAEPTAAQSSAAVKPTTSAAATQAPAQSASAAASSAGPAKTTLATVTKPQPTSGSDSGAEVQAYGRCGGQGHTGSTTCVSGWTCKVQNSYYSQCIKSEGGNAAPQPSATKPAASATKPATAPTSTAAAASSAAPVASSSAAAVVTKEAVSSATPSASAAPAADKLWTIEELIAFLEEAAE

SEQ ID NO: 4921 - protein, 408 aa, Unknown
  Kingdom: Fungi, Phylum: Ascomycota
MQFFTRFVAFTAAVTPFFASAAPVTGSKAADGIIPGKYIVQLKPEIDVASIAAHHIVLREIHERNFAKRGLTIVEKEAGVEHEFGFGEFKGYSGAFDAATIKELEALPEVLNVVQDYIMTTNALVTQNNAPWGLGSISSRTRGASSYIYDNTGGRGTFSYVVDTGIRITHQDFGGRAQFGYNAVGGDNNDNQGHGTHVAGTLGGTTYGVAKQTTLIAVKVFEGSQGSASAVIAGFDWAVNDIVSKGRQNSAVINMSLGGPGSTVWDQAITAAWNRGVLAVVASGNENQLASNRSPARSPEVLCVGNVQSNDARRAGSTGSNYGPAVDIFAAGTSIVSAYYNSDTATASLTGTSMASPHVAGLVSYLRGLEGLSSAAAVKARVLQLATPNRVTDTQGSANLLAYNGNGR

SEQ ID NO: 4922 - protein, 375 aa, Unknown
  Kingdom: Fungi, Phylum: Ascomycota
MELTKFLAALAAFLPIVYGAPTTAANELHPEILAAMKRDLGLDAEQAHVRVARELKATEVIEQLRTSAGNSFGGAWLVDGELNVAVTDEALSAEVTEAGATALVVDTPLSKLEDAQKALDKIDLESATKRSAGTGIAAYYVDVAANKLIIEALADSTEQAADLAKQVGLAEGEFEVKTVGELPSTFATVRGGDAYYINRAGRCSVGFSVTTGFVTAGHCGTTGSTATTSASGGSTIGTFAGSSFPGNDYAFVRSTSGNTYAGVVNNYSGGTIRVTGNTPTAVGGSICRSGSTTGVFCGTVRALGASVSYAEGRVTGLTQTNVCAEPGDSGGSWYSGGNAQGVTSGGSGNCRTGGVTYFQPLNEILSAYGLTLVRG

SEQ ID NO: 4923 - protein, 1007 aa, Unknown
  Kingdom: Fungi, Phylum: Ascomycota
MRSINSLSWLSVLATLTTSIPAINAQNNSVGQWPVHDNGLNEVVQWDHYSFMVNGKRLFVFSGEIHYWRIPVPEIWEDLLEKIKAAGFTAFAFYGNWGYHSFNNQTIDFDSPAHDFTKLYEIAERVGLYVITRPGPYVNAEATAGGFPHWLTTGAYGKLRDDDPRYLSALEPYFSEFSKRAAEHDITKGGNGFVYQLENEYGSQWQNRDRKIPYLPAGRYMDHLQKLARANNIDIPVIHNDPNMNTRSWSKDYAPGALGNVDVAGLDSYPSCWSCNLDECTGTNGEYVAYQTINYYDHFALVSPTQPSFFPEFQGGSYNPWGGPEGGCPGDIGADFANLFYRNLIAQRSTALSLYMMFGGTNWGALACPVVATSYDYSSPISENRRIDSKFYETKNLALFTRIAEDLTVTDLIGNSTSYSTNSAIKASELRNPETNGAFYVTIHDYSPSGTREEFKLHVSTSIGNLTVPQTGSIVLNGHQSKILVTDFAIGENIITYSTAEVLTYSIVDGKPVVVLWTGAGESAEFHIKDAKKGSAAQNGKASNATIKTDSFGVLVNVPAVNGQSVYEFDKGVRVIVVDKPTAYLYWAPNLSKDPFAPVDQSIIVGGPYLVRHVANENGVLALKGDIMKSTEIEVFASKDFKKLSWNGQELKTHRTAHGSLTANVQAFSGSIKLPELNNWKVANNLPEKEPSYDDSGAAWVEADHLTTPNPTKPDTLPVLYVDEYGFHNSFHLFRGYFNGSATGVKLALQGGLAFGWTAWLNGEFIGSWYGNSTLGQGNQTLSFNNATLNSNGTNVLLVAQDNSGHDLRERATDPRGILAASLVGGGNFTKWKIAGEAGGERIQLDPIRGPLSEGGLTAERLGWHLPGFDDSEWETASPSTGVSGATINFYRTVVPLDVPENVDASFAFVLNAPASKQVRVHLFVNGYQYGRFNPWVGNEVKFPVPAGVLNYGGDNVIGLSVWSQSEDGAKVDIKMVQEYAIESSWKSRFDGEYLRPGWTEERLAYA

SEQ ID NO: 4924 - protein, 227 aa, Unknown
  Kingdom: Fungi, Phylum: Ascomycota
MVSFIAIFTAAVAASGAIAAPVTDLATRSLGALTARAGTPSSQGTHNGCFYSWWTDGGASATYTNGAGGSYSVSWKTGGNLVGGKGWNPGAARTITYSGSYKPNGNSYLAIYGWTRNPLIEYYVVENFGTYDPSSQATNKGTLNADGSSYKIAQTTRTNQPSIDGTRTFEQYWSVRANKRSSGSVNMKTHFDAWASKGMRLGTHNYQIVATEGYFSSGSSQITVNCA

SEQ ID NO: 4925 - protein, 253 aa, Unknown
  Kingdom: Fungi, Phylum: Ascomycota
MRLTSISSVTVLAGSAFAAVGDWQQCGGVNWSGETLCNAGSGCVKLNDFYSQCQPGAVVTTLFTSTKSPTTVTRTTAGGTAVIPSTPAATSTPVGTGPGTTLQSGYHWIRAVAAPNFHKYMQTKPLYATGAALLADYTTAGQFQVVDGQLVQLVSAPGAAIKLLYAVVSETRYINDKSLSVTFSTTKNTYGQFAWQGDTLTWSVAGVSRPNTAAWYVCTGQQLYINLGSYLYQTPAGCADQTIHYYNDKTANA

SEQ ID NO: 4926 - protein, 464 aa, Unknown
  Kingdom: Fungi, Phylum: Ascomycota
MKLSQTTLSFITLQLVAAQGGPWAQCGGSGWNGATSCVNGYICTTQNPYYHQCVPGTSTNPPPPSTSALPPPVTTTSSGSPPPPSTTGGTNPPTGSCPALPSSLGSSNSNLPDPFTFHNGAKVQTKADWTCRQREMSHLLQTYELGTLPPKPQSVTASYSGNTLTINVSDNGKSISFSVTISKPSGTSVPAIIHFGFASLPVPAGVASITFDNGDIAAQENSGSRGRGKFYTLYGASHSAGAMTAWAWGVARIIDALEVTPSVGINPARVGVTGCSRNGKGALVAGALEPRIALTLPEESGSGGSACWRISDWQKSRGTNVQTASQIITENVWLGPAFNTYVNNVNALPFDHHMLAGLVAPRPLYVMENSDMEWLGSTSTYGCMGAARKQWEALGALDNFGYSQVGGNSHCSFPTGKQGTELNAFINKFLLGSGGGTTNIYRTEASHSGFSLSTWAPWPVPALA

SEQ ID NO: 4927 - protein, 232 aa, Unknown
  Kingdom: Fungi, Phylum: Ascomycota
MLSQSVLTLALAALLPTLTAAQSGRTTRYWDCCKPSCAWSGKAQVNRPILTCSANDSPLTDPDVRSGCDGGSAYTCSNNSPWAVNDQTAYGFAATAISGQSESSWCCACYALTFTSGPVAGKTMVVQSTNTGGDLGSNHFDILMPGGGVGLFDGCTPQFGGIPGAQYGGVSSRSECDSMPANLKAGCQWRFDWFQNADNPDVSFKQVRCPSELTSISGCTRNDDGSFPAFSG

SEQ ID NO: 4928 - protein, 234 aa, Unknown
  Kingdom: Fungi, Phylum: Ascomycota
MRYSQIASLAALGSVASAYDLPDNLRAIYEEHKSGSCNNPLSDTFSEGDVYCGDLPNAIFLKGNGVYANMDIDCDGANNAAGDCANDPTGQGQTAFQWIVEDYGIEDLDANLHSYVVFGNVEDSPSYEPDKSEGMEPLSVMAVVCNDQLFYGVWGDINGGTSTGEASLALAKLCFPNEGLNGNKGHDERDVLYIGFTGSAAQPGADGAAWSASSPEEFAESLREIGDSLVASLG

SEQ ID NO: 4929 - protein, 384 aa, Unknown
  Kingdom: Fungi, Phylum: Ascomycota
MRSPAFLLAIAPAAVLAQSPVWGQCGGSGWNGPTTCASGSTCVKSNDWYSQCIPGTGGGGGDNGGGGGTTPPPSGGGGGGANTLDGRLKAKGKAFFGTEMDHYHLNNAQYTAIARDQFGQVTHENSMKWDAIEPQRNQFTFTNADRIVDWAQTNGKKVRGHTLLWHSQLPAWVNNINDRNTLTQVIQNHVTTMVTRYKGKIAHWDVVNEIFAEDGSLRNSVFSRVLGEDFVGIAFRAARAADPAAKLYINDYNLDIANYAKVTRGMVDHVNKWIAAGIPIDGIGTQAHLAAPGGWNPASGVPAALRTLAASNAKEIAITELDIANAGANDYVTVVNACVATPKCVSITVWGVDDGNSWRDDNPLIWDAQFRPKAALNAILGALA

SEQ ID NO: 4930 - protein, 301 aa, Unknown
  Kingdom: Fungi, Phylum: Ascomycota
MKIDLRLSLGLAATQALHAFAQSCPSIHIFGARETTVSPGYGSAGALVQQVQSAYPGSTAEAITYPACGGQSSCGGVAYGDSARQGTAAVASAVNSFNQRCPDTKIVLIGYSQGGQIMDNAFCGGGDPNSGISSTAVPISASAVNMIKAAIFLGDPRWQYGLAYQVGTCRAGGFAARPSGFTCPNASKVKSYCDSQDPYCCNGNDANHHQQYVSIYGSQALTFIKSQLDASGGGSGGGGDNGGGGNNGGGGNNGGGGGGGGGGTNCAALWGQCGGSGWSGATCCQTGSCKAQNQWYSQCIN

SEQ ID NO: 4931 - protein, 408 aa, Unknown
  Kingdom: Fungi, Phylum: Ascomycota
MPSFTYLTAALALTSAVAATPVQKRDAFTVEQVEHSVHLKNGPAQVAKTLRKYGQVVPSHIQKAADARANTVNAAAATSGSEPANPSDEYDSSYLSPVTVGTANLNLDFDTGSADLWVFSNLQASSQLAGHDYYKVDSSKLKSGYSWRISYGDGSGASGKVYADKVTVAGVTATSQAVEAATSVSAQFQQDQDTDGLLGLAFSSINTVSPTPQKTFFDTVKSSLAKQLFAVTLKYHAAGTYDFGFIDSTKYTGAITYVPVDNSQGFWGFTATGYKVGTGSAVSSQIDAIVDTGTTLIYVDSAIVRAYYSKVSGAKNDNTQGGYVFPCSATLPSFSITVGGVAQTVPGKYINYAPISTGSSTCFGGIQDNSGIGFNIFGDIFLKSKYVVHDVSTGSPRLGFAQQAGVSA

SEQ ID NO: 4932 - protein, 408 aa, Unknown; identical to SEQ ID NO: 4931
  Kingdom: Fungi, Phylum: Ascomycota

SEQ ID NO: 4933 - protein, 227 aa, Unknown
  Kingdom: Fungi, Phylum: Ascomycota
MVSFTSIFTAAVAASGAMAAPVTDLATRSLGALTARAGTPSSAGTHNGCYYSWWTDGGAQATYTNGAGGSYSVTWKTGGNLVGGKGWNPGAARTITYSGTYNPQGNSYLAIYGWTRNPLIEYYVVENFGTYDPSSNAQVKGSVTSDGSSYKIAQTQRVNQPSIDGTQTFNQYWSVRQNKRSSGSVNMKTHFDAWAAKGMKLGTHNYQIVATEGYFSSGSAQITVNCA

SEQ ID NO: 4934 - protein, 338 aa, Unknown
  Kingdom: Fungi, Phylum: Ascomycota
MRRDGPVPKGDGARVAGMNEPSVLVIPSNWAPPSHRVKLKEICGRGPAQAASRDLRTTHPQTDWGIAQDQQDDPLFRKLECRHWTYITESSRLTTFDVSTPHTPTVKPITSNMLFLQQLIVVTLAIGSAVAQTKTGKTTRYWDCCKPSCGWSGKASVTAPVKSCDKSDNPLADMAAKNGCESGGSAFMCTNQSPWAVNDNLAYGFAAAKLSGGSESSWCCACYELTFTSGSVSGKKMIVQATNTGGDLGDNHFDIQMPGGGVGLFNGCTAEFGAPSTGWGAQYGGISSRSQCDSFPQKLKAGCYWRFDWFKNADNPSVSFKEVTCPSALTDKTGCKRK

SEQ ID NO: 4935 - protein, 281 aa, Unknown
  Kingdom: Fungi, Phylum: Ascomycota
MKATFVLATVTALAVKVAGHATFQELWVNGVDQISQLSHLVAQTVLTDVTSNNIRCGPQPKRNDRNLLTIQPGNANQGFAASKCSVAAGGTVTIEMHQQPNDRSCSNEAIGGAHYGPVLVYMSKVSNSATADGSTPFFKIYEDTWAQNTAGGGGSDDYWGTKDLNKHCGKLDVKIPTGLAPGDYLLRAEAIALHAAGSSGGAQFYLTCYQLTVTGSGTTNPSGVSFPGAYKASDPGILINIYQKLTKYVSPGPAVISGGTTAVAGKAGSTLGRRLSAKLHY

SEQ ID NO: 4936 - protein, 372 aa, Unknown
  Kingdom: Fungi, Phylum: Ascomycota
MQISAFLAAVAAFLPIVYGAPTAAANSLHPDILAAMKRDLGLDAEQAHARVARELQAADVIKTLESKAGFAGAWLVDGDLKVAVTDDALTAEVSSAGAEAVTVDTPLSKLQEAQKAIDALDIEGLTKREEAAKGIAAYYVDVAANKLVLEALADSIAQAEDLAKKVGLVAGEYEVKTVSELPTTFATIRGGDAYYINNSARCSVGFSVTTGFVSAGHCGTAGQTASTSAGATIGTFSGSSFPGNDYSYIRGSSGNTFQGRINNYAGSTLPVSGSTAAAVGSSVCRSGSTTGVYCNTIRATGATVSYAEGRVTGLTQTNVCAEPGDSGGSFYSGAQAQGVTSGGSGNCASGGVTYFQPVNEILSAYGLTLVRG

SEQ ID NO: 4937 - protein, 441 aa, Unknown
  Kingdom: Fungi, Phylum: Ascomycota
MHFSSLLVAAVAVLPTTVFSQLSGRVGPLTTYAAKTKVKTCSVLDYGGKADKSTDIGPALLKAFAACKAGGTVVVPAGDYAMQTWATFEGGKAWALQLDGVIYRTGTDAGNMLFIRNANDFEMFSSTGKGAIQGLGYEDHKNGKRNGARLLRVEKTNNFSVHDIILVDAPMFHFVMNTVTNGEAYNMAIRGGDWGGLDGVDVVGTNVWIHDIMVTNKDECVTVKSPSSNLLVENIYCNWSGGCGMGSLGASTAISKIQYRNIYTWKSNQMMMIKSNGGSGYVEDVLFENFIGHSNAYAFDIDQYWSSMSAIAGTGVQLSNITAKNWRGTQANGAQRGPVKVVCADGAPCTGIDVSDVQMWTETGSKNVNVCRSGHGAGACLKSGTGAYAQIAQTVTTAPTAYSAASMAEDLKTAFGTASSIPIPTLPASYYPNTPPISKAP

SEQ ID NO: 4938 - protein, 549 aa, Unknown
  Kingdom: Fungi, Phylum: Ascomycota
MKTVAVIAGIAALANAHATWQQLWKNGEDLESTCARLPPSNSPIEDYTSTALQCNVNPAPASGKCGFAAGDTVTIEMHQHNSRLCTEEGIGGAHWGPVLAYMSKVEDAATADGSSEFFKIYENTWKKAPGSTQGDNDYWGTKDMNYNCGKLDFTIPEDIAPGDYLLRAEAIALHAASSSGGAQHYVTCYQLTVTGDGTATPAGVKFPEAYSKTGPGLGFSIHQDMTEYPAPGPALYARGTEATPQLLTFGEISGVPKPTGGASAPASSAVVAPSSKAASSAAATSAAATSAAATSAAPASSAAATSAAAPTSAAEAATSAAASSIVASTPAASSTAAPETGDKKYNVDTFAAYLEAQPGSDAEFDMAEFIAWLEKIESGSNTAEPTAAQSSAAAVKPTATAAASQAPAKSSAAAVSSAPAKTTLATVTKPQPTSGSGSGSSSDATVQAYGRCGGQDYTGSSTCASGYTCKVQNPYYSQCVPGSEGGNAAQPGASKPTATKPAATPTAAASSAPVVSKEAAPSASASAAPAADKLWTIDELIAFLEKSAE

SEQ ID NO: 4939 - protein, 396 aa, Unknown
  Kingdom: Fungi, Phylum: Ascomycota
MMSKAFSVATVALAASSLVSAQTFTACNPLKKTCPADPAFGGTTSCDFTKGACNTFSLADGTSLKYNGQGAVFSISKDSDAPTIHTGKYIFFGEVEVKVQAAPGKGIVTSAVLQSDDLDEIDWEWVGGDNTQVQTNYFSKGDTSSYDRGAFHGVGNPTGQVHTYTVKWTSQGVWWFIDGQQVRELTAANAKGGAAALPQTPMQIKLGTWVAGRKDAPEGTVQWAGGYADYSKAPFLAYYQSVKIVDYAGKDSPASGGVKEYVYSDNTGSWKSIKVVGGSGNDDTSSTTSVASTTKATKTSSKTTEASSTETTSSAVTKTSSVESKTTLTSAVSTASKTDSGSGNATASTTGGSNTSPATGSATPTSVPKSGAERGVAAVGSVLLAGAGVLAAQLLL

SEQ ID NO: 4940 - protein, 488 aa, Unknown
  Kingdom: Fungi, Phylum: Ascomycota
MRSTIRALAALASAACLVAPSTAQTYTNCNPTVRTDCPPDSALARTVNIDLSSASDSFTPQSNPTYGDDGVSFTISKSGDAPQLTSKWYIMFGKVDVVLKASPGAGIVSSFVMQSDTLDEIDWEWLGTNPDEVQSNFFGKGQTTSYNRGAFHEDIGSQSGFKTYSIEWTPEQIVWQIDGVTVRTLEPANAENQYPQTPMQIKFGSWAGGDPGNAAGTIEWARGPTDYTKGPFTMTVKSLRVEDYSTGTQYVYGDTSGTWQSIKSNGGTIYSGGEKPLNSDSPQITATASGAPLPFTPSRTSSDYERPSVYPWIPGTSSPTPEPTFGNYPGLPSGWTVSDTGKVVPPSSAPVSKPSVYSSILETVANSHLQQSPLASSTASPAASQSASSGDSKPLIWTGYDDRGFTTIYTSYPGTTQAPVTQLPATEAAAQPTSTVQINSDLALENNAAETAPPVPKANNAPGLDNVMTSSAYFFTIIVVTVAGSWWF

SEQ ID NO: 4941 - protein, 608 aa, Unknown
  Kingdom: Fungi, Phylum: Ascomycota
MTGYKSSGNLTRWFCSTCGAHLFGDIQLGDAKLWFVSAPSVDAEEGVWNFAGHVFVGGTGDGGLATLMPNIGGKELGLWETWAGKSAPWHPTERTKGTETIQRPEQDRLHAHCHCGGVEFYISRPTGDETFKEIDENNIRKHKDKWFALHDVCNSCRLTISTWVISWFFPSRDHITLADGSPYPADGLFGTAKAYSSSAGIDRTFCGKCLLDTDDVRAENWLEWRTYKLAWDDDAVWKSVKDALKTGLQVHAQNDIWTLHGRRERLPTTDSCCGLRFKYPQPTFGEMIHISLVDDPCRRPSDPRVLDTIKGFVPQKVCFCSTTSHSFPTLVYFASAKMLTKALLSLALVAPILALPAPQPDMVISDTIKQKATSLCGVSDSVVLTDTPWIVFNMMYNQALTVGTQCINYDRVSTGTDGNKEIHWSAVSTIDYVKKTDNIPKGYSFIGLTKNLETKLSAIKSIPATYDWTRTNTTAYKGNICFDFMTSDTKGDSTSSNAQELMLWLEWTGGQLPIGWVEGPVATINDLYGTSWKLYQGKNEDTGITVSSLLPDKQFTGKFTGDIKAWLNALVKVGVFKDSTYVNVGNAGTEPFYGKATVKATLGLQINL

SEQ ID NO: 4942 - protein, 270 aa, Unknown
  Kingdom: Fungi, Phylum: Ascomycota
MLTNYLLSLALIAPILALPAPQPMVISDTTKQKATSLCGVSDSVVLTDTPWIVFNMMYNQALTVGTQCTNYDHVAIGGDGNRKITWSAVSNIDYVKSTDNIPKGYSFIGLTQNLETKLSAIKSIPATYDWTRTNTTAYKGNICFDFMTSDTKGDSTSTNAQELMLWLEYTGGQLPIGWTAGPKATINDLYGTSWKLYQGKNDDTGITVSSLLPDRQFSGTFSGDIKDWLEALVKVGVFKDSTYVNVGNAGTEPFYGVAVVNATLGLQINL

SEQ ID NO: 4943 - protein, 443 aa, Unknown
  Kingdom: Fungi, Phylum: Ascomycota
MHFSSLLVAAVAVLPATVFGQLSGKVGPLTTHAAKTKVKTCNVLNYGGKADKSTDLGPALLKAFAACKKGGTVVVPTGDYAMKTWVTFEGGKAWALQLDGVIYRTGTDAGNMLFIRNANDFEMFSSTGKGAVQGLGYEDHKNGKRNGARLLRVEKTNNFSVHDIILVDAPMFHFVLNTVTNGEAYNMAIRGGDWGGLDGVDVVGSNVWIHDIMVTNKDECVTVKTPSSNLLIENIYCNWSGGCGIGSLGVDTAISKIKYKNIYTWKSNQMMMIKGHGGSGYVEDVLFENFIGHSNAYAFNIDQYWASMSALSGNGVSLSNITAKNWRGTQANGAQRGPVKVVCADKAPCTDINLSDINMWTETGNRNVNLCRSGHGSGACLKSGSGAYALVTQTVATAPTAYSAASMKENLKTAFGTASSIPIPTLPASYYPGTPPISKAPGQ

SEQ ID NO: 4944 - protein, 408 aa, Unknown
  Kingdom: Fungi, Phylum: Ascomycota
MQLFTRAVAIAAAVTPLFASAAPVSARQSADGIIPGKYIIQLKPEADVSSIAPHLNAVREIHARNLAKRDVAVAEEEAGVEREFGFGDFKGYSGAFDAATVEELKALPEVLEVIADYIMTTNALVTQNNAPWGLGSISSRTRGASSYIYDNTGGRGTFSYIVDTGIRTTHQDFGGRAQFGTNTVGGDNNDNQGHGTHVAGTVGGTTYGVAKQTTLIAVKVFEGSTGSASAVIAGFDWAVNDIVSKGRQNSAVINMSLGGPGSTVWDQAITAAWNRGVLAVVAAGNENQLASNRSPARSPEVICVGNVQSNDARRSGTTGSNYGPAVDIFAAGTSIISTYFRSDTDTASLTGTSMASPHVAGLVSYLRGLEGFSSAAAIKQRVYDLATPNRVTDAQGSTNLLAYNGNGR

SEQ ID NO: 4945 - protein, 632 aa, Unknown
  Kingdom: Fungi, Phylum: Ascomycota
MRVSDLLLLSLTSLAAGSPLGSHVVHEKRNALPVAWTKHSRAPKDTVLPVRIGLTQRNLEHADRFLDDISDPESPNFGKHWTSERVANTFAPHPKASETTLEWLQNSGVDLKRVKHSVGRNWVEFSATVEELEKLLSTEYHFYQHKASGGFRIACDEYGLPHEVKKHVDFVMPTVQLDGLQPIAQSVAAIQAPVNLTGLTGTTNCATLITIDCLRAIYNIPVGKYNHTGNQLGIAEWADYLYLPDLKTFFQNFTNPKIPSDVVPEFISIDGGKASNLSLAQQEKVVESALDFQTAYSIIWPQQTRLYQNGDSVNVDSVGTFNIFLDALDASYCTYQGGDQPYVDPAYPDPNDAPGAYTGPLQCGGAPVSNVISVSYGQIEGALPQFYQERQCREWMKLALQGVSVIFASGDSGVANRYNSGYNNSCLNSEYGYVDENGTRFSPSFPANCPYITSVGATTLLNSSIYGGEKAVASPNGPLSYYSGGGFSSVFPRPSYQDKAVEKYLKKYSPKYGEAVFNSSGRAYPDVSALGLKLATVWLDKTYGIGGTSASAPIFASIINLLNEERLEKGKKPIGFLNQIIYKHPEMFNDVTVGGNPGCGTDGFPASPGWDPVTGQGTPDYNKMRKVFLDLP

SEQ ID NO: 4946 - protein, 319 aa, Unknown
  Kingdom: Fungi, Phylum: Ascomycota
MYISNIFVTALAATSTAQAFDIRHEVRNAGEVSKRTFGNIFGMLNGLFGGNNKASAECPAVWTQISAQLTEQFLADGQCTDAARAAIRSSFHDCFNGACDGSLILADECSNVENRGLERLCGNLKTVQANTGVGMADLIQFAAAHGVKTCPGGPTVPVKVGRKDSSEANALGVLPSGRAQSGDLIKLFASKGFSPVDLAALLGAHTAAKQRFTSPDSPQELDSTVGQWDNRYYSETRSGKAPFTLPSDKSVAQNPLTMIPFNTFALSKGAWDMAFVGAMQKMSMMGVDQKDLIDCTSALPGGSRKRDIRSSNVFDRFKW

SEQ ID NO: 4947 - protein, 377 aa, Unknown
  Kingdom: Fungi, Phylum: Ascomycota
MEIIKFLSILAAVLPLAYGAPTQAMSDLHPEILAAMKRDLGLDADQATARVKREISAAEVIEQLRGSTGEAFAGAWVANNGETINVGVTDEALAEQVTAAGAQPVIFANSISKLEEAKEALDKLVSQPQTRSVGKQGTNVASWYIDVEANKIVFEALADSTAHAEKLAAEVGLSESEFEVKTVDEMPTTYATIQGGDAYLISGTSRCSVGFSVTTGFVTAGHCGRVGASATTTSGQSLGSFAGSSFPGRDMAFVRTGSGHTLRGYINGYGSGSLPVSGSTQAPVGSSICRSGSTTGVYCGTVRVFGATVNYSQGSVSGLTGTSVCAEPGDSGGSFYTGAQAQGVTSGGSGNCRSGGTTYFQPVNPILSTYGLTLVRA

SEQ ID NO: 4948 - protein, 377 aa, Unknown
  Kingdom: Fungi, Phylum: Ascomycota
MRAHLLSTALLAFVNSAAAVTGAAEGFAKGVTGGGSGRTVTPNTITDLVNYLGSSEALNIVLTKTFDFTGSEGSATGAGCAPWGTGSTCQKAINKDNWCNNYEPNAPKVTITYDKAGMLGITVNSNKSIVGQGNKGIIKGKGLRMVNGVSNIIIQNIQVTEINPAYVWGGDAITIDGADLVWIDHVSISRIGRQHLVFGESASGRVTVSNCEINGISSWSADPGCTGNHYWGMYFTGSNDLITFKNNYVHHTSGRSPKVQGNTLLHAVNNYFYSNPGHAFETAPGAMVLAEGNVFQNVKVAVEDSGAKWFASPNANVNAQCSSYLGHACQPNAYGSSGSLSGSDTSFFANFKGKNVASATTADAAKNVPNTAGFGKI

SEQ ID NO: 4949 - protein, 1050 aa, Unknown
  Kingdom: Fungi, Phylum: Ascomycota
MRTCQTLNCLLWLALGAEALDHDARVAQTFSRYHSGSLQRREDPVTASANKSTPFIYKTNFDGVTWDSRNWRLHGTILDQGHYQSRGSIANGYFGINVASAGPFFELDEAVDGDVINGWPLFSRRQTFAGLAGFFDVQPDTNGTNFPWLLQYGGESVISGIPHWSALILDLGDDAYLDASVDNQTISNYRTTYDFKAGMLSWEYTWTPKGDHGHFNVTYNLFANKLDINQAAVRMTVRPSFNAKGRVVNLLEGYAAVRTEFVDSGEDEGAIYSAVRPSGINNVTAYVYALLDADPMLDLSSSKILSDEPYIYANKSTIAQAVDVEFKAGEYVTVTKFVGAASNDSFSDPKQVARNAAFAGKYRGYDDALRSHISEWAQVMPDDSVDDFSYRNGTLPDDPFIIEAAVMAVVNPYYLLQNTVGPNAERKANDAPVNDFSISVGGLTSDSYAGLIFWDADVWMQPGLVAAFPESAQRITNYRLAKYPQAKSNVKTAYSSSQNETYFSDDAALYSWTSGRWGNCTATGPCFDYEYHLNGDVGIAFLNEWITSGDDERFREDLFPVYNSIATVYADLLKKNGTKWTLTNMTDPDEYANHVDAGGFTMALISQTLTYANDLREKFGMEKNKTWTEMAENVLLIREDDVTLEFTTMNNSVLVKQADVVLNTYPLDYTRDYPKSIALNDLDYYAIKQSPDGPAMTYAIFSIVANEVSPSGCSAYTYAQYSYLPYLRGPFHQLSEQLIDDYTENGGTHPAYPFLTGHGGANQVVLYGYLGLRLLPDGKIHIDPNLPPQVPQVQYRTFYWHGWPISARSNYTHTTIARATTVKPLDTASGSYRNSSIEVIVGTDENSKTYTLPANGTAIVVENRKIGTKNTLEGNMIQCQPVSSNDSFIPGQFPISINDGAASTKWQPEFANNISSITITAADSDKAKSVSGFYFDWGQAPPSNITVVLHNSKLGGDVESLRLGSLKNSSDLTVAQINVTVSNPWKTNVSNTAEISTPQVNTTNFTFAQAVPLRKFATLFVEGNQGLAEVDVENKNGTGATVAEWAILSG

SEQ ID NO: 4950 - protein, 353 aa, Unknown
  Kingdom: Fungi, Phylum: Ascomycota
MFLKSMVAASALLYTTATAQTACNNSPELCSRAYNNITQLGAHDSPFLRNKNTSFSTSGNHYYDTTTQLDAGVRLLSAQVHKSDNGTGADEWHLCHSSCDLLDAGTLEAWLSTIKTWMDRNTNDVVTVLLVNSDSASASDLGTQFNSSGISQYAYVPPSTSAPTTWPTLDALIGNNTRLLTFVAPLTEASPQYPFLMDEFTYVFENNYENVNPSNYSCTPSRPSGLTTSSTGGRLFLQNHFLYETQLFGIQSPNETYAPTTNAQTGYGSLGTAVSNCTSVYGRVPWAVLVDFFNVGPAIASVDAANGVAGSVTGRRSLSTEPLTEESEGGVARAQGSLLAVIVAVVVAVGFGM

SEQ ID NO: 4951 - protein, 442 aa, Unknown
  Kingdom: Fungi, Phylum: Ascomycota
MRGTTLSLLWLAGLTAGQSDSSSVSPSVVTLTGTQRQLSGGEFGGSVTVPSDFEGSTFATLTSAPSGSTASANATVSASSDASIIEIGGGNRTRTPTGSATGSAALPQNTQPCNNYVEFCNRKYSNITEVAAHNSPFTKERNVGRNQDYGVTQQLNDGIRMLQGQAHYINGTLYYCHTSCDLLNAGTVEDYLKEVVAWVEAHPFDVVTIIFGNYNYEDKDENGNPLVTSSNFDEPIRSSGLYDYIYQPPKTAMELADWPTLGQMLLQQKRVVTFIDYNFDTDAVPYLLWEFYNMWETPYSPTDAAFPCTIGRPEGVSDEKARDMLYMANHNLNVEIAIAGLSLLVPNVAATNTTNGLEGEGSLGLMSNQCTSDWGRPPNFLLVDFYNQGPINGSVFEVAARANNVTYNRGCCGKASSFGTALLTPSATYLALVVAVVGVLMI

SEQ ID NO: 4952 - protein, 353 aa, Unknown
  Kingdom: Fungi, Phylum: Ascomycota
MFFKSLVAASALLYSTATAQTACNNSPSLCSRAYNNITQLGAHDSPFLRNKNTSFSTSGNHYYDTTTQLDAGVRLLSAQVHKSDNGTGADAWHLCHSSCDLLDAGTLESWLSTIKTWMDKNVNDVVTVLLVNSDSATASDLGEQFNSSGISEYAYTPPSTGVPSTWPTLDNLIGNNTRLITFVASLSEASTQYPFLMDEFTYVFENDYENINPSNYSCTPSRPTGLTTSSTGGRLFLMNHFLYENQLFGIQSPNASYAPTTNGQTGFGSLGASVSNCSTVYGKAPWAVLVDFFNVGPAIASVDAANGISGSITGRRSLSTDALTEESESGVARAQGSLLAVIVAVVVAVGFGM

SEQ ID NO: 4953 - protein, 440 aa, Unknown
  Kingdom: Fungi, Phylum: Ascomycota
MRGTTLSLLWLASLAAGQSSSASTASPSVITLTGTQRQLSGGESGGSVTVPSDFEGSTFATLTSSPSGSTASANATVSATESVINIGGSNRTRTPTGSATGSAALPQNTQPCNNYLEFCNRKYSNITEVAAHNSPFTKERNVGRNQDYGVTQQLNDGIRMLQGQAHYVNGTLYYCHTSCDLLNAGTVEDYLKEVVAWVEAHPFDVVTIIFGNYDYEEKDANGNPLVTSKDFDEPIRSSGLYQYIYQPPKTAMELADWPTLGQMLLQQKRVVTFIDYNFDTDAVPYLLWEFYNMWETPYSPTDDNFPCTIGRPEGVSNEKAHDMLYMANHNLNVEIAIAGLNLLVPNVAATNQTNGLEGNGSLGLMANQCTSDWGRPPNFLLVDFYNQGPINGSVFEVAARANNVTYNRECCGKATSLATVLAPSATYFALVIAVVAVLMI

SEQ ID NO: 4954 - protein, 370 aa, Unknown
  Kingdom: Fungi, Phylum: Ascomycota
MKHFGVSLILALAAAPFAVAGRACNNAEELCDTSYDQMTHLGAHDSPFLRDDSTGFSSFGNQFFNTTVQLDAGVRLLSAQIHVAENKDTKAREIHLCHTSCGLFDVGTFQTWLWEIHLWMAANPNEVVTLVLVNMDGISAVELETEYARADIAHFGYVPENINHAPAPSSEFKKTWPTLGEMIDKGSRLVTFVQPLNPDQMNAPYLLNEFDFVWENAYDVRNATDFACKPDRPSNTTTVDQERDSGKLMLMNHMLYWQQAMGIEVPDIRNINNTNSWDGTGGLGEHMTRCGQIVAKQPTFVLVDFFNVGPAMKAVDIFNGVDNPVGRKNVTTEVIAGGAGNNYYVSAGDKMGSNAWAALVVAAVGIALCT

SEQ ID NO: 4955 - protein, 554 aa, Unknown
  Kingdom: Fungi, Phylum: Ascomycota
MKFATGLAGIGAVAATLLGSVSAASYDDIPDIEVYGQHFFYTNNGSQFYLKGVAYQQNYSPNGSTSSDTTYTDPLADGDACRRDIPYLKQIYTNILRVYAIDPTKDHDDCMAQLASADIYVIADLGEPGTSIRSNDPEWDVTLYQRYTGVVDALQKYKNVVGFFAGNENVSAGNQTAAAAFVKAAVRDVKGYISARGYRNTLGVGYATADVPTRDELAYYFACEPGNTGNSTQIDYWGYNVYSWCGDSTYAASSYGERVDFFSDYPVPVFFAEYGCIEGLESEGGATHRPFTEVEVLFGNMTDVFSGGIVYEWFMGVNNYGLISLTNNDASVSPYPDFTSLQSQLATVSPTITQRSTYTPSNSAPACPTVDASWQAEASPLPPSPNSALCSCMVASLQCNIDSTDEESYADVFNFICGANEDFCAGIARNATTGSYGGYSGCDPKDQLAWVANQYYLGNGRSSSACAFSGVATVQSAATASTCSSLLEAVGTAGLSTAASPTGVGTAGATGAASSTSRGAAAGFNGPKAVEHGGLIMGIWTVVAAGSLLGMLVL

SEQ ID NO: 4956 - protein, 2153 aa, Unknown
  Kingdom: Fungi, Phylum: Ascomycota
MTRNEPSTTRQGSTDSSWSARTSDTVRPYGRHSSLRGTPVTVKTSKDPNAPYVYTPAASAQHPAVATRPLRLSSQHCATGAVCAARSTPIDKESEISPTTVPPAPPPKDPQHQPRKPPTWDGPVSNDFRDHRKDLAVLQTSGGRVPSILRNPPTASTANPNPPWASGPNGGTNMANSVWNSFFNDSDNDDVAQLSPGFAPVGNNSREDAMGFPKDDRRPSVASAMTVSSTGSKSSFSRGFHKKLQNVFGEDFPGDGRQNSDPSLNGKSQNTETQSLHAPRNRGNSLGNNYGGGGYNSRPTSPTSSRPRTPQPSSEVTPWEFQAPQDAPFLAENGRRRSSEQASTKSGNRTHKITSRLPGHRHHRSKEENKTAPDSRGDISAPYPLRPATSREDSYSGRRNQPQQSALGSAFASKTSLVPRSSSPTPSAYSEMTPQSVAQQSQSPSTSKGPGRFFARLRGKDKTDSHPTVEHLKNMPAGSSQVSLPPSINGPPSVRADPNQPSFISRKKSTFEQLKGPSNVPKDGKKEHRRLPFKNSDKRQMSMAEARGKDPNEAIADTTGNEAMWFLDTKLDDMSGIVNPQKPPMTPPTGDVQHTTLAGDDEPGPRDDTWDAPDSWAVKRHDEVREASIDEPEVAAKEQNDTKTYCLRIFRADSTFATLSASLNTTVAEIIQILGKKTVLQDELDNYHIVMRKHDTSRQLDSNERPLLIQKRLLEQAGYSEADRLEDVGREDNSYLCRFTFLPAKMSGFSSLEKDPGFKQMQKFSHIDLQGKNLITIPITLYQKATEIISLNLSRNLSLDVPKDFIQACTNLREIKYTSNDARRLPQSLSMASRLTMLDISNNCLQTLEKAELQKLQSLQGLRLSNNGLTSLPSYFGQYRALRSLNLSSNSLTEFPDFLCEVRTLVDLDISFNSISSLPKIGQLTCLERLWATNNKLSGSFPSNFSNLINLREVDVRFNALDSMDVMSQLPRLEFLMIGHNSISAFEGYFPKIRVLHMNHNPVTRFGLSGPVPSLSVLNLASAKLAQLPEDLFQKLTGLTKLILDKNHFTSLSNNIGRLYRLEHLSVARNSLDELPAEIGRLLELRYLDVRENNLGRLPPEIWYARRLETLNVSSNVLDAFPKPSAAPPAEANSGIQLDGSHSLSLTPGLGSSPSYEELGKLEDFQNRRPSQASGGYLSSGTSPASTNRKGSMASFNTASTARKPSAASRAQTEGTLTPMSRKDSSLSSRMVTTFAGSLRHIFLADNRLEDNVFDELCLLPELRIVNLSYNLIYDVPTRTIRRWQHLTELYLSGNDLTSLPSEDLEEVGSLKVLHINNNKFQVLPAELGKVAQLAVLDVASNSLKYNVSNWPYDWNWNWNHKLRYLNLSGNKRLEIKPSGSYSGSGAAMREGRDLTDFTALVSLRVLGLMDVTMMIPSVPEQTEDRRVRTAGSAVGTMAYGMADSLGRTEHISTMDMVVPRFRSHDDEQVLGLFDAQPLAGGGSKIAKFLYDNFKNRFADELDRLRPSETPVDALRRTYLGLNKELATAASQSLDKNAYTPPTQPRGAVPELGEDDLTSGCVATVMYLKEMELYMSNVGDAQALLIRSEGGHKILTRKHDPAEPSERARIREAGGFVSRQGKLNDVLEVSRAFGYVQMSPSVIASPHIVNLKLGDTDEMILVASRELWEYLTPDFAVDVARSERNDLMRAAQKLRDLAIAFGATNKIHVMLLGVSDLKSKQRARFRTHSMSMGPTGSPDDFAVRRPGKRARNMVNDSKLARLDQEVDAPTGEVSLVFTDIKSSTLLWETYPIAMRSAIKMHNELMRRQLRIIGGYEVKTEGDAFMVAFRTVTSALLWCFTIQSQLLEVQWPQEILNSVNGQEVVDADGNVIFRGLSVRMGIHWGRPVCEVDPVTRRMDYFGPMVNRASRISSVADGGQITVSSDFIAEIQRLLETHIEGDRSNSTGSEEAYGDDVHSHLIRQELRSLSSQGFEVKDLGERRLKGLENPEYIYLMYPHSLASRLVVQRQLEEQAAPAAQEPSIGQKMPGSQLTIDTEDVWDLWNISLRLEMLCSTLENPGSSELKAPETALLERMKNRGGEITDRFLINFVEHQISRIESCATTLALRHMMRPFGSAPLLQQACHMGDIFSELEAKLKRLEQFEREAMADMAPS

SEQ ID NO: 4957 - protein, 497 aa, Unknown
  Kingdom: Fungi, Phylum: Ascomycota
MPSLIRSLALVPALLSSIAQAVNPVEIRGLDFVDTVTNKRLMIVGVDYQPGGQAGYKPTSKQDALTDADVCLRDAVVMQKLGVNTIRVYNVDPTLDHSECMSIFNAAGIYLILDVNSPFSGESINRAEPWTSYHEDYLTRIFGVVENFKNFPNTLAFFAANEVMNDLTTAEYNPMYIRAVQRDLKNYIKNHVDRTIPVGYSAADVREILHDTWAYMQCSHDDDQSSSDFFGLNSYSWCGNGDMQSSGYTDMVNMFKNSSIPVFYSEYGCNKVQPRIFTEVEALYGEQMTVLSGGLVYEYSQEEADYGLVVINENGTLSLREDFENLQGQFNKLDLSLIQSTNSSGNLQPPECSMDLITAEEFSTNFTIPAVCPGCADIIKNGISNPMNGKLVDVTNTKPKQAVYGTNGAEIEGLELTKLTEVNVPGGSNFSSGTASGTATGTAAQPSATKTGSASSVVSTPSTPSPTSTPTAKGKASSLDETKFLWFALVTFWVVGR
